United States Patent
Gilbert et al.

(10) Patent No.: US 11,254,933 B2
(45) Date of Patent: Feb. 22, 2022

(54) CRISPR/CAS TRANSCRIPTIONAL MODULATION

(71) Applicant: THE REGENTS OF THE UNIVERSITY OF CALIFORNIA, Oakland, CA (US)

(72) Inventors: Luke A Gilbert, San Francisco, CA (US); Max Horlbeck, Oakland, CA (US); Martin Kampmann, Oakland, CA (US); Lei S Qi, Oakland, CA (US); Jonathan S Weissman, San Francisco, CA (US)

(73) Assignee: The Regents of the University of California, Oakland, CA (US)

( * ) Notice: Subject to any disclaimer, the term of this patent is extended or adjusted under 35 U.S.C. 154(b) by 0 days.

(21) Appl. No.: 15/326,428

(22) PCT Filed: Jul. 14, 2015

(86) PCT No.: PCT/US2015/040449
§ 371 (c)(1),
(2) Date: Jan. 13, 2017

(87) PCT Pub. No.: WO2016/011080
PCT Pub. Date: Jan. 21, 2016

(65) Prior Publication Data
US 2017/0204407 A1    Jul. 20, 2017

Related U.S. Application Data

(60) Provisional application No. 62/024,373, filed on Jul. 14, 2014.

(51) Int. Cl.
*C12N 15/10* (2006.01)
*C12Q 1/6897* (2018.01)
*C12N 15/63* (2006.01)

(52) U.S. Cl.
CPC ....... *C12N 15/1079* (2013.01); *C12N 15/102* (2013.01); *C12N 15/1082* (2013.01); *C12N 15/63* (2013.01); *C12Q 1/6897* (2013.01)

(58) Field of Classification Search
CPC .................... C12N 15/1079; C12N 2310/20
See application file for complete search history.

(56) References Cited

U.S. PATENT DOCUMENTS

| | | | | |
|---|---|---|---|---|
| 8,697,359 B1* | 4/2014 | Zhang | .................... | C12N 15/85 435/6.1 |
| 2014/0068797 A1* | 3/2014 | Doudna | .............. | C12N 15/102 800/18 |
| 2015/0376586 A1* | 12/2015 | May | ..................... | C12N 15/111 424/93.7 |
| 2016/0289673 A1 | 10/2016 | Huang et al. | | |

FOREIGN PATENT DOCUMENTS

| | | |
|---|---|---|
| WO | 2014/005042 A2 | 1/2014 |
| WO | 2014/093655 A2 | 6/2014 |
| WO | 2014/093701 A1 | 6/2014 |
| WO | 2014/099744 A1 | 6/2014 |

OTHER PUBLICATIONS

Shalem et al. (2014) Genome-Scale CRISPR-Cas9 Knockout Screening in Human Cells. Science, 343:84-8, and supplementary materials.*
Kouzarides, T. (2007) Chromatin Modifications and Their Function. Cell, 128:693-705 (Year: 2007).*
Bendich et al. (2000) Prokaryotic and eukaryotic chromosomes: what's the difference? BioEssays, 22:481-486 (Year: 2000).*
DNA Polymerase II, MeSH Descriptor Data 2018, revised Jul. 8, 2013, obtained at <https://meshb.nlm.nih.gov/record/ui?ui=D004257> on Apr. 13, 2018, 2 pages (Year: 2013).*
DNA Polymerase III, MeSH Descriptor Data 2018, revised Jul. 8, 2013, obtained at <https://meshb.nlm.nih.gov/record/ui?name=DNA%20Polymerase%20III (Year: 2013).*
Mueller-Planitz et al. (2013) Nucleosome sliding mechanisms: new twists in a looped history. Nature Structural & Molecular Biology, 20(9): 1026-1032 (Year: 2013).*
Whitehead et al. (2005) Variation in tissue-specific gene expression among natural populations. Genome Biology, 6(R13): pp. 1-14 (Year: 2005).*
Bassik et al. (2013) A Systematic Mammalian Genetic Interaction Map Reveals Pathways Underlying Ricin Susceptibility. Cell 152: 909-922 (Year: 2013).*
Nielsen et al. (2013) Mechanism of Eukaryotic RNA Polymerase III Transcription Termination. Science, 340:1577-1580, and supplementary materials (Year: 2013).*
Matveeva et al. (2010) Optimization of Duplex Stability and Terminal Asymmetry for shRNA Design. PLoS ONE, 5(4):e10180, pp. 1-9 (Year: 2010).*
Forrest et al. (2014) A promoter-level mammalian expression atlas. Nature, 507:462-471 (Year: 2014).*
Wu et al. (2014) Genome-wide binding of the CRISCRISCRISCRISPR endonuclease Cas9 in mammalian cells. Nature Biotechnology, 32(7):670-676 (Year: 2014).*
Mali et al. (2013) RNA-Guided Human Genome Engineering via Cas9. Science, 339:823-826 (Year: 2013).*
Radzisheuskaya et al. (2016) Optimizing sgRNA position markedly improves the efficiency of CRISPR/dCas9-mediated transcriptional repression. Nucleic Acids Research, 44(18):e141, pp. 1-13 (Year: 2016).*
Dreos et al. (2013) EPD and EPDnew, high-quality promoter resources in the next-generation sequencing era. Nucleic Acids Research, 41:D157-D164 (Year: 2013).*
Wu et al. (2013) Assessing the impact of human genome annotation choice on RNA-seq expression estimates. BMC Bioinformatics, 14(Suppl 11):S8, pp. 1-13 (Year: 2013).*

(Continued)

*Primary Examiner* — Neil P Hammell
(74) *Attorney, Agent, or Firm* — Kilpatrick Townsend & Stockton LLP

(57) ABSTRACT

Methods, compositions, and kits are provided for CRISPR/Cas mediated transcriptional modulation.

17 Claims, 47 Drawing Sheets

Specification includes a Sequence Listing.

(56) References Cited

OTHER PUBLICATIONS

Lei et al., Repurposing CRISPR as an RNA-Guided Platform for Sequence-Specific Control of Gene Expression, Cell, vol. 152, No. 5, Feb. 28, 2013.
Maeder et al., CRISPR RNA-guided activation of endogenous human genes, Nature Methods, vol. 10, No. 10, Jul. 25, 2013.
Mali et al., CAS9 transcriptional activators for target specificity screening and paired nickases for cooperation genome engineering, Nature Biotechnology, vol. 31, No. 9, Aug. 1, 2013.
Farzadfard et al., "Tunable and Multifunctional Eukaryotic Transcription Factors Based on CRISPR/Cas", ACS Synthetic Biology, vol. 2, No. 10, Oct. 18, 2013.
Larson et al., CRISPR interference (CRISPRi) for sequence-specific control of gene expression, Nature Protocols, vol. 8, No. 11, Nov. 1, 2013.
Koike-Yusa et al., "Genome-wide recessive genetic screening in mammalian cells with a lentiviral CRISPR-guide RNA library", Nature Biotechnology, vol. 32, No. 3, Dec. 23, 2013.
Nissim et al., "Multiplexed and Programmable Regulation of Gene Networks with an Integrated RNA and CRISPR/CAS Toolkit in Human Cells", Molecular Cell, vol. 54, No. 4, May 22, 2014.
Kabadi et al., "Engineering synthetic TALE and CRISPR/Cas9 transcription factors for regulating gene expression", Methods, vol. 69, No. 2, Jul. 8, 2014.
Gilbert et al. "Genome-Scale CRISPR-Mediated Control of Gene Repression and Activation", Cell, vol. 159, No. 3, Oct. 1, 2014.
Tanenbaum et al., "A Protein-Tagging System for Signal Amplification in Gene Expression and Fluorescence Imaging", Cell, vol. 159, No. 3, Oct. 9, 2014.
The Partial Supplementary European Search Report from Appln. No. 15822737.1 dated Feb. 20, 2018.
Qi et al., "Repurposing CRISPR as an RNA-Guided Platform for Sequence-Specific Control of Gene Expression," Cell, 152, Feb. 28, 2013, 1173-1183.
Horlbeck et al., "Compact and highly active next-generation libraries for CRISPR-mediated gene repression and activation," eLife, 5, (2016), e19760.
Chen et al., Dynamic Imaging of Genomic Loci in Living Human Cells by an Optimized CRISPR/Cas System, Cell, vol. 155:1479-1491 Dec. 19, 2013.
Horlbeck et al., Compact and Highly Active Next-Generation Libraries for CRISPR-mediated Gene Repression and Activation, eLife, vol. 5, e19760, Sep. 23, 2016.
Horlbeck et al.,Nucleosomes Impede Cas9 Access to DNA In Vivo and In Vitro, eLife; vol. 5, e12677, Mar. 17, 2016.
KONERMANN et al., Optical Control of Mammalian Endogenous Transcription and Epigenetic States, Nature, vol. 500, 472-489, Aug. 22, 2013.
Rogers et al., Context Influences on TALE-DNA Binding Revealed by Quantitative Profiling, Nature Communications, vol. 6:7440, 1-10, Jun. 11, 2015.
Boettcher, Michael, et al., "Choosing the Right Tool for the Job: RNAi, TALEN, or CRISPR," Molecular Cell Review, 58, Elsevier Inc., pp. 575-585, May 21, 2015.
Gilbert, L., et al., "CRISPR Screening From Both Ways," Nature Review Genetics, AOP, vol. 15, Dec. 2014, published online; doi 10.1038/nrg3850; Original Research Paper: Gilbert, L.A., et al., "Genome-Scale CRISPR Mediated Control of Gene Repression and Activation," Cell http://dx.doi.org/10.1016/j.cell.2014.09.029 (2014).
Radzisheuskaya, A., et al., "Optimizing sgRNA Position Markedly Improves the Efficiency of CRISPR/dCas9-mediated Transcriptional Repression," Nucleic Acids Research, 2016, vol. 44, No. 18, pp. 1-13, e141, http://dx.doi.org/10.1093/nar/gkw583.
Zhu, S., et al., "Making Better CRISPR Libraries," eLIFE, 2016; 5:e21863, pp. 1-3, http://dx.doi.org/10.7554/eLife.21863.
Dreos, R. et al., EPD and EPDnew, high-quality promoter resources in the next-generation sequencing era, Nucleic Acids Research, 2013, vol. 41, Database issue D157-D164, https://academic.oup.com/nar/article-abstract/41/D1/D57/1078274.

* cited by examiner

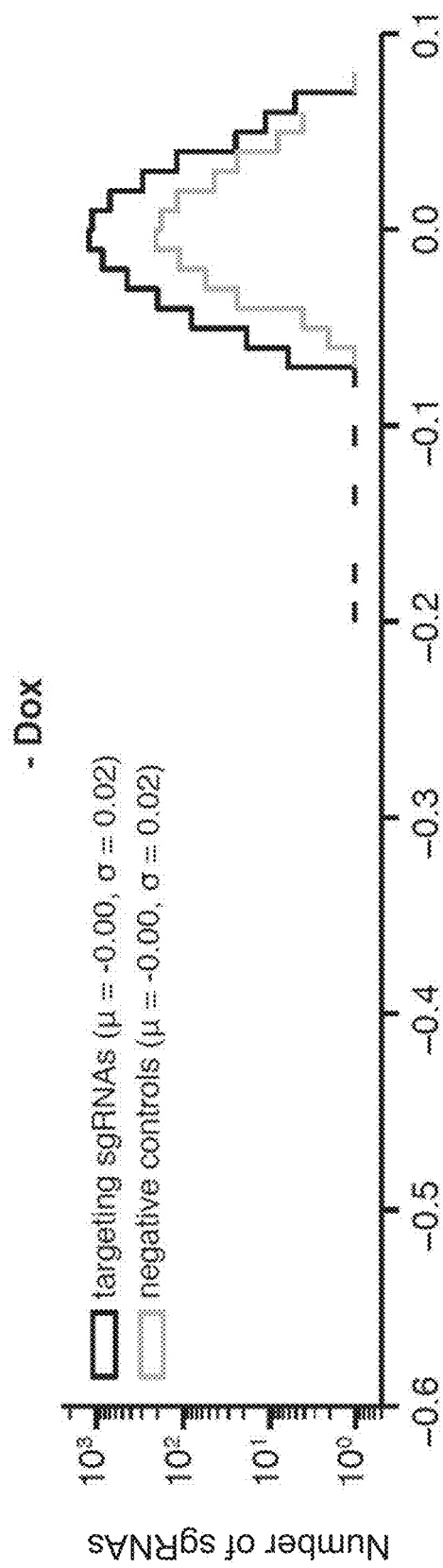
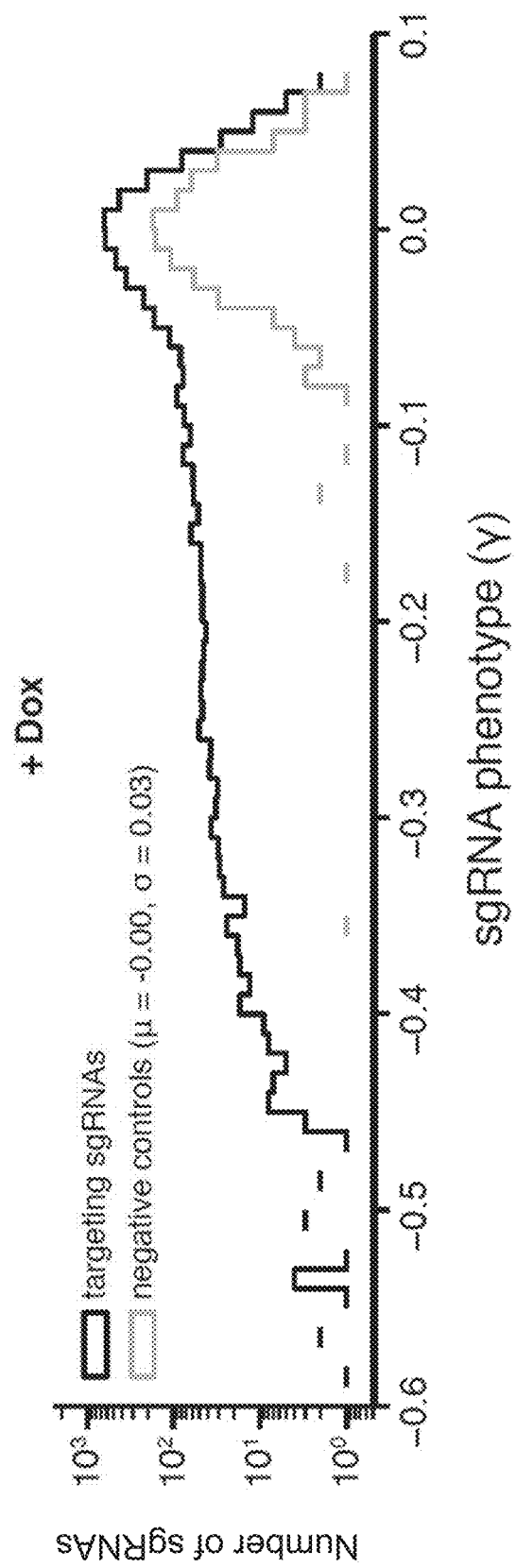
FIG. 5F
FIG. 5G

CRISPRi and CRISPRa sgRNA library construction (version 2)

Transcription Start Site Determination

Select genes to target

Extract Transcription Start Site (TSS) for each transcript from Ensembl annotaton (5' most position)
Group TSSs for gene within 200bp windows Define "primary" and "secondary" TSSs using the FANTOM5 Cap Analysis of Gene Expression (CAGE) Classifier
 -Search for "p1@gene" or "p2@gene" within 30kb of annotated TSS.
  where the gene name or synonym matches the gene of interest
  -In the above cases, assign "p1" to "primary" and "p2" to "secondary"
 -If not found, search instead for any "p1" and "p2" on the same strand within 500bp
  -In the above cases, assign "p1" to "primary" and "p2" to "secondary"
 -If not found, search for any "robust" TSS on the same strand within 200bp
 -If not found, search for any "permissive" TSS on the same strand within 200bp
  -In the above cases, assign most 5' TSS to "primary" and most 3' TSS to "secondary"
 -If no CAGE evidence found, assign annotated TSS to both "primary" and "secondary"

*FIG. 16A*

CRISPR/CAS TRANSCRIPTIONAL MODULATION

CROSS-REFERENCES TO RELATED APPLICATIONS

This application is a U.S. National Phase of PCT/US2015/040449, international filing date Jul. 14, 2015, which claims priority to U.S. Provisional Application No. 62/024,373, filed on Jul. 14, 2014, the contents of which are hereby incorporated by reference in the entirety for all purposes.

STATEMENT AS TO RIGHTS TO INVENTIONS MADE UNDER FEDERALLY SPONSORED RESEARCH AND DEVELOPMENT

This invention was made with government support under Grant Nos. OD017887, P50 GM102706 and RO1 DA036858 awarded by the National Institutes of Health. The government has certain rights in the invention.

REFERENCE TO A "SEQUENCE LISTING," A TABLE, OR A COMPUTER PROGRAM LISTING APPENDIX SUBMITTED AS AN ASCII TEXT FILE

This application includes a Sequence Listing as a text file named "81906_948709_seq_listing" created Jul. 13, 2015 and containing 127,743,598 bytes, machine format IBM-PC, MS-Windows operating system. The material contained in this text file is incorporated by reference in its entirety for all purposes.

BACKGROUND OF THE INVENTION

Clustered, regularly interspaced short palindromic repeat (CRISPR) sequences are present in approximately 40% of eubacterial genomes and nearly all archaeal genomes sequenced to date, and consist of short (~24-48 nucleotide) direct repeats separated by similarly sized, unique spacers. They are generally flanked by a set of CRISPR-associated (Cas) genes that encode a nuclease that is important for CRISPR maintenance and function. In *Streptococcus thermophilus* and *Escherichia coli*, CRISPR/Cas loci have been demonstrated to confer immunity against bacteriophage infection by an interference mechanism that relies on the strict identity between CRISPR spacers and phage target sequences. The mechanism underlying this immunity is based on sequence specific cleavage of foreign nucleic acids by a CRISPR:Cas complex that contains a guide RNA that provides target sequence specificity through a single stranded binding region and is derived from the CRISPR sequences and a guide RNA dependent nuclease encoded by the Cas gene. Binding of the CRISPR:Cas complex to the target sequence results in double stranded cleavage of the target sequence.

The CRISPR/Cas system has been modified for use in prokaryotic and eukaryotic systems for genome editing and transcriptional regulation. However, methods and compositions known the in art often fail to provide the activity and specificity necessary for routine use. For example, Cradick, et al., Nucleic Acids Res. Aug. 11, 2013; Pattanayak, et al., Nat Biotechnol. 2013 September; 31(9):839-43; Mali, et al., Nat Biotechnol. 2013 September; 31(9):833-8; and Hsu, et al., Nat Biotechnol. 2013 September; 31(9):827-32, all report significant off-target genome editing and varied editing efficiency across different gene targets. Similar issues also exist when using known CRISPR/Cas systems for regulation of transcription.

BRIEF SUMMARY OF THE INVENTION

In some embodiments, the present invention provides a method of screening for one or more genetic elements that modulate a phenotype, the method comprising: contacting a plurality of cells with a library of structurally distinct small guide RNAs (sgRNAs) that target a plurality of genetic elements, thereby generating a plurality of test cells, the plurality of test cells each comprising: a small guide RNA (sgRNA); and a nuclease deficient sgRNA-mediated nuclease (dCas9), wherein the dCas9 comprises a dCas9 domain fused to a transcriptional modulator; or a dCas9 domain fused to an epitope fusion domain, selecting the test cells on the basis of the phenotype; and quantitating the frequency of the structurally distinct sgRNAs within the population of selected cells, wherein the sgRNAs that target genetic elements that modulate the phenotype are overrepresented or underrepresented in the selected cells.

In some cases, the dCas9 comprises a dCas9 domain and a transcriptional activator. In some cases, the dCas9 domain and transcriptional activator comprises the amino acid sequence of SEQ ID NO:1 or 2. In some cases, the library of sgRNAs are targeted to a region between 0-750 bp upstream of the transcription start site of the targeted genes. In some cases, the dCas9 comprises a dCas9 domain and a transcriptional repressor. In some cases, the library of sgRNAs are targeted to a region between 0-1000 bp downstream of the transcription start site of the targeted genes. In some cases, the dCas9 domain and transcriptional repressor comprises the amino acid sequence of SEQ ID NO:3. In some cases, wherein the dCas9 comprises: a first dCas9 fused to a transcriptional repressor; and a second dCas9 fused to a transcriptional activator; or a second dCas9 fused to an epitope fusion domain. In some cases, at least a portion of the plurality of test cells comprise a Cas9 nuclease.

In some cases, the library of sgRNAs contains or contains at least 1; 2; 3; 5; 10; 100; 1,000; 10,000; 100,000; 200,000; 400,000; or 1 million structurally distinct sgRNAs. In some cases the, or the at least, 1; 2; 3; 5; 10; 100; 1,000; 10,000; 100,000; or 200,000 structurally distinct sgRNAs comprise binding regions that are independently selected from the group consisting of the sgRNA binding region sequences encoded by SEQ ID NOs:26-205,305. In some cases the, or the at least, 1; 2; 3; 5; 10; 100; 1,000; 10,000; 100,000; or 200,000 structurally distinct sgRNAs comprise binding regions that comprise a sequence independently selected from the group consisting of the sgRNA binding region sequences encoded by the 19 nucleotides at the 3' end of SEQ ID NOs:26-205,305.

In some cases the, or the at least, 1; 2; 3; 5; 10; 100; 1,000; 10,000; 100,000; or 200,000 structurally distinct sgRNAs comprise binding regions that are independently selected from the group consisting of the sgRNA binding region sequences encoded by SEQ ID NOs:205,306-410,595. In some cases the, or the at least, 1; 2; 3; 5; 10; 100; 1,000; 10,000; 100,000; or 200,000 structurally distinct sgRNAs comprise binding regions that comprise a sequence independently selected from the group consisting of the sgRNA binding region sequences encoded by the 19 nucleotides at the 3' end of SEQ ID NOs:205,306-410,595.

In some cases the, or the at least, 1; 2; 3; 5; 10; 100; 1,000; 10,000; 100,000; or 200,000 structurally distinct sgRNAs comprise binding regions that are independently selected from the group consisting of the sgRNA binding region sequences encoded by SEQ ID NOs:410,596-633,445. In some cases the, or the at least, 1; 2; 3; 5; 10; 100; 1,000; 10,000; 100,000; or 200,000 structurally distinct sgRNAs comprise binding regions that comprise a sequence independently selected from the group consisting of the sgRNA binding region sequences encoded by the 19 nucleotides at the 3' end of SEQ ID NOs:410,596-633,445.

In some cases the, or the at least, 1; 2; 3; 5; 10; 100; 1,000; 10,000; 100,000; or 200,000 structurally distinct sgRNAs comprise binding regions that are independently selected from the group consisting of the sgRNA binding region sequences encoded by SEQ ID NOs:633,446-857,995. In some cases the, or the at least, 1; 2; 3; 5; 10; 100; 1,000; 10,000; 100,000; or 200,000 structurally distinct sgRNAs comprise binding regions that comprise a sequence independently selected from the group consisting of the sgRNA binding region sequences encoded by the 19 nucleotides at the 3' end of SEQ ID NOs:633,446-857,995.

In some cases the, or the at least, 1; 2; 3; 5; 10; 100; 1,000; 10,000; 100,000; 200,000; or 400,000 structurally distinct sgRNAs comprise binding regions that are independently selected from the group consisting of the sgRNA binding region sequences encoded by SEQ ID NOs:26-410,595 or SEQ ID NOs:410,596-857,995. In some cases the, or the at least, 1; 2; 3; 5; 10; 100; 1,000; 10,000; 100,000; 200,000; or 400,000 structurally distinct sgRNAs comprise binding regions that comprise a sequence independently selected from the group consisting of the sgRNA binding region sequences encoded by the 19 nucleotides at the 3' end of SEQ ID NOs:26-410,595 or SEQ ID NOs:410,596-857,995.

In some cases, the sgRNAs are selected to inhibit transcription of human target loci (e.g., targeted to optimized human CRISPRi target sites), activate transcription of human target loci (e.g., targeted to optimized human CRISPRa target sites), inhibit transcription of mouse target loci (e.g., targeted to optimized mouse CRISPRi target sites), or activate transcription of mouse target loci (e.g., targeted to optimized mouse CRISPRa target sites).

In some cases, the dCas9 comprises a dCas9 domain and an epitope fusion domain, and wherein the plurality of cells further comprise an affinity agent, wherein the affinity agent has affinity to the epitope fusion domain and comprises a transcriptional activator. In some cases, the library of sgRNAs are targeted to a region between 0-750 bp upstream of the transcription start site of the targeted genes. In some cases, the transcriptional activator comprises a VP16 domain. In some cases, the transcriptional activator comprises a VP64 domain. In some cases, wherein the transcriptional activator comprises a plurality of VP64 domains.

In some cases, the epitope fusion domain comprises a GCN4 epitope and the affinity agent has affinity for the GCN4 epitope. In some cases, the epitope fusion domain comprises a plurality of GCN4 epitopes. In some cases, the dCas9 comprises an amino acid sequence of SEQ ID NO:4. In some cases, the affinity agent comprises an amino acid sequence of SEQ ID NO:5.

In some cases, the quantitating the frequency comprises deep sequencing. In some cases, the deep sequencing comprises sequencing with a redundancy of at least about 10. In some cases, the selecting the cells on the basis of the phenotype comprises culturing the cells, thereby selecting the cells on the basis of cellular proliferation. In some cases, the culturing is performed in the presence of a selection agent. In some cases, the selection agent is a chemotherapeutic, a DNA damaging agent, a cytotoxic agent, a growth factor, a transcription factor, a kinase, a drug, an exogenous gene under the control of a heterologous promoter, or a hormone. In some cases, the selecting the cells on the basis of the phenotype comprises selecting the cells on the basis of protein expression, RNA expression, or protein activity. In some cases, the selecting the cells on the basis of the phenotype comprises fluorescence activated cell sorting, affinity purification of cells, or selection based on cell motility.

In some cases, the specific sgRNAs that are overrepresented or underrepresented within the selected cells are overrepresented or underrepresented relative to the frequency of the corresponding sgRNAs in the sgRNA library. In some cases, the method further comprises contacting a plurality of control cells with the sgRNA library, wherein the plurality of control cells are not subject to the selecting on the basis of the phenotype, and the sgRNAs that are overrepresented or underrepresented in the selected cells are overrepresented or overrepresented relative to their frequency in the plurality of control cells. In some cases, the sgRNAs that are overrepresented or underrepresented in the selected cells are overrepresented or underrepresented relative to their frequency in the cells at an earlier time point in the culturing of the cells.

In some cases, the sgRNA is encoded by an expression cassette in the cell, the expression cassette comprising a promoter operably linked to a polynucleotide encoding the sgRNA. In some cases, the promoter operably linked to the polynucleotide encoding the sgRNA is inducible. In some cases, the nuclease deficient sgRNA-mediated nuclease (dCas9) is encoded by an expression cassette in the cell, the expression cassette comprising a promoter operably linked to a polynucleotide encoding the dCas9. In some cases, the promoter operably linked to the polynucleotide encoding the dCas9 is inducible. In some cases, the plurality of cells comprise a tetracycline transactivator, and wherein the method comprises expression of dCas9 under the control of a tetracycline inducible promoter in the absence of tetracycline or other exogenous inducer of the tetracycline inducible promoter. In some cases, the plurality of cells are contacted with a library of structurally distinct short hairpin RNAs (shRNA).

In some embodiments, the present invention provides a method of identifying a lead compound for treatment of a phenotype, the method comprising: performing any of the foregoing methods, thereby identifying a genetic element that modulates the phenotype; and identifying or screening for a lead compound that modulates expression of the genetic element; expression of a gene operably linked to the genetic element, or activity of a peptide encoded by the genetic element or a gene operably linked to the genetic element.

In some embodiments, the present invention provides a method of identifying interacting genetic elements, the method comprising: (i) performing any of the foregoing methods, thereby identifying a plurality of structurally distinct sgRNAs that target genetic elements that modulate the phenotype; (ii) contacting a plurality of interaction test cells with a library comprising a plurality of pairwise combinations of the structurally distinct sgRNAs identified in (i); (iii) selecting the test cells on the basis of the phenotype; and (iv) quantitating the frequency of the pairwise combinations of structurally distinct sgRNAs within the population of selected cells, wherein the pairwise combinations of structurally distinct sgRNAs that are overrepresented or underrepresented in the selected cells are predicted to target interacting genetic elements.

In some cases, the pair wise combinations of structurally distinct sgRNAs comprise a first member and a second member of the pair, and wherein the first member and second member target unlinked genetic elements. In some cases, the pairwise combinations of structurally distinct sgRNAs that are overrepresented or underrepresented in the selected cells are overrepresented or underrepresented relative to the frequency of the members of that pairwise combination in the selected cells of (i).

In some embodiments, the present invention provides a method of optimizing an sgRNA, the method comprising: performing any of the foregoing methods, wherein the plurality of structurally distinct sgRNAs target different regions within or next to a single genetic element, wherein the most overrepresented or underrepresented sgRNAs in the selected cells are identified as optimized sgRNAs that target the genetic element.

In some embodiments, the present invention provides a small guide RNA (sgRNA) comprising from 5' to 3': a binding region, of between about 19 and about 21 nucleotides in length; a 5' hairpin region, comprising: a unique endonuclease site; and fewer than four consecutive uracil nucleotides; or a length of at least 31 nucleotides; and a 3' hairpin region; and a transcription termination sequence, wherein the small guide RNA is configured to form a complex with a small guide RNA-mediated nuclease, the complex having increased stability or activity relative to a complex containing a small guide RNA-mediated nuclease and a small guide RNA comprising at least 95% identity to SEQ ID NO:6 or a complement thereof.

In some cases, the 5' hairpin region comprises fewer than four consecutive uracil nucleotides and a length of at least 31 nucleotides. In some cases, the unique endonuclease cut site is a BlpI site. In some cases, the small guide RNA has 19-25 or 21-28 nucleotides between the unique endonuclease site and the 5' end. In some cases, the small guide RNA comprises a binding region encoded by a sequence selected from the group consisting of (i) SEQ ID NOs:26-205,305; (ii) SEQ ID NOs:205,306-410,595; (iii) SEQ ID NOs:410, 596-633,445; (iv) SEQ ID NOs:633,446-857,995; (v). SEQ ID NOs:26-410,595; or (vi) SEQ ID NOs: 410,596-857,995. In some cases, the small guide RNA comprises a binding region encoded by a sequence selected from the group consisting of the 19 nucleotides at the 3' end of (i) SEQ ID NOs:26-205,305; (ii) SEQ ID NOs:205,306-410,595; (iii) SEQ ID NOs:410,596-633,445; (iv) SEQ ID NOs:633,446-857,995; (v). SEQ ID NOs:26-410,595; or (vi) SEQ ID NOs: 410,596-857,995.

In some embodiments, the present invention provides a method of constructing a library of any one of the foregoing small guide RNAs (sgRNAs), the method comprising: providing a polynucleotide encoding a sgRNA scaffold, the scaffold comprising from the 5' to 3' end: a unique endonuclease site, the unique endonuclease site having been cleaved by an endonuclease that recognizes the site; at least a portion of a 5' hairpin region comprising fewer than four consecutive uracil nucleotides or a length of at least 31 nucleotides; a 3' hairpin region; and a transcription termination sequence, chemically synthesizing a library of binding region encoding sequences containing, at the 3' end, a portion of a small guide RNA 5' hairpin region, and a region that complements the 3' unique endonuclease site of the small guide RNA scaffold; and ligating the library of binding region encoding sequences to the small guide RNA scaffold, wherein the small guide RNAs are configured to form a complex with a small guide RNA-mediated nuclease, the complex having increased stability or activity relative to a complex containing a small guide RNA-mediated nuclease and a small guide RNA comprising at least 95% identity to SEQ ID NO:6 or a complement thereof.

In some embodiments, the present invention provides a library of small guide RNAs (sgRNAs) that target a plurality of target genes comprising at least 2; 3; 4; 5; 6; 8; 10; 100; 1,000; 10,000; 50,000; 75,000; 100,000; 200,000; 400,000 or more structurally distinct sgRNAs, or a library of small guide RNA encoding sequences, or a library of small guide RNA binding region encoding sequences, as described in the foregoing embodiments, cases, or examples. In some cases, the sgRNAs are targeted to a region between 0-750 bp upstream of the transcription start site of the targeted genes. In some cases, the sgRNAs are targeted to a region between 0-1000 bp downstream of the transcription start site of the targeted genes. In some cases, the majority of the targeted genes are targeted with, targeted with no more than, or targeted with fewer than, 25, 20, 15, 11, 10, 6, 5, 4, or 3 structurally distinct sgRNAs. In some cases, the majority of sgRNAs are targeted to a region predicted to be accessible to sgRNA binding. In some cases, the region predicted to be accessible to sgRNA binding is selected from the group consisting of a region having a low micrococcal nuclease signal, a region having a high DNA polymerase III chromatin immunoprecipitation signal, and a region having a high run-on sequencing signal, or a combination thereof. In some cases, the region predicted to be accessible to sgRNA binding has a low micrococcal nuclease signal, a high DNA polymerase II chromatin immunoprecipitation signal, and a high run-on sequencing signal. In some cases, the majority of sgRNAs do not contain three or more or four or more repeated nucleotides, or do not contain three or more or four or more repeated U's, A's, G's, C's, or a combination thereof, excluding the 3' transcription termination sequence. In some cases, the majority of sgRNAs are targeted to a region predicted to be optimal for gene modulation by the dCas9-fusion protein. In some cases, at least $10^4$ genes are targeted, and the library contains fewer than $2.5 \times 10^5$, fewer than $2 \times 10^5$, fewer than $1 \times 10^5$, about $5 \times 10^4$, or fewer than $5 \times 10^4$ structurally distinct sgRNAs. In some cases, the sgRNAs are selected to have a binding region encoded by a sequence selected from the group consisting of SEQ ID NOs:26-410,595; selected from the group consisting of SEQ ID NOs: 410,596-857,995. In some cases, the sgRNAs are selected to have a binding region encoded by a sequence comprising the 19 nucleotides at the 3' end of any one or more (e.g., 2; 3; 4; 5; 10; 20; 40; 50; 100; 1,000; 5,000; 10,000; 15,000; 20,000; 50,000; 100,000; 200,000; 300,000; or 400,000, or more) or all of SEQ ID NOs:26-410,595; or any one or more (e.g., 2; 3; 4; 5; 10; 20; 40; 50; 100; 1,000; 5,000; 10,000; 15,000; 20,000; 50,000; 100,000; 200,000; 300,000; or 400,000, or more) or all of SEQ ID NOs: 410,596-857,995.

BRIEF DESCRIPTION OF THE DRAWINGS

FIG. 1A Depicts strategy for the massively parallel determination of growth or toxin resistance phenotypes caused by sgRNAs expressed in mammalian cells that also express dCas9 or dCas9-derived fusion constructs. Two types of large libraries can be used to define rules for CRISPRi/a or to perform genome scale screens to query the function of many genes in a pooled screen. FIG. 1B A map showing CRISPRi activity for all 49 genes in defined windows relative to the TSS of each gene. sgRNAs targeting the window of −50 to +350 bp around the TSS of a gene have maximal activity. FIG. 1C A schematic showing the genomic organization, GC content, and repetitive elements around the TSS of the gene, VPS54, across a 10 kb window targeted by the tiling sgRNA library. Many sgRNAs targeting dCas9 (top) and dCas9-KRAB (bottom) to VPS54 promote resistance to ricin. Each sgRNA is represented by one black dot. The data are displayed as a phenotype signed Z score (See methods of Example 6). FIG. 1D A sliding-window average of 49 genes targeted in a test sgRNA library is shown as a shaded region (top and bottom). The variable line between the 95th percentile and 5th percentile range displays median sgRNA activity in a defined window for each gene. The defined differentially shaded region in the center region of the bottom graph is the observed average window of maximum CRISPRi activity. The data are displayed as a phenotype signed Z score. FIG. 1E Depicts ricin resistance phenotypes comparing CRISPRi to RNAi for genes previously established to cause ricin resistance phenotypes when knocked down by RNAi. The data is displayed as a mean phenotype signed Z score for 10 subsampled sgRNAs or siRNAs.

FIG. 3A A schematic of the dCas9-SUN-tag+scFV-VP64+ sgRNA system for CRISPRa. Each component of the system is stably expressed in K562 cells. FIG. 3B The activity of sgRNAs in K562 cells expressing each component of CRISPRa, as a function of the distance of the sgRNA site to the TSS of the targeted gene; gene activation results in a negative ricin phenotype score. Top, many sgRNAs targeting VPS54 sensitize cells to ricin; Bottom, sliding-window average of all 49 genes targeted by our test library is shown in shaded. The median activity is shown with a variable line while the window of maximal activity is shown as a differentially shaded region. The data is displayed as a phenotype signed z-score. FIG. 3C Ricin resistance phenotypes for CRISPRa are anti-correlated to phenotypes for CRISPRi (dCas9-KRAB) for select genes. For each gene, a p-value is calculated using CRISPRi/a sgRNA activity relative to a negative control distribution for 24 subsampled sgRNAs. FIG. 3D CRISPRi knockdown and CRISPRa activation of the same gene can have opposing effects on the ricin resistance phenotype in both a primary screen and single sgRNA validation experiments. Data is represented as the mean and standard deviation of replicates (N=3). FIG. 3E CRISPRi knockdown and CRISPRa activation can modulate expression levels of a gene (as quantified by qPCR) over several orders of magnitude.

FIG. 4A A genome-scale CRISPRi screen was carried out in replicate in the human K562 cell line. Three classes of negative control sgRNAs are shown non-targeting sgRNAs, sgRNAs targeting Y-chromosomal genes, and sgRNAs targeting olfactory genes show no reproducible phenotypes. A subset of sgRNAs in the library strongly deplete in a reproducible manner (black). FIG. 4B Co-expression of sgRNAs and dCas9-KRAB is not toxic in K562 cell lines over 16 days. FIG. 4C Gene set enrichment analysis was performed for several essential cellular complexes. A histogram of gene distribution is shown under the GSEA curve. FIG. 4D The top 10 DAVID annotation clusters identified in our growth screen are strongly enriched for known essential cellular processes.

FIGS. 5A-5H: CRISPRi Gene Silencing is Robustly Inducible and Reversible and Non-Toxic. FIG. 5A A schematic depicting the lentiviral expression construct encoding inducible KRAB-dCas9. FIG. 5B Western blot analysis of inducible KRAB-dCas9 in the absence, presence, and after washout of doxycycline. Samples were collected daily from the same NegCtrl-4 sgRNA-expressing cells processed for RT-qPCR in FIG. 5C. FIG. 5C CRISPRi mediated gene repression is reversible. K562 cells expressing two sgRNAs targeting RAB1A were grown with or without doxycycline or doxycycline for 10 days or doxycycline was withdrawn at day 4. RAB1A mRNA levels were measured at each indicated time point by qPCR. FIGS. 5D and 5E Competitive growth assays performed with inducible CRISPRi K562 cells transduced with the indicated sgRNAs in the presence and absence of doxycycline. Data represent the mean of replicates (N=3) normalized to NegCtrl-1 results. Error bars represent standard deviation. FIGS. 5F and 5G A CRISPRi sub-library screen for effects on cell growth was performed with inducible CRISPRi K562 cells in the presence and absence of doxycycline. FIG. H Cumulative growth curves from the sub-library screen represented in FIGS. 5F and 5G show no bulk changes to growth caused by induction of KRAB-dCas9. Data represent the mean of replicate infections each screened in duplicate.

FIG. 6A A proposed model for CTx-DTA binding, retrograde trafficking, retro-translocation and cellular toxicity. FIG. 6B Gene set enrichment analysis of top hits from two replicate genome-scale CRISPRi screens for genes modulating sensitivity to CTx-DTA demonstrates strong enrichment for genes in known host pathways hijacked/targeted by CTx-DTA. FIG. 6C Overview of top hit genes detected by the CTx-DTA screen. Many genes fall into pathways, or encode subunits of the same physical complex. Pathways expected based on previous knowledge of CTx-DTA action (ganglioside biosynthesis, diphthamide biosynthesis, retrograde trafficking, ERAD, proteasome, translation) are each represented by several top hits, illustrating the robustness of CRISPRi based screening.

FIG. 7A-FIG. 7C A representative western blot and quantification of cholera toxin trafficking in cells expressing a negative control sgRNA or an sgRNA targeting SEL1L or B4GALNT1. Cholera toxin is distributed in both the cytosolic and membrane fractionation in control cells and according to their proposed function in CTx binding is blocked when B4GALNT1 is repressed or CTx is trapped in the ER upon repression of SEL1L. FIG. 7D Validation of CTx-DTA screen phenotypes with single sgRNA re-test experiments. Data are represented as the mean and standard deviation of replicates (N=3). FIG. 7E CRISPRi knockdown of 5 hit genes (15sgRNAs) identified in the CTx-DTA screen was quantified by qPCR. The gray shaded region denotes sgRNAs showing at least 90% knockdown for each gene. FIG. 7F Receiver operating characteristic (ROC) curve showing the performance of an improved sgRNA predictive score. FIG. 7G Simulation of library performance with decreasing numbers of sgRNAs targeting each gene. The phenotype for hit genes was calculated as the average of the top 3 most active sgRNAs, and overall library performance was expressed as the mean phenotype of all hit genes. The size of the library was computationally compacted by randomly subsampling sgRNAs or selecting sgRNAs based on the predictive score, and the remaining library activity is plotted as a percent of the full 10 sgRNA per gene library activity.

FIGS. 8A and 8B The formulas for deriving cellular phenotype from measurements of cell fraction in a population at discrete timepoints. Cells with a given genotype have an intrinsic growth rate g, often expressed as cell doublings per day. The $\log_2$ enrichment ($\log_2 e$) of cells with a specific genotype in a population can be calculated from the fraction of cells in the population at the endpoint t versus that fraction at t0. In order to express this as the growth rate relative to wild-type ($\gamma$), $\log_2 e$ is normalized to the median $\log_2 e$ of the negative control set and then divided by t. Similarly, the phenotype of cells exposed to a selective pressure (e.g., toxin treatment) can calculated from the $\log_2 e$ of treated and untreated populations to obtain $\rho$, which is +1 for completely resistant cells and −1 for cells with 2-fold sensitivity to the pressure relative to wild-type. FIG. 8C In order to quantify the strength of individual sgRNA activity relative to noise in the experiment, sgRNA phenotype was divided by the standard deviation of negative control phenotypes to yield the z-score. For analyses of sgRNA strength in tiling screens, in which genes had known knockdown phenotypes for either sensitivity or resistance, z-scores were re-signed to give positive values where the phenotypes agreed with the expected phenotype and negative values otherwise.

FIG. 9A-FIG. 9G: Highly active CRISPRi sgRNAs are close to the TSS, short and do not contain nucleotide homopolymers. FIG. 9A-FIG. 9B For several example genes, the phenotypes observed for sgRNAs expressed in dCas9 or dCas9-KRAB cells as a function of their position with respect to the TSS are depicted. Each point is an sgRNA. FIG. 9C Shorter sgRNAs have, on average, significantly higher activity. Each point represents an sgRNA, with lines connecting related sgRNAs that target the same PAM site but have increasing protospacer base pair length. Black lines represent the median activity for sgRNAs of specific lengths. sgRNAs are depicted if there are multiple sgRNAs targeting the same site and at least one sgRNA at that site is highly active (phenotype-signed z-score≥5). FIG. 9D sgRNA sequences with very high or very low GC content are less active. FIG. 9E The presence of homopolymers (AAAA, GGGG, UUUU) within an sgRNA reduces activity on average. FIG. 9F The DNA strand targeted by an sgRNA has no effect on activity. FIG. 9G A comparison of a subset of sgRNAs selected based on CRISPRi activity rules versus our previously published shRNA library. For each gene, the Mann-Whitney p-value was calculated using sgRNA or shRNA activity relative to a negative control distribution using 24 shRNAs or 24 sgRNAs. The 24 shRNAs and sgRNAs were randomly selected 100 times from the shRNA library and sgRNAs meeting position and length rules, respectively, and the median and SD $\log_{10}$ p-value are displayed.

FIG. 11A The activity of sgRNAs in a CRISPRa cell line as a function of the distance of the sgRNA site to the TSS of the targeted gene for four example genes. Top, ARL1 and ST3GAL4 activation results in ricin resistance; bottom, SURF4 and RAB1A activation results in ricin sensitivity. FIG. 11B A sliding-window average only for genes with a significant CRISPRa ricin resistance phenotype targeted by our test library is shown as a shaded region. The median activity is shown with a variable line while the window of maximal activity is shown in a differentially shaded region. The data is displayed as a phenotype-signed z-score.

FIG. 12A Competitive growth assays performed with inducible CRISPRi K562 cells transduced with the indicated RAB1A-targeting sgRNAs in the presence of doxycycline. Data represented as the mean and standard deviation of replicates (N=3). FIG. 12B CRISPRi knockdown of hit genes identified in the genome-scale growth screen (9 sgRNAs) was quantified by qPCR after two days of doxycycline treatment. The gray shaded region denotes sgRNAs showing at least 90% knockdown for each gene. See also FIGS. 5D and 5E.

FIG. 13A-FIG. 13E: A Genome-Scale CRISPRi Screen Reveals Known and New Pathways and Complexes Governing the Response to a Choler-Diptheria Fusion Toxin. FIG. 13A Two replicate genome-scale CRISPRi screens for CTx-DTA sensitivity show high reproducibility and robust enrichment and sensitization for individual sgRNAs. FIGS. 13B-13E Overview of top hit genes detected by the CTx-DTA screen. Many genes fall into pathways, or encode subunits of the same physical complex. Pathways expected based on previous knowledge of CTx-DTA action (ganglioside biosynthesis, diphthamide biosynthesis, retrograde trafficking, ERAD, proteasome, translation) are each represented by several top hits, illustrating the robustness of CRISPRi based screening.

FIG. 14A sgRNAs with longer protospacers are less active. FIG. 14B sgRNAs with poly-U homotrimers, homotetramers or more have decreased activity. FIG. 14C Overall purine content of sgRNAs correlates with increased activity. FIG. 14D sgRNA activity varies depending on the base immediately following the PAM. FIG. 14E sgRNA activity is optimal within a window from +25 to +100 bp.

FIG. 16A-FIG. 16C: Depict a flow chart for identifying optimized sgRNA binding region encoding sequences.

DEFINITIONS

Figure 1A:
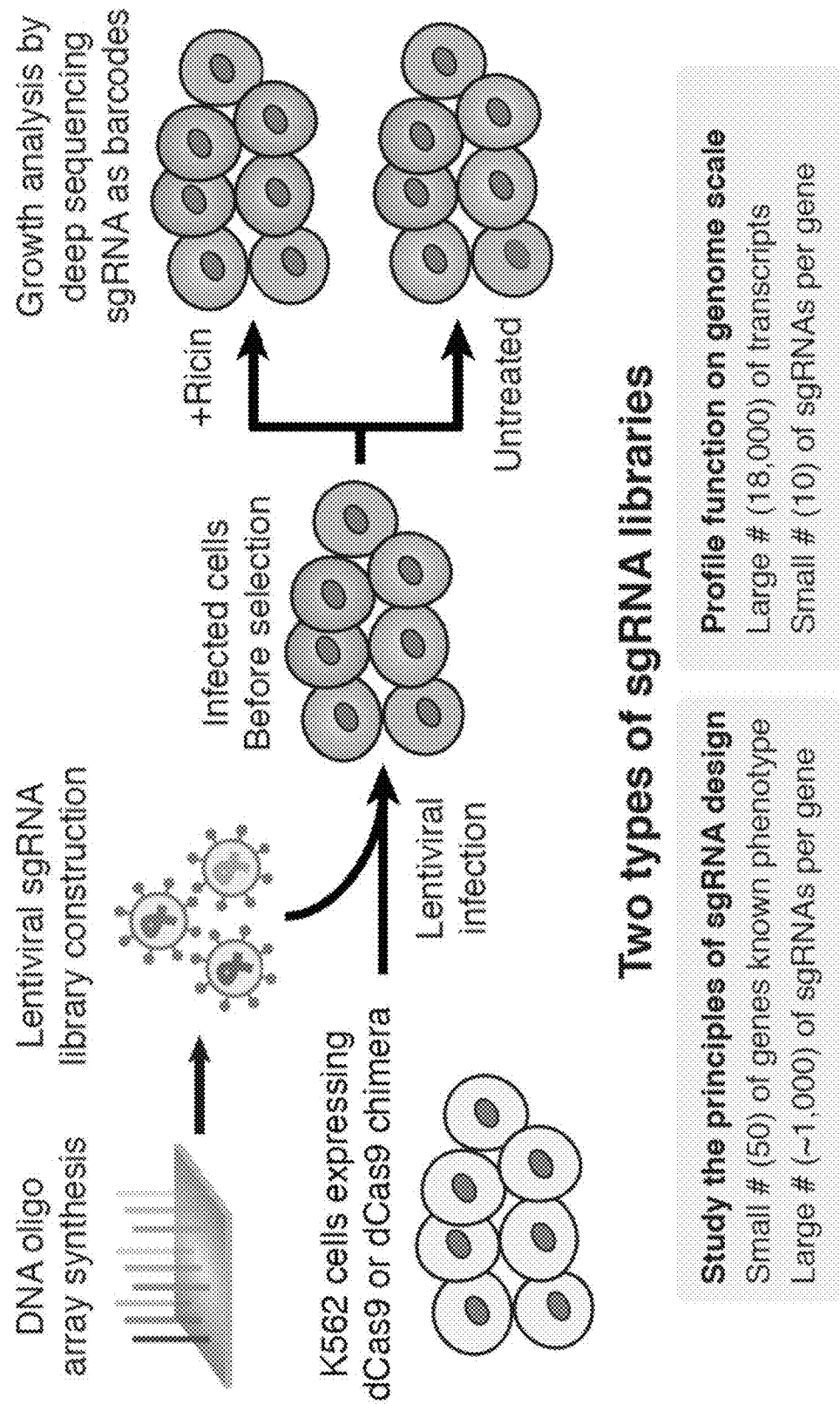
FIGS. 1A-1E: A Tiling sgRNA Screen Defines Rules for CRISPRi Activity at Endogenous Genes in Human Cells.

As used in this specification and the appended claims, the singular forms "a," "an," and "the" include plural reference unless the context clearly dictates otherwise.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., *Nucleic Acid Res.* 19:5081 (1991); Ohtsuka et al., *J. Biol. Chem.* 260:2605-2608 (1985); and Rossolini et al., *Mol. Cell. Probes* 8:91-98 (1994)). The term nucleic acid is used interchangeably with gene, cDNA, and mRNA encoded by a gene.

The term "gene" means the segment of DNA involved in producing a polypeptide chain. It may include regions preceding and following the coding region (leader and trailer) as well as intervening sequences (introns) between individual coding segments (exons).

A "promoter" is defined as an array of nucleic acid control sequences that direct transcription of a nucleic acid. As used herein, a promoter includes necessary nucleic acid sequences near the start site of transcription, such as, in the case of a polymerase II type promoter, a TATA element. A promoter also optionally includes distal enhancer or repressor elements, which can be located as much as several thousand base pairs from the start site of transcription.

An "expression cassette" is a nucleic acid construct, generated recombinantly or synthetically, with a series of specified nucleic acid elements that permit transcription of a particular polynucleotide sequence in a host cell. An expression cassette may be part of a plasmid, viral genome, or nucleic acid fragment. Typically, an expression cassette includes a polynucleotide to be transcribed, operably linked to a promoter.

A "reporter gene" encodes proteins that are readily detectable due to their biochemical characteristics, such as enzymatic activity or chemifluorescent features. One specific example of such a reporter is green fluorescent protein. Fluorescence generated from this protein can be detected with various commercially-available fluorescent detection systems. Other reporters can be detected by staining. The reporter can also be an enzyme that generates a detectable signal when contacted with an appropriate substrate. The reporter can be an enzyme that catalyzes the formation of a detectable product. Suitable enzymes include, but are not limited to, proteases, nucleases, lipases, phosphatases and hydrolases. The reporter can encode an enzyme whose substrates are substantially impermeable to eukaryotic plasma membranes, thus making it possible to tightly control signal formation. Specific examples of suitable reporter genes that encode enzymes include, but are not limited to, CAT (chloramphenicol acetyl transferase; Alton and Vapnek (1979) Nature 282: 864-869); luciferase (lux); β-galactosidase; LacZ; β-glucuronidase; and alkaline phosphatase (Toh, et al. (1980) Eur. J. Biochem. 182: 231-238; and Hall et al. (1983) J. Mol. Appl. Gen. 2: 101), each of which are incorporated by reference herein in its entirety. Other suitable reporters include those that encode for a particular epitope that can be detected with a labeled antibody that specifically recognizes the epitope.

The term "amino acid" refers to naturally occurring and synthetic amino acids, as well as amino acid analogs and amino acid mimetics that function in a manner similar to the naturally occurring amino acids. Naturally occurring amino acids are those encoded by the genetic code, as well as those amino acids that are later modified, e.g., hydroxyproline, γ-carboxyglutamate, and O-phosphoserine. Amino acid analogs refers to compounds that have the same basic chemical structure as a naturally occurring amino acid, i.e., an a carbon that is bound to a hydrogen, a carboxyl group, an amino group, and an R group, e.g., homoserine, norleucine, methionine sulfoxide, methionine methyl sulfonium. Such analogs have modified R groups (e.g., norleucine) or modified peptide backbones, but retain the same basic chemical structure as a naturally occurring amino acid. "Amino acid mimetics" refers to chemical compounds having a structure that is different from the general chemical structure of an amino acid, but that functions in a manner similar to a naturally occurring amino acid.

There are various known methods in the art that permit the incorporation of an unnatural amino acid derivative or analog into a polypeptide chain in a site-specific manner, see, e.g., WO 02/086075.

Amino acids may be referred to herein by either the commonly known three letter symbols or by the one-letter symbols recommended by the IUPAC-IUB Biochemical Nomenclature Commission. Nucleotides, likewise, may be referred to by their commonly accepted single-letter codes.

"Polypeptide," "peptide," and "protein" are used interchangeably herein to refer to a polymer of amino acid residues. All three terms apply to amino acid polymers in which one or more amino acid residue is an artificial chemical mimetic of a corresponding naturally occurring amino acid, as well as to naturally occurring amino acid polymers and non-naturally occurring amino acid polymers. As used herein, the terms encompass amino acid chains of any length, including full-length proteins, wherein the amino acid residues are linked by covalent peptide bonds.

"Conservatively modified variants" applies to both amino acid and nucleic acid sequences. With respect to particular nucleic acid sequences, "conservatively modified variants" refers to those nucleic acids that encode identical or essentially identical amino acid sequences, or where the nucleic acid does not encode an amino acid sequence, to essentially identical sequences. Because of the degeneracy of the genetic code, a large number of functionally identical nucleic acids encode any given protein. For instance, the codons GCA, GCC, GCG and GCU all encode the amino acid alanine. Thus, at every position where an alanine is specified by a codon, the codon can be altered to any of the corresponding codons described without altering the encoded polypeptide. Such nucleic acid variations are "silent variations," which are one species of conservatively modified variations. Every nucleic acid sequence herein that encodes a polypeptide also describes every possible silent variation of the nucleic acid. One of skill will recognize that each codon in a nucleic acid (except AUG, which is ordinarily the only codon for methionine, and TGG, which is ordinarily the only codon for tryptophan) can be modified to yield a functionally identical molecule. Accordingly, each silent variation of a nucleic acid that encodes a polypeptide is implicit in each described sequence.

As to amino acid sequences, one of skill will recognize that individual substitutions, deletions or additions to a nucleic acid, peptide, polypeptide, or protein sequence which alters, adds or deletes a single amino acid or a small percentage of amino acids in the encoded sequence is a "conservatively modified variant" where the alteration results in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the invention. In some cases, conservatively modified variants of Cas9 or sgRNA can have an increased stability, assembly, or activity as described herein.

The following eight groups each contain amino acids that are conservative substitutions for one another:
1) Alanine (A), Glycine (G);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V);
6) Phenylalanine (F), Tyrosine (Y), Tryptophan (W);
7) Serine (S), Threonine (T); and
8) Cysteine (C), Methionine (M)
(see, e.g., Creighton, *Proteins*, W. H. Freeman and Co., N.Y. (1984)).

Amino acids may be referred to herein by either their commonly known three letter symbols or by the one-letter symbols recommended by the IUPAC-IUB Biochemical Nomenclature Commission. Nucleotides, likewise, may be referred to by their commonly accepted single-letter codes.

In the present application, amino acid residues are numbered according to their relative positions from the left most residue, which is numbered 1, in an unmodified wild-type polypeptide sequence.

As used in herein, the terms "identical" or percent "identity," in the context of describing two or more polynucleotide or amino acid sequences, refer to two or more sequences or subsequences that are the same or have a specified percentage of amino acid residues or nucleotides that are the same. For example, a core small guide RNA (sgRNA) sequence responsible for assembly and activity of a sgRNA:nuclease complex has at least 80% identity, preferably 85%, 90%, 91%, 92%, 93, 94%, 95%, 96%, 97%, 98%, 99%, or 100% identity, to a reference sequence, e.g., one of SEQ ID NOs:6-11), when compared and aligned for maximum correspondence over a comparison window, or designated region as measured using one of the following sequence comparison algorithms or by manual alignment and visual inspection. As another example, a Cas9 sequence responsible for assembly and activity of a sgRNA:nuclease complex has at least 80% identity, preferably 85%, 90%, 91%, 92%, 93, 94%, 95%, 96%, 97%, 98%, 99%, or 100% identity, to a reference sequence, e.g., one of SEQ ID NOs:1-4), when compared and aligned for maximum correspondence over a comparison window, or designated region as measured using one of the following sequence comparison algorithms or by manual alignment and visual inspection. Such sequences are then said to be "substantially identical." With regard to polynucleotide sequences, this definition also refers to the complement of a test sequence. With regard to amino acid sequences, preferably, the identity exists over a region that is at least about 50 amino acids or nucleotides in length, or more preferably over a region that is 75-100 amino acids or nucleotides in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. For sequence comparison of nucleic acids and proteins, the BLAST and BLAST 2.0 algorithms and the default parameters discussed below are used.

A "comparison window", as used herein, includes reference to a segment of any one of the number of contiguous positions selected from the group consisting of from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well-known in the art. Optimal alignment of sequences for comparison can be conducted, e.g., by the local homology algorithm of Smith & Waterman, *Adv. Appl. Math.* 2:482 (1981), by the homology alignment algorithm of Needleman & Wunsch, *J. Mol. Biol.* 48:443 (1970), by the search for similarity method of Pearson & Lipman, *Proc. Nat'l. Acad. Sci. USA* 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., *Current Protocols in Molecular Biology* (Ausubel et al., eds. 1995 supplement)).

Examples of algorithms that are suitable for determining percent sequence identity and sequence similarity are the BLAST and BLAST 2.0 algorithms, which are described in Altschul et al., (1990) J. Mol. Biol. 215: 403-410 and Altschul et al. (1977) Nucleic Acids Res. 25: 3389-3402, respectively. Software for performing BLAST analyses is publicly available at the National Center for Biotechnology Information website, ncbi.nlm.nih.gov. The algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits acts as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a word size (W) of 28, an expectation (E) of 10, M=1, N=−2, and a comparison of both strands. For amino acid sequences, the BLASTP program uses as defaults a word size (W) of 3, an expectation (E) of 10, and the BLOSUM62 scoring matrix (see Henikoff & Henikoff, Proc. Natl. Acad. Sci. USA 89:10915 (1989)).

The BLAST algorithm also performs a statistical analysis of the similarity between two sequences (see, e.g., Karlin & Altschul, *Proc. Nat'l. Acad. Sci. USA* 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

An indication that two nucleic acid sequences or polypeptides are substantially identical is that the polypeptide encoded by the first nucleic acid is immunologically cross reactive with the antibodies raised against the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules or their complements hybridize to each other under stringent conditions, as described below. Yet another indication that two nucleic acid sequences are substantially identical is that the same primers can be used to amplify the sequence. Yet another indication that two polypeptides are substantially identical is that the two polypeptides retain identical or substantially similar activity.

A "translocation sequence" or "transduction sequence" refers to a peptide or protein (or active fragment or domain thereof) sequence that directs the movement of a protein from one cellular compartment to another, or from the extracellular space through the cell or plasma membrane into the cell. Translocation sequences that direct the movement of a protein from the extracellular space through the cell or plasma membrane into the cell are "cell penetration peptides." Translocation sequences that localize to the nucleus of a cell are termed "nuclear localization" sequences, signals, domains, peptides, or the like. Examples of translocation sequences include, without limitation, the TAT transduction domain (see, e.g., S. Schwarze et al., Science 285 (Sep. 3, 1999); penetratins or penetratin peptides (D. Derossi et al., Trends in Cell Biol. 8, 84-87); Herpes simplex virus type 1 VP22 (A. Phelan et al., Nature Biotech. 16, 440-443 (1998), and polycationic (e.g., polyarginine) peptides (Cell Mol. Life Sci. 62 (2005) 1839-1849). Further translocation sequences are known in the art. Translocation peptides can be fused (e.g. at the amino or carboxy terminus), conjugated, or coupled to a compound of the present invention, to, among other things, produce a conjugate compound that may easily pass into target cells, or through the blood brain barrier and into target cells.

The "CRISPR/Cas" system refers to a widespread class of bacterial systems for defense against foreign nucleic acid. CRISPR/Cas systems are found in a wide range of eubacterial and archaeal organisms. CRISPR/Cas systems include type I, II, and III sub-types. Wild-type type II CRISPR/Cas systems utilize the RNA-mediated nuclease, Cas9 in complex with guide and activating RNA to recognize and cleave foreign nucleic acid. Methods and compositions for controlling inhibition and/or activation of transcription of target genes, populations of target genes (e.g., controlling a transcriptome or portion thereof) are described, e.g., in Cell. 2014 Oct. 23; 159(3):647-61, the contents of which are incorporated by reference in the entirety for all purposes.

Cas9 homologs are found in a wide variety of eubacteria, including, but not limited to bacteria of the following taxonomic groups: Actinobacteria, Aquificae, Bacteroidetes-Chlorobi, Chlamydiae-Verrucomicrobia, Chlroflexi, Cyanobacteria, Firmicutes, Proteobacteria, Spirochaetes, and Thermotogae. An exemplary Cas9 protein is the *Streptococcus pyogenes* Cas9 protein. Additional Cas9 proteins and homologs thereof are described in, e.g., Chylinksi, et al., RNA Biol. 2013 May 1; 10(5): 726-737; Nat. Rev. Microbiol. 2011 June; 9(6): 467-477; Hou, et al., Proc Natl Acad Sci USA. 2013 Sep. 24; 110(39):15644-9; Sampson et al., Nature. 2013 May 9; 497(7448):254-7; and Jinek, et al., Science. 2012 Aug. 17; 337(6096):816-21.

As used herein, "activity" in the context of CRISPR/Cas activity, Cas9 activity, sgRNA activity, sgRNA:nuclease activity and the like refers to the ability to bind to a target genetic element and/or modulate transcription at or near the target genetic element. Such activity can be measured in a variety of ways as known in the art. For example, expression, activity, or level of a reporter gene, or expression or activity of a gene encoded by the genetic element can be measured.

DETAILED DESCRIPTION OF THE INVENTION

I. Introduction

Described herein are methods and compositions for modulating the transcription of genomic regions at or near a target genetic element. The methods and compositions are based a CRISPR/Cas system that employs an optimized small guide RNA (sgRNA) and a nuclease deficient sgRNA-mediated nuclease (dCas9) and/or an sgRNA-mediated nuclease (Cas9). The sgRNA contains a binding region that provides highly specific binding to the target genetic element. Exemplary sgRNA binding region encoding sequences can include, but are not limited to, sequences that comprise or consist of the 19 nucleotides at the 3' end of any one of SEQ ID NOs:26-857,995. Exemplary sgRNA binding region encoding sequences can additionally or alternatively include, but are not limited to, sequences that comprise or consist of any one of SEQ ID NOs:26-857,995.

The sgRNA and the dCas9 can form a complex that specifically binds at or near the target genetic element. The dCas9 can be a fusion between the nuclease deficient dCas9 domain and a domain that provides a transcriptional modulation function. The methods and compositions can be used to target genetic elements as further described herein.

For example, the methods and compositions can be used to perform large (e.g., genome-wide) screens for genetic elements involved in the modulation of various phenotypes of interest. In some cases, previous screening techniques were impractical for performing large scale screens due to the size of the library required. For example, shRNA genome screens (e.g., Bassik et al., Cell. 2013 Feb. 14; 152(4):909-22) can require at least 25 shRNAs per targeted gene to ensure a high probability of transcriptionally repressing each gene. As described herein, the present inventors have discovered methods for designing sgRNAs and sgRNA libraries that target genetic elements with a high probability of altering the transcription of the targeted genetic element to a detectable degree. In some cases, the methods and compositions described herein can provide a library of sgRNAs of, of about, or of less than 25, 24, 23, 22, 21, 20, 15, 14, 13, 12, 11, 10, 9, 8, 7, 6, 5, 4, 3 or fewer sgRNAs per targeted gene. In some cases, the sgRNAs of the library are optimized to have a high probability of effectively modulating (e.g., activating or inhibiting transcription) target genes. Due to the high probability of effective target gene modulation, the library can target a large number of genes without requiring a large number of sgRNAs per target gene and therefore without becoming too large for facile construction and use. In some cases, the library targets a large plurality of genes (e.g., a library that targets at least 90%, 95%, 99%, substantially all, or all of the genes in a genome).

II. Compositions

Described herein are compositions useful as components of a CRISPR/Cas system for targeting genetic elements. The components can be used in a screen to identify genetic elements that modulate a phenotype, to identify genetic interactions, to develop or identify optimized sgRNAs, or for lead compound discovery or improvement. The components include sgRNAs, sgRNA libraries, and sgRNA scaffolds, and dCas9 transcriptional modulators.

A. sgRNAs

Described herein are sgRNAs, sgRNA scaffolds, and sgRNA libraries. The sgRNAs can contain from 5' to 3': a binding region, a 5' hairpin region, a 3' hairpin region, and a transcription termination sequence. The sgRNA can be configured to form a stable and active complex with a small guide RNA-mediated nuclease (e.g., Cas9 or dCas9). In some cases, the sgRNA is optimized to enhance expression of a polynucleotide encoding the sgRNA in a host cell.

The 5' hairpin region can be between about 15 and about 50 nucleotides in length (e.g., about 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or about 50 nucleotides in length). In some cases, the 5' hairpin region is between about 30-45 nucleotides in length (e.g., about 31, 32, 33, 34, 35, 36, 37, 38, 39, 40, 41, 42, 43, 44, or 45 nucleotides in length). In some cases, the 5' hairpin region is, or is at least about, 31 nucleotides in length (e.g., is at least about 31, 32, 33, 34, 35, 36, 37, 38, 39, 40, 41, 42, 43, 44, or 45 nucleotides in length). In some cases, the 5' hairpin region contains one or more loops or bulges, each loop or bulge of about 1, 2, 3, 4, 5, 6, 7, 8, 9, or 10 nucleotides. In some cases, the 5' hairpin region contains a stem of between about 10 and 30 complementary base pairs (e.g., 11, 12, 13, 14, 15, 16, 17, 18, 19, 20, 21, 22, 23, 24, 25, 26, 27, 28, 29, or 30 complementary base pairs).

In some embodiments, the 5' hairpin region can contain protein-binding, or small molecule-binding structures. In some cases, the 5' hairpin function (e.g., interacting or assembling with a sgRNA-mediated nuclease) can be conditionally activated by drugs, growth factors, small molecule ligands, or a protein that binds to the protein-binding structure of the 5' stem-loop. In some embodiments, the 5' hairpin region can contain non-natural nucleotides. For example, non-natural nucleotides can be incorporated to enhance protein-RNA interaction, or to increase the thermal stability or resistance to degradation of the sgRNA.

In some embodiments, the 5' hairpin region contains a unique endonuclease site. In some cases, the unique endonuclease site can introduce a bulge (e.g., a bulge of about 1, 2, 3, 4, 5, 6, 7, 8, 9, or 10 nucleotides). In an exemplary embodiment, the unique endonuclease site is a BlpI site. The unique endonuclease site can facilitate cloning of a binding region or a library of structurally distinct binding regions into an sgRNA scaffold as further described below.

The sgRNA can contain an intervening sequence between the 5' and 3' hairpin regions. The intervening sequence between the 5' and 3' hairpin regions can be between about 0 to about 50 nucleotides in length, preferably between about 10 and about 50 nucleotides in length (e.g., at a length of, or about a length of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides). In some cases, the intervening sequence is designed to be linear, unstructured, substantially linear, or substantially unstructured. In some embodiments, the intervening sequence can contain non-natural nucleotides. For example, non-natural nucleotides can be incorporated to enhance protein-RNA interaction or to increase the activity of the sgRNA:nuclease complex. As another example, natural nucleotides can be incorporated to enhance the thermal stability or resistance to degradation of the sgRNA.

The 3' hairpin region can contain an about 3, 4, 5, 6, 7, or 8 nucleotide loop and an about 4, 5, 6, 7, 8, 9, 10, 11, 12, 13, 14, 15, 16, 17, 18, 19, 20, 21, 22, 23, 24, or 25 nucleotide or longer stem. In some cases, the 3' hairpin region can contain a protein-binding, small molecule-binding, hormone-binding, or metabolite-binding structure that can conditionally stabilize the secondary and/or tertiary structure of the sgRNA. In some embodiments, the 3' hairpin region can contain non-natural nucleotides. For example, non-natural nucleotides can be incorporated to enhance protein-RNA interaction or to increase the activity of the sgRNA:nuclease complex. As another example, natural nucleotides can be incorporated to enhance the thermal stability or resistance to degradation of the sgRNA.

In some embodiments, the sgRNA includes a termination structure at its 3' end. In some cases, the sgRNA includes an additional 3' hairpin region, e.g., before the termination and after a first 3' hairpin region, that can interact with proteins, small-molecules, hormones, etc., for stabilization or additional functionality, such as conditional stabilization or conditional regulation of sgRNA:nuclease assembly or activity.

In some embodiments, the sgRNA forms an sgRNA:Cas9 or dCas9 complex that has increased stability and/or activity as compared to previously known sgRNAs or an sgRNA substantially identical to a previously known sgRNA. In some cases, the sgRNA forms an sgRNA:Cas9 or dCas9 complex that has increased stability and/or activity as compared to as an sgRNA encoded by:
SEQ ID NO:6 [N]$_{5-100}$GUUUUAGAGCUA-GAAAUAGCAAGUUAAAAUAAGGCUAGUCC GUUAUCAACUUGAAAAAGUGGCACCGAGUCG-GUGCUUUUUUU, where [N] represents a target specific binding region of between about 5-100 nucleotides (e.g., about 5, 10, 15, 20, 15, 30, 35, 40, 45, 50, 55, 60, 70, 80, or 90 nucleotides) that is complementary or substantially complementary to the target genetic element. In some embodiments, the binding region of the sgRNA is, or is about, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 or 40 or more nucleotides in length. In some cases, the binding region of the sgRNA is between about 19 and about 21 nucleotides in length.

Generally, the binding region is designed to complement (e.g., perfectly complement) or substantially complement the target genetic element or elements. In some cases, the binding region can incorporate wobble or degenerate bases to bind multiple genetic elements. In some cases, the 19 nucleotides at the 3' or 5' end of the binding region are perfectly complementary the target genetic element or elements. In some cases, the binding region can be altered to increase stability. For example, non-natural nucleotides, can be incorporated to increase RNA resistance to degradation. In some cases, the binding region can be altered or designed to avoid or reduce secondary structure formation in the binding region. In some cases, the binding region can be designed to optimize G-C content. In some cases, G-C content is preferably between about 40% and about 60% (e.g., 40%, 45%, 50%, 55%, 60%). In some cases, the binding region, can be selected to begin with a sequence that facilitates efficient transcription of the sgRNA. For example, the binding region can begin at the 5' end with a G nucleotide. In some cases, the binding region can contain modified nucleotides such as, without limitation, methylated or phosphorylated nucleotides.

In some cases, the sgRNAs described herein form an sgRNA:nuclease complex with enhanced stability or activity as compared to SEQ ID NO:6, or an sgRNA 90, 95, 96, 97, 98, or 99% or more identical to SEQ ID NO:6. In some cases, the optimized sgRNAs described herein form an sgRNA:nuclease complex with enhanced stability or activity as compared to SEQ ID NO:6, or an sgRNA with fewer than 5, 4, 3, 2 or 1 nucleotide substitutions, additions, or deletions of SEQ ID NO:6.

As used herein, identity of an sgRNA to another sgRNA, such as an sgRNA to SEQ ID NO:6 is determined with reference to the identity to the nucleotide sequences outside of the binding region. For example, two sgRNAs with 0% identity inside the binding region and 100% identity outside the binding region are 100% identical to each other. Similarly, as used herein, the number of substitutions, additions, or deletions of an sgRNA as compared to another, such as an sgRNA compared to SEQ ID NO:6 is determined with reference to the nucleotide sequences outside of the binding region. For example, two sgRNAs with multiple additions, substitutions, and/or deletions inside the binding region and 100% identity outside the binding region are considered to contain 0 nucleotide substitutions, additions, or deletions.

As used herein, the structural distinctiveness of an sgRNA to another sgRNA is determined with reference to the binding region. Thus, for example, an sgRNA that is structurally distinct as compared to another sgRNA has a different binding region sequence. The sequence can be different by way of any one or more substitutions, additions, or deletions within the binding region.

In some embodiments, the sgRNA can be optimized for expression by substituting, deleting, or adding one or more nucleotides. In some cases, a nucleotide sequence that provides inefficient transcription from an encoding template nucleic acid can be deleted or substituted. For example, in some cases, the sgRNA is transcribed from a nucleic acid operably linked to an RNA polymerase III promoter. In such cases, sgRNA sequences that result in inefficient transcription by RNA polymerase III, such as those described in Nielsen et al., Science. 2013 Jun. 28; 340(6140):1577-80, can be deleted or substituted. For example, one or more consecutive uracils can be deleted or substituted from the sgRNA sequence. In some cases, the consecutive uracils are present in the stem portion of a stem-loop structure. In such cases, one or more of the consecutive uracils can be substituted by exchanging the uracil and its complementary base. For example, if the uracil is hydrogen bonded to a corresponding adenine, the sgRNA sequence can be altered to exchange the adenine and uracil. This "A-U flip" can retain the overall structure and function of the sgRNA molecule while improving expression by reducing the number of consecutive uracil nucleotides. In some cases, the sgRNA containing an A-U flip is encoded by:

SEQ ID NO:7 $[N]_{5-100}$GUUU$\underline{A}$AGAGCUAGAAAUAGCAAGUU$\underline{U}$AAAUAAGGCUAGUCC GUUAUCAAC-UUGAAAAAGUGGCACCGAGUCGGUGCUUUUUUU, where the A-U flipped nucleotides are underlined. In some cases, the optimized sgRNA is at least 90, 91, 92, 93, 94, 95, 96, 97, 98, or 99% identical or more to SEQ ID NO:7, or contains fewer than 10, 9, 8, 7, 6, 5, 4, 3, or 2 nucleotide additions, deletions, or substitutions compared to SEQ ID NO:7. Alternatively, the A-U pair can be replaced by a G-C, C-G, A-C, G-U pair. In some cases, the sgRNA is designed so that, with the exclusion of the transcription terminator sequence, it does not contain any run of four or more of A, U, G, or C.

In some embodiments, the sgRNA can be optimized for stability. Stability can be enhanced by optimizing the stability of the sgRNA:nuclease interaction, optimizing assembly of the sgRNA:nuclease complex, removing or altering RNA destabilizing sequence elements, or adding RNA stabilizing sequence elements. In some embodiments, the sgRNA contains a 5' stem-loop structure proximal to, or adjacent to, the binding region that interacts with the sgRNA-mediated nuclease. Optimization of the 5' stem-loop structure can provide enhanced stability or assembly of the sgRNA:nuclease complex. In some cases, the 5' stem-loop structure is optimized by increasing the length of the stem portion of the stem-loop structure. An exemplary sgRNA containing an optimized 5' stem-loop structure is encoded by:

SEQ ID NO:8 $[N]_{5-100}$GUUUUAGAGCUA$\underline{UGCUGG}$AAA$\underline{CAGCA}$UAGCAAG$\underline{UUAAAAU}$AAGGCUAGUCCGUUAUCAAC-UUGAAAAAGUGGCACCGAGUCGGUGCUUUUUU U, where the nucleotides contributing to the elongated stem portion of the 5' stem-loop structure are underlined. In some cases, the optimized sgRNA is at least 90, 91, 92, 93, 94, 95, 96, 97, 98, or 99% identical or more to SEQ ID NO:8, or contains fewer than 10, 9, 8, 7, 6, 5, 4, 3, or 2 nucleotide additions, deletions, or substitutions compared to SEQ ID NO:8.

In some embodiments, the 5' stem-loop optimization is combined with mutations for increased transcription to provide an optimized sgRNA. For example, an A-U flip and an elongated stem loop can be combined to provide an optimized sgRNA. An exemplary sgRNA containing an A-U flip and an elongated 5' stem-loop is encoded by:

SEQ ID NO: 9 $[N]_{5-100}$GUUU$\underline{A}$AGAGCUA$\underline{UGCUGG}$AAA$\underline{CAGCA}$UAGCAAGUU$\underline{U}$AAAU AAGGCUAGUCCGUUAUCAAC-UUGAAAAAGUGGCACCGAGUCGGUGCUUUUUU U, where the A-U flipped nucleotides and the nucleotides contributing to the elongated stem portion of the 5' stem-loop structure are underlined. In some cases, the optimized sgRNA is at least 90, 91, 92, 93, 94, 95, 96, 97, 98, or 99% identical or more to SEQ ID NO:9, or contains fewer than 10, 9, 8, 7, 6, 5, 4, 3, or 2 nucleotide additions, deletions, or substitutions compared to SEQ ID NO:9.

In some embodiments, a small guide RNA can include a unique endonuclease site to enable construction of large libraries with high fidelity. In some embodiments, the unique endonuclease site introduces a 1 bp bulge in the 5' hairpin region. An exemplary sgRNA containing a unique endonuclease site and 1 bp bulge in the 5' hairpin region is encoded by:

SEQ ID NO: 10 [N]$_{5-100}$GUUU<u>A</u>AGAGCUA AGCUGGAAA<u>CAGCA</u>UAGCAAGUUU<u>U</u>AAAU AAGGCUAGUCCGUUAUCAAC- UUGAAAAAGUGGCACCGAGUCGGUGCUUUUUU U, where the A-U flipped nucleotides, the 1 bp bulge, and the nucleotides contributing to the elongated stem portion of the 5' stem-loop structure are underlined. In some cases, the optimized sgRNA is at least 90, 91, 92, 93, 94, 95, 96, 97, 98, or 99% identical or more to SEQ ID NO:10, or contains fewer than 10, 9, 8, 7, 6, 5, 4, 3, or 2 nucleotide additions, deletions, or substitutions compared to SEQ ID NO:10.

In some embodiments, the small guide RNA is encoded by a polynucleotide that comprises or consists of:
SEQ ID NO:11 [N]$_{19-21}$GUUU<u>A</u>AGAGCUA AGCUGGAAA<u>CAGCA</u>UAGCAAGUUU<u>U</u>AAAU AAGGCUAGUCCGUUAUCAAC- UUGAAAAAGUGGCACCGAGUCGGUGCUUUUUU U, where the A-U flipped nucleotides, the 1 bp bulge, and the nucleotides contributing to the elongated stem portion of the 5' stem-loop structure are underlined. In some cases, the optimized sgRNA is at least 90, 91, 92, 93, 94, 95, 96, 97, 98, or 99% identical or more to SEQ ID NO:11, or contains fewer than 10, 9, 8, 7, 6, 5, 4, 3, or 2 nucleotide additions, deletions, or substitutions compared to SEQ ID NO:11.

sgRNAs can be modified by methods known in the art. In some cases, the modifications can include, but are not limited to, the addition of one or more of the following sequence elements: a 5' cap (e.g., a 7-methylguanylate cap); a 3' polyadenylated tail; a riboswitch sequence; a stability control sequence; a hairpin; a subcellular localization sequence; a detection sequence or label; or a binding site for one or more proteins. Modifications can also include the introduction of non-natural nucleotides including, but not limited to, one or more of the following: fluorescent nucleotides and methylated nucleotides.

In some embodiments, the sgRNAs are selected so as not to have significant off-target effects. In some cases, the similarity of an sgRNA binding region for off-target genetic element sequences can be determined. sgRNAs having a high similarity exceeding a pre-designated threshold can be filtered out. In some cases, candidate binding regions, including the protospacer adjacent motif (PAM) sequences can be scored using a scoring metric in a manual or automated fashion. sgRNA binding regions having an acceptable number of off-target mismatches can then be selected for synthesis.

An exemplary scoring metric is provided as follows: G1 of the PAM (e.g., NGG for *Streptococcus pyogenes* Cas9) is given a score of 40 if present and a score of 0 if absent. G2 of the PAM is given a score of 19 if present and a score of 0 if absent. N of the PAM is given a score of 0, whether present or absent. Region I, corresponding to the first 7 nucleotides of the binding region starting from the 5' end is given a score of 28 for every mismatch present. Region II, corresponding to the first 5 nucleotides of the binding region starting after the 3' end of Region I is given a score of 19 for every mismatch present. Region III, corresponding to the remaining nucleotides between Region II and the PAM is given a score of 10 for every mismatch present. Off-target binding at any given site can be estimated as 1−([Σ/ (mismatches*mismatch_score)]/40). In some cases, sgRNAs are selected that have a score according to the foregoing metric of less than or equal to 0. Thus, according to the foregoing exemplary scoring metric, an sgRNA having one mismatch in PAM G1 and no other mismatches would be selected. However, an sgRNA having one mismatch in PAM G1 and any other mismatch would not be selected for synthesis.

In some embodiments, the sgRNAs are targeted to specific regions at or near a gene. For example, an sgRNA can be targeted to a region at or near the 0-750 bp region 5' (upstream) of the transcription start site of a gene. In some cases, the 0-750 bp targeting of the region can provide, or provide increased, transcriptional activation by an sgRNA: dCas9 complex. For instance, a cell can be contacted with a dCas9 fused to a transcriptional activator or epitope fusion domain and an sgRNA, or library of sgRNAs, targeted to the 0-750 bp region 5' of the transcription start site of one or more genes.

As another example, an sgRNA can be targeted to a region at or near the 0-1000 bp region 3' (downstream) of the transcription start site of a gene. In some cases, the 0-1000 bp targeting of the region can provide, or provide increased, transcriptional repression by an sgRNA:dCas9 complex. For instance, a cell can be contacted with a dCas9 fused to a transcriptional repressor or epitope fusion domain and an sgRNA, or library of sgRNAs, targeted to the 0-1000 bp region 3' of the transcription start site of one or more genes.

In some embodiments, the sgRNAs are targeted to a region at or near the transcription start site (TSS) based on an automated or manually annotated database. For example, transcripts annotated by Ensembl/GENCODE or the APPRIS pipeline (Rodriguez et al., Nucleic Acids Res. 2013 January; 41(Database issue):D110-7 can be used to identify the TSS and target genetic elements 0-750 bp upstream (e.g., for targeting one or more transcriptional activator domains) or 0-1000 bp downstream (e.g., for targeting one or more transcriptional repressor domains) of the TSS.

In some embodiments, the sgRNAs are targeted to a genomic region that is predicted to be relatively free of nucleosomes. The locations and occupancies of nucleosomes can be assayed through use of enzymatic digestion with micrococcal nuclease (MNase). MNase is an endo-exo nuclease that preferentially digests naked DNA and the DNA in linkers between nucleosomes, thus enriching for nucleosome-associated DNA. To determine nucleosome organization genome-wide, DNA remaining from MNase digestion is sequenced using high-throughput sequencing technologies (MNase-seq). Thus, regions having a high MNase-seq signal are predicted to be relatively occupied by nucleosomes and regions having a low MNase-seq signal are predicted to be relatively unoccupied by nucleosomes. Thus, in some embodiments, the sgRNAs are targeted to a genomic region that has a low MNase-Seq signal.

In some cases, the sgRNAs are targeted to a region predicted to be highly transcriptionally active. For example, the sgRNAs can be targeted to a region predicted to have a relatively high occupancy for RNA polymerase II (PolII). Such regions can be identified by PolII chromatin immunoprecipitation sequencing (ChIP-seq), which includes affinity purifying regions of DNA bound to PolII using an anti-PolII antibody and identifying the purified regions by sequencing. Therefore, regions having a high PolII Chip-seq signal are predicted to be highly transcriptionally active. Thus, in some cases, sgRNAs are targeted to regions having a high PolII ChIP-seq signal as disclosed in the ENCODE-published PolII ChIP-seq database (Landt, et al., Genome Research, 2012 September; 22(9):1813-31).

As another example, the sgRNAs can be targeted to a region predicted to be highly transcriptionally active as identified by run-on sequencing or global run-on sequencing (GRO-seq). GRO-seq involves incubating cells or nuclei with a labeled nucleotide and an agent that inhibits binding of new RNA polymerase to transcription start sites (e.g., sarkosyl). Thus, only genes with an engaged RNA polymerase produce labeled transcripts. After a sufficient period of time to allow global transcription to proceed, labeled RNA is extracted and corresponding transcribed genes are identified by sequencing. Therefore, regions having a high GRO-seq signal are predicted to be highly transcriptionally active. Thus, in some cases, sgRNAs are targeted to regions having a high GRO-seq signal as disclosed in a published GRO-seq data (e.g., Core et al., Science. 2008 Dec. 19; 322(5909):1845-8; and Hah et al., Genome Res. 2013 August; 23(8):1210-23).

Also described herein are expression cassettes and vectors for producing sgRNAs in a host cell. The expression cassettes can contain a promoter (e.g., a heterologous promoter) operably linked to a polynucleotide encoding an sgRNA. The promoter can be inducible or constitutive. The promoter can be tissue specific. In some cases, the promoter is a U6, H1, or spleen focus-forming virus (SFFV) long terminal repeat promoter. In some cases, the promoter is a weak mammalian promoter as compared to the human elongation factor 1 promoter (EF1A). In some cases, the weak mammalian promoter is a ubiquitin C promoter or a phosphoglycerate kinase 1 promoter (PGK). In some cases, the weak mammalian promoter is a TetOn promoter in the absence of an inducer. In some cases, when a TetOn promoter is utilized, the host cell is also contacted with a tetracycline transactivator. In some embodiments, the strength of the selected sgRNA promoter is selected to express an amount of sgRNA that is proportional to the amount of Cas9 or dCas9. The expression cassette can be in a vector, such as a plasmid, a viral vector, a lentiviral vector, etc. In some cases, the expression cassette is in a host cell. The sgRNA expression cassette can be episomal or integrated in the host cell.

Also described herein are sgRNA scaffolds. sgRNA scaffolds are portions of an sgRNA that can serve as a recipient of a binding region, or portion thereof, for ease of cloning or other manipulation. In some embodiments, the sgRNA scaffold comprises all the regions of the sgRNA (e.g., 5' hairpin region, intervening region, 3' hairpin, and termination sequence) except for the binding region. Thus, the sgRNA scaffold comprises all the constant regions of the sgRNA. In some cases, the scaffold contains a unique endonuclease site at or near the 5' end of the 5' hairpin region. An exemplary unique endonuclease site is a BlpI site, as shown for example in SEQ ID NO:11. In some cases, the scaffold is present in a vector or expression cassette. For example, the scaffold can be configured to be operably linked to a promoter (e.g., a heterologous promoter) after ligation of a binding region. In some cases, the scaffold can be present in a shuttle or intermediate cloning vector. For example, the scaffold can be present in an *E. coli* cloning vector, and configured to accept ligation of a binding region, thereby providing an sgRNA that can be excised from the *E. coli* vector and ligated into a suitable host cell expression vector.
I In some embodiments, portions of the sgRNA scaffold are encoded in different expression cassettes, different vectors, or different intermediate cloning polynucleotides. For example, a portion of the sgRNA scaffold containing the 5' hairpin region and a unique restriction site may reside on an *E. coli* cloning vector. A binding region, or library of binding regions, can be cloned into the sgRNA scaffold portion. The binding region and 5' hairpin region can then be digested and ligated into a destination vector (e.g., a host cell expression vector) that provides one or more of an intervening region, a 3' hairpin region, and/or a 3' termination sequence.

The sgRNA scaffold can be used to generate libraries of structurally distinct sgRNAs. For example, a library of polynucleotides encoding structurally distinct binding regions can be synthesized or generated using methods known in the art including but not limited to solid phase DNA synthesis. In some cases, the solid phase synthesis is performed on a microarray slide or chip. The library of polynucleotides encoding the binding regions can be recovered, optionally purified (e.g., HPLC or PAGE), and cloned into an sgRNA scaffold to generate polynucleotides encoding a library of structurally distinct sgRNAs. Thus, the solid phase synthesis can be performed to generate the short (e.g., 19-21 nucleotide) binding region, while the constant regions are provided by the scaffold. In some embodiments, this combination of solid phase synthesis of the binding region and cloning into a scaffold can greatly increase the quality of the library as compared to synthesizing a larger portion of the sgRNA. For example, the synthesized region can contain fewer misincorporation errors (e.g., synthesized oligonucleotides of length N−1) that arise during synthesis of long polynucleotides.

Consequently, also described herein are libraries of sgRNAs, wherein the library contains a large number of sgRNAs having structurally distinct binding regions. The library can contain at least 10, 100; 1,000; 10,000; 50,000; or more structurally distinct sgRNAs. In some embodiments, the library contains less than about 50%, 25%, 15%, 10%, 1%, or fewer misincorporation (e.g., synthesized oligonucleotides of length N−1) errors.

In some embodiments, the library contains sgRNAs that target genetic elements that are at least about 5 bp apart in the genome of an organism. In some cases, completely or nearly overlapping sgRNAs can be enriched for the same or similar phenotype. Therefore enforcing a distance between targeted genetic elements of the sgRNAs can provide an sgRNA library with a larger variety of possible phenotypes as compared to a library of the same size having overlapping sgRNAs. In some cases, a majority, substantial majority, or at least 90% (e.g., at least 90, 95, or 99%) of the sgRNAs of an sgRNA library are targeted to non-overlapping genetic elements (e.g., genetic elements that are at least 1, 2, 3, 4, 5, 6, 7, 8, 9, 10, 11, 12, 13, 14, 15, 16, 17, 18, 19, or 20 bp apart).

In some embodiments, the library contains a plurality of sgRNAs, wherein the plurality of sgRNAs comprise binding regions that are designed according to one or more of the following criteria: designed to target a genetic element that is at least 5 bp apart from a genetic element targeted by another sgRNA of the library; designed to begin with a "G" nucleotide; designed to have a mismatch scoring metric for off-target genetic elements of below a pre-designated threshold (e.g., designed to have a mismatch scoring metric of less than or equal to 0); designed to target a region between, or between about, 0 and about 750 bp upstream of the transcription start site (TSS), or wherein a majority, substantial majority, or at least 90% (e.g., at least 90, 95, or 99%) of the sgRNAs are targeted to a region between, or between about, 0 and about 1000 bp downstream of the TSS of a gene; designed to target a region between, or between about, 0 and about 1000 bp downstream of the transcription start site (TSS), or wherein a majority, substantial majority, or at least 90% (e.g., at least 90, 95, or 99%) of the sgRNAs are targeted to a region between, or between about, 0 and about 100 bp downstream of the TSS of a gene; designed to target regions upstream or downstream of the TSS as annotated by Ensemble/ENCODE or the APPRIS pipeline; designed to lack any region containing four or more consecutive U, A, G, and/or C nucleotides; designed to have a GC percentage of between about 25% and 100%, or between about 30% and 95%; designed to target genetic elements having a low MNase-seq signal; designed to target genetic elements having a high PolII ChIP-seq signal; or designed to target genetic elements having a high GRO-seq signal.

In some embodiments, the sgRNA libraries can target a plurality of genetic elements with a high probability of substantially modulating the expression level of one or more genes, or portions thereof, at or near the targeted genetic element or modulating the expression level of the genetic element. In some embodiments, the sgRNA libraries can provide a high probability of substantial transcriptional modulation despite having a relatively low number of sgRNAs targeted to a gene or genetic element. For example, the sgRNA library can have less than, or less than about, 20, 19, 18, 17, 16, 15, 14, 13, 12, 11, 10, 9, 8, 7, 6, 5, 4, 3, or 2 sgRNAs targeted to each gene, genomic region, or genetic element. In comparison, other pooled techniques for large scale transcriptional modulation, such as methods utilizing shRNA libraries can require a higher level of redundancy to ensure a high probability of transcriptional modulation of targeted genes or genetic elements. In some embodiments, the sgRNA library has a median predicted probability of providing a detectable phenotype, as measured using a signed Z-score of at least, or at least about, 0.1, 0.2, 0.3, 0.4, 0.5, 0.6, 0.7, 0.8, 0.9, or higher. In some cases, the Z-score is between, or between about 0.1 and 2, 0.1 and 1, 0.1 and 0.9 or 1, 0.2 and 0.9 or 1, 0.3 and 0.9 or 1, 0.4 and 0.9 or 1, or 0.5 and 0.9 or 1.

In some embodiments, the Z-score is calculated using a method described in Kampmann et al., Proc Natl Acad Sci USA. 2013 Jun. 18; 110(25):E2317-26, or Bassik et al., Cell. 2013 Feb. 14; 152(4):909-22. For example, the phenotype of each sgRNA can be quantified, for growth ("gamma") or resistance to treatment ("rho"). To normalize these phenotypes, the quantified value for gamma or rho is divided by the standard deviation of negative-control sgRNA phenotypes. These standardized phenotypes represent the "z scores".

In some embodiments, sgRNA libraries can be double-sgRNA libraries. For example, the library can be a plurality of polynucleotides that each encode two sgRNAs. The sgRNAs can be pairwise combinations of sgRNAs that have already been identified as modulating a phenotype. Such libraries can be useful for identifying genetic interactions between the genetic elements targeted by each sgRNA of the pair.

B. Cas9

Described herein are guide RNA dependent nucleases and derivatives thereof. In some cases, the sgRNA-mediated nuclease is a Cas9 protein. For example, the sgRNA-mediated nuclease can be a type I, II, or III Cas9 protein. In some cases, the sgRNA-mediated nuclease can be a modified Cas9 protein. Cas9 proteins can be modified by any method known in the art. For example, the Cas9 protein can be codon optimized for expression in host cell or an in vitro expression system. Additionally, or alternatively, the Cas9 protein can be engineered for stability, enhanced target binding, or reduced aggregation.

The Cas9 can be a nuclease defective Cas9 (i.e., dCas9). For example, certain Cas9 mutations can provide a nuclease that does not cleave or nick, or does not substantially cleave or nick the target sequence. Exemplary mutations that reduce or eliminate nuclease activity include one or more mutations in the following locations: D10, G12, G17, E762, H840, N854, N863, H982, H983, A984, D986, or A987, or a mutation in a corresponding location in a Cas9 homologue or ortholog. The mutation(s) can include substitution with any natural (e.g., alanine) or non-natural amino acid, or deletion. An exemplary nuclease defective dCas9 protein is Cas9D10A&H840A (Jinek, et al., Science. 2012 Aug. 17; 337(6096):816-21; Qi, et al., Cell. 2013 Feb. 28; 152(5): 1173-83).

dCas9 proteins that do not cleave or nick the target sequence can be utilized in combination with an sgRNA, such as one or more of the sgRNAs described herein, to form a complex that is useful for transcriptional modulation of target nucleic acids as further explained below. The dCas9 can be targeted to one or more genetic elements by virtue of the binding regions encoded on one or more sgRNAs. Recruitment of dCas9 can therefore provide recruitment of additional effector functions as provided by polypeptides fused to the dCas9 domain. For example, a polypeptide comprising an effector function can be fused to the N and/or C-terminus of a dCas9 domain. In some cases, the polypeptide encodes a transcriptional activator or repressor. In other cases, the polypeptide encodes an epitope fusion that can be used to recruit one or more copies of an affinity agent. In some cases, the affinity agent is fused to a transcriptional activator or repressor.

In one embodiment, the dCas9 is a transcriptional activator and comprises a dCas9 domain and a transcriptional activator domain. In some cases, the dCas9 domain is fused to a p65 activation domain (p65AD). SEQ ID NO:1 is an exemplary dCas9 domain fused to p65AD. In some cases, the dCas9 fused to p65AD is at least about 90%, 95%, or 99% identical, or identical, to SEQ ID NO:1.

In some cases, the dCas9 domain transcriptional activator comprises a dCas9 domain fused to one or more copies of a VP8 activation domain (e.g., fused to a VP8, VP16, or VP64 domain). SEQ ID NO:2 is an exemplary dCas9 domain fused to VP16 or VP64. In some cases, the dCas9 fused to a VP16 domain is at least about 90%, 95%, or 99% identical, or identical, to SEQ ID NO:2.

In some embodiments, the dCas9 is a transcriptional repressor and comprises a dCas9 domain and a transcriptional repressor domain. In some cases, the dCas9 domain is fused to a Krüppel associated box (KRAB) repressor domain. SEQ ID NO:3 is an exemplary dCas9 domain fused to a KRAB domain. In some cases, the dCas9 fused to a KRAB domain is at least about 90%, 95%, or 99% identical, or identical, to SEQ ID NO:3.

In some embodiments, the dCas9 is a transcriptional repressor and comprises a dCas9 domain and a transcriptional repressor domain. In some cases, the dCas9 domain is fused to a chromoshadow repressor domain. SEQ ID NO:12 is an exemplary dCas9 domain fused to a chromoshadow domain. In some cases, the dCas9 fused to a chromoshadow domain is at least about 90%, 95%, or 99% identical, or identical, to SEQ ID NO:12.

In some embodiments, the dCas9 transcriptional modulator is a dCas9 domain fused to an epitope fusion polypeptide. The epitope fusion polypeptide can contain one or more copies (e.g., 2, 3, 4, 5, 6, 7, 8, 9, 10, 11, 12, 13, 14, 15, 16, 17, 18, 19, 20 or more copies) of an epitope. In some cases, the epitope fusion polypeptide contains multiple copies of an epitope separated by one or more linker sequences. In some cases, the linker is configured to allow the binding of affinity agents to adjacent epitopes without, or without substantial, steric hindrance. In some cases, the linker sequences are configured to provide an unstructured or linear region of the polypeptide. For example, the linker sequence can comprise one or more glycines and/or serines. The linker sequences can be at least about 2, 3, 4, 5, 6, 7, 8, 9, 10 or more amino acids in length. In some cases, the linker sequences are, or comprise, one or more of the linkers disclosed on the world wide web at parts.igem.org/Protein_domains/Linker.

The amino acid sequence of the epitope can be any sequence that is specifically recognized by a corresponding affinity agent. Thus, the dCas9 domain fused to the epitope fusion polypeptide will recruit one or more copies of the corresponding fusion agent. This can result in an amplification of any signal or effector function provided by the affinity agent. For example, the affinity agent can be a fusion protein comprising an affinity domain and a transcriptional modulation domain. The dCas9 epitope fusion can form a complex with an sgRNA specific for a target genetic element and recruit multiple copies of the transcriptional modulation domain via the affinity domain to the targeted genetic element.

In some cases, the dCas9 domain fused to an epitope fusion polypeptide contains one or more copies of a GCN4 epitope. In some cases, the epitope fusion polypeptide contains multiple copies of a GCN4 epitope separated by one or more copies of one or more linker sequences. In some cases, the linker is configured to allow the binding of affinity agents to adjacent GCN4 epitopes without, or without substantial, steric hindrance. An exemplary dCas9 fused to a GCN4 epitope fusion domain is or comprises SEQ ID NO:4. In some cases, the dCas9 fused to a GCN4 epitope fusion domain is at least about 90%, 95%, or 99% identical, or identical, to SEQ ID NO:4.

In some embodiments, the epitope fusion polypeptide contains one or more copies of two or more different epitopes. In such cases, the dCas9 can recruit multiple different effector functions. For example, the epitope fusion polypeptide can contain a first epitope that recruits an affinity agent fused to a transcriptional activator. The epitope fusion polypeptide can further contain a second epitope that recruits an affinity agent fused to different effector function. In some cases, the epitope fusion polypeptide containing one or more copies of two or more different epitopes can be used to enhance the specificity of a CRISPR/Cas interaction. For example, one epitope can recruit an affinity agent fused to one half of an obligate dimer effector domain, while the other epitope recruits an affinity agent fused to the other half of the obligate dimer effector domain.

In some cases, the epitope fusion polypeptide recruits one or more copies of an obligate dimer fluorescent protein (e.g., GFP), an obligate dimer recombinase (e.g., CRE recombinase), an obligate dimer luciferase, an obligate dimer thymidine kinase, an obligate dimer TEV protease, or an obligate dimer dihydrofolate reductase (DHFR). In some cases, the epitope fusion polypeptide recruits one or more copies of a combination of effector domains or enzymes which promote or affect transcription. For example, the epitope fusion polypeptide can recruit one or more copies of enzymes or other effector domains that regulate DNA methylation, histone methylation or demethylation, histone deacetylation, RNA polII de-phosphorylation, or promote an increase in nucleosome compaction as measured by reduced DNAse1 hypersensitivity or decreased Micrococcal nuclease accessibility. A combination of activation effector domains or enzymes which could promote transcription could include DNA demethylases, histone demethylases or methylases, histone acetylases, RNA polII phosphorylases, or enzymes or effector domains that reduce nucleosome compaction as measured by increased DNAse1 hypersensitivity or increase micrococcal nuclease accessibility, or promote natural or un-natural chromosomal looping between distal enhancer elements and proximal promoter elements.

Also described herein are expression cassettes and vectors for producing Cas9 or dCas9, including Cas9 or dCas9 fusion proteins, in a host cell. The expression cassettes can contain a promoter (e.g., a heterologous promoter) operably linked to a polynucleotide encoding Cas9 or dCas9. The promoter can be inducible or constitutive. The promoter can be tissue specific. In some cases, the promoter is a weak mammalian promoter as compared to the human elongation factor 1 promoter (EF1A). In some cases, the weak mammalian promoter is a ubiquitin C promoter, a vav promoter, or a phosphoglycerate kinase 1 promoter (PGK). In some cases, the weak mammalian promoter is a TetOn promoter in the absence of an inducer. In some cases, when a TetOn promoter is utilized, the host cell is also contacted with a tetracycline transactivator.

In some embodiments, the strength of the dCas9 or Cas9 promoter is selected to express an amount of Cas9 or dCas9 (e.g., Cas9 or dCas9 epitope fusion protein) that is proportional to the amount of sgRNA or amount of sgRNA expression. In some embodiments, the strength of the selected sgRNA promoter is selected to express an amount of small guide RNA that is proportional to the amount of corresponding affinity agent or the amount of Cas9 or dCas9 (e.g., Cas9 or dCas9 epitope fusion protein). For example, if a dCas9 epitope fusion protein contains ten copies of an epitope, then the dCas9 promoter can be selected to express $1/10^{th}$ the amount of dCas9 as compared to corresponding affinity agent (or less). In some cases, a weak promoter can be selected to reduce cytotoxicity induced by expression of the Cas9 or dCas9 gene.

In some cases, the polynucleotide encoding a small guide RNA-mediated nuclease of the expression cassette further encodes one or two localization sequences (e.g., nuclear localization sequences). For example, the polynucleotide can encode a Cas9 or dCas9 protein having a nuclear localization sequence at the N- and/or C-terminus. The expression cassette can be in a vector, such as a plasmid, a viral vector, a lentiviral vector, etc. In some cases, the expression cassette is in a host cell. The expression cassette can be episomal or integrated in the host cell.

C. Affinity Agents

Described herein are affinity agents for recruiting effector functions to dCas9 epitope fusion proteins. A wide variety of affinity agents can be utilized. Generally, the affinity agent is stable under the reducing conditions present in the intracellular environment of the cell. Additionally, the affinity agent should specifically bind to its corresponding epitope with minimal cross-reactivity. In some cases, the affinity agent is an antibody, such as an scFv. In some cases, the affinity agent is an antibody (e.g., scFv) that has been optimized for stability in the intracellular environment. For example, the affinity agent (e.g., scFv) can be an intrabody (see, e.g., Lo et al., Handb. Exp. Pharm. 2008; (181):343-

73). An exemplary affinity agent comprises the anti-GCN4 scFv domain of SEQ ID NO:5.

The affinity agent can contain one or more solubility enhancing domains. For example, the affinity agent can be fused at the N- and/or C-terminus to a highly soluble, and/or a highly stable, polypeptide. Exemplary solubility enhancing domains include, without limitation, superfolder GFP (Pedelacq et al., Nat Biotechnol. 2006 January; 24(1):79-88), maltose binding protein, albumin, hen egg white lysozyme, glutathione S-transferase, the protein G B1 domain, protein D, the Z domain of protein A, thioredoxin, bacterioferritin, DhaA, HaloTag, and GrpE.

In some embodiments, the affinity agent comprises a transcriptional modulator domain. For example, the affinity agent can contain an affinity domain (e.g., an scFv domain) and a transcriptional modulator (e.g., transcriptional activator or repressor) domain. In some cases, the affinity agent contains an affinity domain fused to one or more copies of a VP8, VP16, or VP64 domain. In some cases, the affinity agent contains an anti-GCN4 affinitydomain fused to one or more copies of a VP8, VP16, or VP64 domain. An exemplary affinity agent containing a transcriptional modulator domain comprises SEQ ID NO:13.

Also described herein are expression cassettes and vectors for producing one or more affinity agents described herein in a host cell. The expression cassettes can contain a promoter (e.g., a heterologous promoter) operably linked to a polynucleotide encoding an affinity agent. The promoter can be inducible or constitutive. The promoter can be tissue specific. In some cases, the promoter is a strong promoter. For example, the promoter can be a CMV promoter, an SFFV long terminal repeat promoter, or the human elongation factor 1 promoter (EF1A). In some cases, the polynucleotide encoding an affinity agent of the expression cassette further encodes one or two nuclear localization sequences. For example, the polynucleotide can encode an affinity agent having a nuclear localization sequence at the N- and/or C-terminus. The expression cassette can be in a vector, such as a plasmid, a viral vector, a lentiviral vector, etc. In some cases, the expression cassette is in a host cell. The expression cassette can be episomal or integrated in the host cell.

III. Methods

Described herein are methods of using CRISPR/Cas for modulating transcription of one or more genes or genetic elements. The methods can be used to optimize sgRNAs by testing a pooled library of sgRNAs that target a single gene and selecting those that produce a desired phenotype. The methods can also be used for small, medium, or large scale (e.g., genome-wide) screening of genetic elements that contribute to a selected phenotype. The methods can also be used to identify interacting genes and gene networks. The methods can also be used for identifying targets for therapeutic development or lead compounds.

A. Screening for Genetic Elements that Modulate a Phenotype

Described herein is a method of screening for one or more genetic elements that modulate a phenotype. The method can be performed by contacting a plurality of cells with a library of structurally distinct small guide RNAs (sgRNAs) that target a plurality of genetic elements, such as any of the sgRNA or sgRNA libraries described herein. The contacting the plurality of cells with a plurality of sgRNAs can thereby generate a plurality of test cells, the plurality of test cells each comprising: a small guide RNA (sgRNA); and a nuclease deficient sgRNA-mediated nuclease (dCas9), wherein the dCas9 comprises a dCas9 domain fused to a transcriptional modulator or a dCas9 domain fused to an epitope fusion domain. The method includes selecting the cells on the basis of the phenotype and quantitating the frequency of the structurally distinct sgRNAs within the population of selected cells. sgRNAs that target genetic elements that modulate the phenotype can be overrepresented or underrepresented in the selected cells. In some cases, the cells are also contacted with a plurality (e.g., about 2, 3, 4, 5, 6, 7, 8, 9, 10, 15, 20, 25, 30, 50, 75, 100, 150, 200, 250, 300, 350, 400, 500, 750, 1000 or more) of control sgRNAs. For example, the control sgRNAs can have binding regions that do not bind to any genomic region or transcript. Alternatively, the control sgRNAs can bind to a genomic region that is known to not produce or affect the phenotype of interest. As yet another alternative the control sgRNAs can affect an alternate control phenotype.

The phenotype can be cell growth, survival, or proliferation. In some cases, the phenotype is cell growth, survival, or proliferation in the presence of an agent, such as a cytotoxic agent, an oncogene, a tumor suppressor, a transcription factor, a kinase (e.g., a receptor tyrosine kinase), a gene (e.g., an exogenous gene) under the control of a promoter (e.g., a heterologous promoter), a checkpoint gene or cell cycle regulator, a growth factor, a hormone, a DNA damaging agent, a drug, or a chemotherapeutic.

For example, test cells containing sgRNAs and dCas9 can be cultured in the presence of a growth factor such as epidermal growth factor. The cells can be harvested after a sufficient period of culturing. sgRNAs, or polynucleotides encoding the sgRNAs, can be extracted from the cells and quantified by, e.g., sequencing. The frequency of sgRNAs can be thereby determined. sgRNAs that increase cell growth, proliferation, viability, or survival in the presence of epidermal growth factor can thereby be identified as those that are overrepresented. sgRNAs that decrease growth, proliferation, viability, or survival of cells in the presence of epidermal growth factor can thereby be identified as those that are underrepresented. Overrepresentation and underrepresentation can be relative to their frequency in the library that was contacted with the cells, relative to the frequency of the sgRNAs in the cells (or a sub-population of the cells) prior to selection (or early in the selection period), or relative to a frequency in control cells that are not subject to the selection or subject to an alternative selection. The target genetic elements of such overrepresented or underrepresented sgRNAs can thereby be identified as genetic elements that modulate the phenotype.

The phenotype can also be protein expression, RNA expression, protein activity, or cell motility, migration, or invasiveness. For example, a plurality of cells that express a particular cell surface protein associated with tumor malignancy can be contacted with a plurality of sgRNAs and dCas9 transcriptional modulators (activators and/or repressors). The cells can be incubated for a sufficient time to allow sgRNA:dCas9 complex formation and transcriptional modulation. The cells can then be contacted with an antibody that recognizes the malignancy associated cell surface protein. The antibody can be used to select cells, or select against cells, that express the cell surface protein, for example by fluorescence activated cell sorting or using solid phase purification (e.g., with protein A agarose). sgRNAs that are overrepresented or underrepresented in the selected cells can be identified as altering cell surface expression of the malignancy associated protein. As another example, cell motility, migration, or invasiveness can be selected using a boyden chamber using methods known in the art.

The frequency of sgRNAs in test and/or control cells that are quantitated in various methods described herein can be determined in a variety of ways. In one embodiment, sgRNAs are quantitated by deep sequencing. As used herein, "deep sequencing" refers to highly redundant sequencing of a nucleic acid or a family of nucleic acids, such as a family of sgRNAs or a family of polynucleotides encoding sgRNAs. The redundancy (i.e., depth) of the sequencing is determined by the length of the sequence to be determined (X), the number of sequencing reads (N), and the average read length (L). The redundancy is then N×L/X. In the case of sgRNAs, the length of the sequence can be the length of the binding region, the full length of the sgRNA, or the length of a portion of the sgRNA that contains the binding region. The sequencing depth can be, or be at least about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 70, 80, 90, 100, 110, 120, 130, 150, 200, 300, 500, 500, 700, 1000, 2000, 3000, 4000, 5000 or more. Deep sequencing can provide an accurate number of the relative frequency of the sgRNAs. Deep sequencing can also provide a high confidence that even sgRNAs that are rarely present in a population of cells (e.g., a population of selected test cells) can be identified.

In some embodiments, the screen is an interference screen. In some cases, if the screen is an interference screen, the plurality of cells can be contacted with a library of sgRNAs, wherein a majority, substantial majority, or at least 90% (e.g., at least 90, 95, or 99%) of the sgRNAs are targeted at the TSS start site of a gene, or upstream (5') of the TSS of a gene. In some cases a majority, substantial majority, or at least 90% (e.g., at least 90, 95, or 99%) of the sgRNAs are targeted to a region between, or between about, 0 and about 750 bp upstream of the TSS of a gene.

If the screen is an interference screen, the plurality of cells can be contacted with a dCas9 containing a dCas9 domain. Binding of a dCas9 domain in complex with an sgRNA can interfere with transcription at or near the genetic element targeted by (bound to) the sgRNA:dCas9 complex. Without wishing to be bound to theory, it is believed that the sgRNA:dCas9 complex can compete with RNA polymerase or other transcriptional machinery to suppress transcription at or near the targeted genetic element.

Alternatively, if the screen is an interference screen, the plurality of cells can be contacted with a dCas9 containing a dCas9 domain fused to one or more copies of a transcriptional repressor. Exemplary transcriptional repressors include, without limitation, a KRAB domain, a chromoshadow domain, a SID domain, or an EAR-repression domain (SRDX). The transcriptional repressor can be codon optimized for efficient expression in the host cell.

As yet another alternative, if the screen is an interference screen, the plurality of cells can be contacted with a dCas9 containing a dCas9 domain fused to an epitope fusion domain. In such cases, the plurality of cells can also be contacted with an affinity agent having affinity for the epitope of the epitope fusion protein. The affinity agent can contain an affinity domain (e.g., an scFv) or an affinity domain fused to a transcriptional repressor. Binding of the sgRNA:dCas9 complex to a targeted genetic element can then recruit one or more copies of the affinity agent to the site of the targeted genetic element. In cases where the affinity agent is not fused to a transcriptional repressor, the enhanced size of the sgRNA:dCas9:affinity agent complex can further suppress expression at or near the targeted genetic element relative to a complex of sgRNA and a dCas9 domain. In cases, where the affinity agent is fused to a transcriptional repressor, the recruitment of multiple copies of the transcriptional repressor can further suppress expression at or near the targeted genetic element relative to the previously described transcriptional repressors.

In some embodiments, the screen is an activation screen. In such cases, the plurality of cells can be contacted with a library of sgRNAs, wherein a majority, substantial majority, or at least 90% (e.g., at least 90, 95, or 99%) of the sgRNAs are targeted at the TSS start site of a gene, or downstream (3') of the TSS of a gene. In some cases a majority, substantial majority, or at least 90% (e.g., at least 90, 95, or 99%) of the sgRNAs are targeted to a region between, or between about, 0 and about 1000 bp downstream of the TSS of a gene.

In some cases, wherein the screen is an activation screen, the plurality of cells can be contacted with a dCas9 containing a dCas9 domain fused to one or more copies of a transcriptional activator. Exemplary transcriptional repressors include, without limitation, a p65 activation domain (p65AD), or one or more copies of a VP8, VP16, or VP64 domain. The transcriptional repressor can be codon optimized for efficient expression in the host cell.

As yet another alternative, the plurality of cells can be contacted with a dCas9 containing a dCas9 domain fused to an epitope fusion domain. In such cases, the plurality of cells can also be contacted with an affinity agent having affinity for the epitope of the epitope fusion protein. The affinity agent can contain an affinity domain fused to a transcriptional activator, such as any of the activators described herein. Binding of the sgRNA:dCas9 complex to a targeted genetic element can then recruit one or more copies of the affinity agent to the site of the targeted genetic element. The recruitment of multiple copies of the affinity agent and thus multiple copies of the transcriptional activator can further activate expression at or near the targeted genetic element relative to activation provided by a dCas9 fused to a transcriptional activator.

In some embodiments, an activation and an interference screen can be performed at the same time. For example, a plurality of cells can be contacted with an sgRNA library. The plurality of cells can further be contacted with both dCas9 interference modulators and dCas9 transcriptional activation modulators. For example, dCas9 interference can be provided by a dCas9 domain, a dCas9 domain fused to a transcriptional repressor, or a dCas9 fused to an epitope fusion protein and an affinity agent fused to a transcriptional repressor. As another example, the interference can be provided by a Cas9 nuclease that cleaves or knicks target nucleic acid.

As yet another example, dCas9 activation can be provided by a dCas9 domain fused to a transcriptional activator, or a dCas9 fused to an epitope fusion protein and an affinity agent fused to a transcriptional activator. In some cases, a portion of the plurality of cells can contain a dCas9 transcriptional activator and a portion can contain a transcriptional repressor. Thus, sgRNAs that complex with an activator can activate targeted genetic elements and sgRNAs that complex with a repressor can repress targeted genetic elements.

As yet another example, the plurality of cells can be contacted with a library of sgRNAs and a library of shRNAs and a dCas9 transcriptional activator. The dCas9 transcriptional activator can be a dCas9 domain fused to transcriptional activator or a dCas9 fused to an epitope fusion domain that is bound to one or more copies of an affinity agent fused to a transcriptional activator. Thus, the shRNAs repress target genetic elements and the sgRNAs activate target genetic elements.

sgRNAs and/or shRNAs that target genetic elements that modulate a phenotype can then be identified as described herein. For example, sgRNAs and/or shRNAs that are overrepresented or underrepresented in selected cells can be identified. In some cases, the method can further include associating whether the overrepresented or overrepresented sgRNAs are in cells providing dCas9 interference or dCas9 activation.

B. Identifying Druggable Targets and Lead or Therapeutic Compounds

Described herein are methods of identifying targets for drug development or identifying lead compounds. As an example, methods described herein can be used to identify target genes or genetic elements whose transcriptional modulation produces a desired phenotype. The identified target can then serve as a target for lead compound identification, screening, or development.

In some embodiments, the method includes performing an sgRNA screen, such as any of the sgRNA screens described herein, on a plurality of cells using a library of sgRNAs, such as any of the sgRNAs or libraries described herein to identify a gene or genetic element that modulates a phenotype. For example, the phenotype can be a growth, proliferation, survival, or viability of a tumor cell. In some cases, the screen can identify genetic elements whose transcriptional modulation affects growth, proliferation, survival, or viability of the tumor cell. In some cases, the genetic elements encode or regulate protein targets, or portions thereof, for which pharmaceutical inhibitors or activators are known. In some cases, activators or inhibitors are known, but they are not suitable therapeutic pharmaceutical agents. In such cases, the activators or inhibitors can serve as lead compounds for further development of therapeutic pharmaceutical agents.

In some cases, the genetic elements encode or regulate protein targets, or portions thereof for which activators or inhibitors are as yet unidentified. Nevertheless, the identification of the genetic elements can allow development of screening methods for identification or development of lead compounds and/or pharmaceutical agents. For example, the genetic element, or a genomic region containing the genetic element can be operably linked to a reporter gene. The activity of the reporter gene can be assayed in the presence of a large number of different candidate compounds to identify a lead compound.

C. Identifying Interacting Genetic Elements

Identification of genetic interactions (GI) between pairwise sets of genetic elements, have enabled the systematic exploration of gene function in various organisms. Described herein, are methods for performing large scale and unbiased screens for pairwise genetic interactions using sgRNAs. For example, a plurality of sgRNAs can be contacted with a plurality of cells to identify high-confidence target genetic elements for a given phenotype and effective sgRNAs. Double-sgRNA libraries can be constructed from this list of high-confidence target genetic elements to systematically measure GIs between hits.

In some cases, the plurality of sgRNAs can be selected or designed to target each gene, genetic element, or genomic region with multiple sgRNAs (e.g., about, or at least about, 2, 3, 4, 5, 6, 7, 8, 9, 10, 11, 12, 13, 14, 15, 16, 17, 18, 19, 20, 21, 22, 23, 24, or 25 sgRNAs per targeted gene, genomic region, or genetic element). Such highly complex libraries increase the likelihood of targeting each gene with several effective sgRNAs, thus reducing the false-negative rate. Additionally, requiring several effective sgRNAs to identify a hit gene reduces the rate of false-positives, since it is unlikely that several sgRNAs targeting a non-hit gene have off-target effects relevant to the phenotype of interest.

Therefore, in some cases, the plurality of sgRNAs can be selected or designed to target each gene, genetic element, or genomic region with a minimal number of effective sgRNAs (e.g., about, or at less than about, 25, 24, 23, 22, 21, 20, 19, 18, 17, 16, 15, 14, 13, 12, 11, 10, 9, 8, 7, 6, or 5 sgRNAs per targeted gene, genomic region, or genetic element). Such minimally complex libraries can be advantageous for enabling large scale and efficient screening. For example, if 100 sgRNAs per targeted gene is required for high confidence screening, a library must be 10-fold larger than a library that requires only 10 sgRNAs per targeted gene for high confidence screening.

The ability to rapidly generate GI maps can identify previously unrecognized gene functions and inform the design of combination therapies based on synergistic pairs. For example, pairs of genes that exhibit synthetic lethality in cancer cells, but not healthy cells, are ideal targets for combination therapies aimed at limiting the emergence of drug resistance in rapidly evolving cells. As another example, if a first and a second gene form an unexpected synergistic genetic interaction for an undesirable phenotype (e.g., tumor growth), then a combination therapy that inhibits both targets can be designed.

In some embodiments, each sgRNA of a pair in a double sgRNA screen is expected to contribute additively to a phenotype of interest in the absence of genetic interaction. Thus, for example, if a single first sgRNA is underrepresented on average by 50% after selection for a phenotype of interest and a single second sgRNA is overrepresented on average by 50% after selection for a phenotype of interest, then a non-interacting pair would be expected to lack significant overrepresentation or underrepresentation. Thus, interacting genes, genomic regions, or genetic elements are identified as corresponding to those sgRNA pairs that are present after a selection event as pairwise combinations that deviate in frequency from the additive relationship expected from the frequency determined in the initial individual sgRNA screen.

D. Identifying Rules for Optimal Targeting of Genetic Elements with CRISPR/Cas

Described herein are methods of assaying sgRNAs for targeting efficiency (e.g., cutting, nicking, interfering, or activating). These assays can be used to develop or discover rules for optimal or optimized sgRNA design. In some embodiments, a library or pool of sgRNAs that target a single gene, genomic region, or genetic element can be generated. The library can be utilized to test which sgRNAs produce a desired phenotype and/or have the highest targeting efficiency. The sequence of the sgRNA (e.g., the sequence of the binding region) and information about the targeted genetic element can then be combined to discover sgRNA design rules. In some cases, the pool of sgRNAs can be designed to contain sgRNAs with mismatched base pairs for use as controls or to determine the effect of mismatches on sgRNA targeting efficiency.

In some cases, the target gene is a reporter gene (e.g., encoding a fluorescent protein, a luciferase, or a gene that confers resistance to a selection agent). In some cases, the reporter gene is present on a plasmid. In other cases, the reporter gene is integrated into the genome of a host cell. In some cases, assaying sgRNA targeting efficiency against an endogenous or heterologous gene that is in the genome of a host cell can allow for analysis or discovery of genomic context specific rules for sgRNA targeting. For example, rules for optimal chromatin conformation or enhancer site positioning can be examined. In some cases, assaying sgRNA targeting efficiency against an episomal or plasmid-based gene can allow for robust signal generation to examine subtle variations in targeting efficiency.

IV. Kits

Described herein are kits for performing sgRNA transcriptional modulation. The kits can be used for performing sgRNA screens as described herein. In one embodiment, the kit contains an sgRNA scaffold and a polynucleotide encoding a Cas9 or dCas9 (e.g., an activating or repressing dCas9). In another embodiment, the kit contains a library of polynucleotides encoding structurally distinct sgRNAs and a polynucleotide encoding a Cas9 or dCas9. In some cases, the kit contains a polynucleotide encoding a dCas9 activator and a dCas9 repressor. In some cases, the kit contains a polynucleotide encoding an affinity agent, such as an affinity agent having affinity for an epitope fused to a dCas9 domain. In some cases, affinity agent having affinity for an epitope fused to a dCas9 domain is fused to a transcriptional activator or repressor. In some cases, the polynucleotides (e.g., polynucleotides encoding sgRNAs, or sgRNA-mediated nucleases) are in expression cassettes and operably linked to a promoter. In some cases, the expression cassettes are in suitable vectors. In some cases, one or more of the vectors or expression cassettes are in a host cell.

In some cases, the kit contains a plurality of host cells, each cell containing an expression cassette encoding a Cas9 or dCas9, and optionally an expression cassette encoding an affinity agent. The kit can further contain an sgRNA scaffold. The kit can be used to clone a library of sgRNA binding regions (e.g., binding regions complementary to) into the sgRNA scaffold and transform the plurality of host cells. The host cells can be selected on the basis of a phenotype of interest and thereby perform any of the sgRNA screens described herein.

All patents, patent applications, and other publications, including GenBank Accession Numbers, cited in this application are incorporated by reference in the entirety for all purposes.

EXAMPLES

The following examples are provided by way of illustration only and not by way of limitation. Those of skill in the art will readily recognize a variety of non-critical parameters that could be changed or modified to yield essentially the same or similar results.

Example 1: Modular sgRNAs

A BlpI site was introduced into the 5' hairpin region of an sgRNA scaffold. A library of sgRNA binding regions was synthesized using solid phase synthesis techniques. The binding regions have a 3' end that can be ligated to a cut BlpI site. The sgRNA scaffold was cut with BlpI and purified. Synthesized binding regions were recovered and ligated to the cut sgRNA scaffold to produce a library of sgRNAs.

Example 2: Inducible CRISPRi System

An inducible CRISPRi system was constructed that enables dynamic control of gene expression. This optimized set of fusion proteins positions a transcriptional repressor effector domain (KRAB) to the N-terminus using an optimized linker domain and removes the fluorescent tag from dCas9 via a self-cleaving peptide. The optimized CRISPRi system shows a 4-15 fold improved activity on a GFP reporter. The CRISPRi system involves delivery of 3 genes or gene products (e.g., an optimized sgRNA, a tet-transactivator, and a tet inducible dCas9-repressor construct).

Example 3: Inducible System for Multimerization of Effector Domains at DNA with CRISPR An inducible Cas9 system for controllable multimerization of effector domains at DNA is constructed. This system involves the delivery of 4 genes or gene products (e.g., an optimized sgRNA, a tet-transactivator, and the tet inducible dCas9-GCN4 epitope fusion protein, and a recombinant single chain variable chain fragment antibody which binds to the GCN4 epitope fused to sfGFP and VP64 (scFVVP64)).

Activation can be tuned to a desired level by varying the number of GCN4 epitopes in the dCas9-GCN4 fusion protein. Fusion proteins with 6, 10 or 24 epitope copies (antibody binding sites) are constructed. The ratio of dCas9 protein to scFVVP64 can also be tuned, e.g., by appropriate promoter and inducer selection. The concentration of antibody and effector protein should typically exceed the concentration of the dCas9 fusion protein by the number of epitope binding sites on the dCas9 fusion. For example a construct that expresses at least 10 fold more scFV-VP64 than dCas9-10×GCN4 can in theory saturate each dCas9-10×GCN4 fusion protein with antibody delivered effector domains. This inducible dCas9 fusion system can be expressed in the absence of doxycycline to achieve sufficiently low dCas9 fusion protein levels.

Stability of intracellular antibodies (e.g., macroaggregation or microaggregation) in the presence and/or absence of dCas9 can also be optimized. An antibody fusion with optimized solubility and stability is obtain by selecting cell clones using a discrimination function with defined rules for the proper levels and localization of the antibody. Too much antibody expression or too little antibody expression can result in a nonfunctional multimerization system.

To optimize a working multimerization system single cell flow cytometry data is utilized to screen for a number of candidate constructs for proper expression level, stability, and activity. Test genes such as CXCR4 which is off in K562 cells are assayed for activation in a population of cells with different dCas9GCN4 fusion proteins and different scFV antibodies. Both median and mean activation of transcription is measured to determine optimal expression levels of sgRNA:dCas9:affinity agent components to optimally activate transcription in all cells. 50-fold induction in protein of genes which are completely off such as CXCR4 in K562 cells is achieved. The activation is unimodal with only ~2% of cells showing weak or no activation.

Example 4: Establishing Rules for sgRNA Targeting

A complex pool of ~55,000 sgRNAs targeting 10 kb around the transcription start sites of 50 genes known to influence resistance/sensitivity to the toxin ricin was constructed. This pool (or "library") included every possible sgRNA between 19 and 25 bp long, starting with a G (for efficient transcription) and having a binding region (and thus corresponding target sequence ending immediately before an NGG (a protospacer adjacent motif for *Streptococcus pyogenes* Cas9). sgRNAs expected to have significant off-target binding sites elsewhere in the genome were filtered out. This was done by establishing a scoring metric as follows: PAM G1=40; PAM G2=19; PAM N=0; Region I=28; Region II=19; Region III=10. Offtarget binding at any given site can be estimated as: 1−sum (mismatches*mismatch_score)/40. For inclusion in this library, no mismatch was greater than 0. The library also included approximately 1000 sgRNAs designed against scrambled target sequences that were estimated to have no binding site anywhere in the genome as negative controls.

The library was tested in K562 cells expressing dCas9, dCas9-Krap, dCas9-VP64, and nuclease active Cas9, driven by both constitutive and tretacycline inducible promoters, and screening for ricin sensitivity as described (Bassik et al., Cell. Feb. 14, 2013; 152(4): 909-922; Kampmann et al., Proc Natl Acad Sci USA. Jun. 18, 2013; 110(25): E2317-E2326).

These tests established rules for selecting sgRNAs that are critical for KRAB-mediated repression and VP64-mediated activation screening, as described herein. By searching for the optimal window for dCas9-Krab mediated repression, a window of 50 bp upstream of the transcription start site (TSS) to 300 bp downstream was determined as most effective and a window of 50-400 bp upstream of the TSS was determined most effective for dCas9 mediated activation.

The length of sgRNA binding regions was tested and shorter guides of 19-21 bp are determined to be more effective than longer guides.

Ensemble transcripts annotated by the APPRIS pipeline were determined as most likely to exhibit a phenotype.

sgRNAs containing binding regions having four or more consecutive nucleotides were found to be generally deleterious, with putative PolIII terminator poly-U the worst and poly-C the least.

Guide strength (plotted as Z-score) is generally consistent across a range of GC percent (x-axis), but extremely high or low values were determined to be worse on average.

Overlapping, or nearly overlapping, sgRNAs (0-0 and 1-4 bp apart) were enriched for phenotypes that have little or no difference, suggesting libraries should be designed to enforce at least 5 bp separation between sgRNA target sequences.

sgRNAs that target sequences with a low MNase-seq signal correlated with stronger average guide Z-scores, indicating that sgRNAs should be targeted to genetic elements with a low MNase seq signal.

A strong agreement between ENCODE published PolII ChIP-seq signal and CRISPRi phenotype was observed, suggesting that CRISPRi sgRNAs should be targeted to regions where PolII ChIP-seq signal is high. Similarly, as much of PolII signal at the TSS is not associated with productive transcription, filtering where PolII is most active with published Global Run-on Sequencing (GRO-seq) data further refined sgRNA targeting rules. Applying a threshold for guide length along with MNase, PolII, and GRO-seq signals, each alone or in combination, improved the median Z-score of guides by up to 10-fold.

Example 5: Utilizing Established sgRNA Selection Rules in a Support Vector Machine The rules established in Example 4 were used to train a support vector regression machine (SVR) to predict the most active guides for every gene in the genome of a target cell. Guide positioning, length, PolII signal, and MNase signal were used to train the SVR on 25% of the data. The SVM was cross-validated by leaving out each gene and testing the ability of the machine to predict the sgRNA activity for that gene based on the other genes in the training set. Selecting 25 top guides per gene predicted by the SVR versus 24 shRNAs gave stronger p-values in almost every case for CRISPRi and CRISPRa.

Example 5: CRISPRa Protein Multimerization

Cells were contacted with an sgRNA, a dCas9-10× epitope fusion, and an scFv-VP64 fusion with affinity to the epitope. K562 cells contacted with dCas9-GCN4-10× and scFv-sfGFP-VP64 and 1, 2, or 3 different sgRNAs targeting the CXCR4 locus show strong induction of CXCR4 activation. Cells contacted with dCas9-VP64 fusion are and 1, 2, or 3 different sgRNAs targeting the CXCR4 locus show moderate CXCR4 activation. K562 cells contacted with 3 different sgRNAs targeting the CXCR4 locus and scFv-sfGFP-VP64 exhibit strong cell surface expression of CXCR4 as demonstrated by flow cytometry. Cells contacted with dCas9-VP64 fusion are and 3, 2, or 1 different sgRNAs targeting the CXCR4 locus and scFv-sfGFP-VP64 show increasing levels of cellular migration.

Example 6

I. Abstract

While the catalog of mammalian transcripts and their expression levels in different cell types and disease states is rapidly expanding, our understanding of their function lags far behind. Presented herein is a robust technology enabling systematic investigation of the cellular consequences of repressing or inducing any transcript. Rules for efficient and specific targeting of transcriptional repressors (CRISPRi) or activators (CRISPRa) to endogenous genes via endonuclease-deficient Cas9, enabling modulation of expression over a ~1000-fold range were identified. Using these rules, construct a genome-scale CRISPRi library was constructed and validated with two pooled screens. A growth-based screen robustly identified essential gene sets. A screen for sensitivity to a cholera-diptheria fusion toxin provided broad insights into the molecular mechanisms of toxin entry, retro-translocation and toxicity. Importantly, CRISPRi has minimal off-target effects, robustly represses transcription (typically achieving 90-99%), and is non-toxic and reversible. Together, CRISPRi and CRISPRa represent key tools for defining gene function in metazoans.

II. Introduction

Dramatic advances in sequencing technology have catalogued a universe of RNA transcripts—greatly exceeding the number of canonical protein-coding open reading frames (ORFs)—which collectively are responsible for carrying out the instruction encoded in the genome (Pubmed IDs: 22955620, 24670764, 20220758, 24037378, 19812545). A central challenge now is to understand the biological role of these transcripts and how quantitative differences in their expression define cellular states in normal development and in disease. Despite intense efforts, the function of many protein-coding genes remains poorly defined, and even less is known about the biological roles of most non-canonical transcripts such as enhancer RNAs, upstream antisense RNAs, lncRNAs, or other intergenic RNAs (Pubmed IDs: 24679528, 24267885). Efforts to address this deficiency in our knowledge would be greatly aided by techniques that are capable of dynamically and precisely controlling the expression of individual transcripts.

One way to explore gene function is to disrupt transcript expression through deletion or repression. However, the dominant tool for programmed knockdown of mRNAs, RNA-interference (RNAi), has pervasive problems with off-target effects, which can be especially confounding in the context of large-scale screens (Pubmed IDs: 23394947, 16929316, 15042091, 15960972, 17572676, 19012953, 12754523, 22344029). Additionally, because RNAi is mediated by cytoplasmic argounaute proteins, gene silencing through this approach is best suited to depletion of cytosolic mRNA targets.

An alternative emerging strategy is programmable genome editing methods that permanently delete or modify DNA using designable, sequence-specific endonucleases such as zinc finger, TALEN or CRISPR (clustered regularly interspaced short palindromic repeats)/Cas9 (CRISPR-associated protein 9) proteins (Pubmed IDs: 20717154, 20660643, 21179091, 22745249, 23386978, 23287718, 23287722, 23360966, 23360964, 23360965, 23643243). A series of elegant studies recently exploited the readily programmable nature of Cas9, in which the specificity is determined by a short guide (sg)RNA, to enable genome-wide loss of function screens (Pubmed IDs: 24336569, 24336571, 24535568, 24717434). These established CRISPR cutting as a powerful screening technology complementary to RNAi (especially when full knockouts are needed to see phenotypes) or haploid mutagenesis screens (Pubmed IDs: 19965467). Nonetheless, screening approaches based on genome editing are currently focused on loss-of-function studies involving irreversible frameshift disruptions, limiting their utility for the study of essential genes and noncoding RNAs. Additionally, double-stranded DNA breaks can be cytotoxic (Pubmed IDs: 24584192, 12016139, 11048728. 8643488). Finally, indel formation from error-prone DNA repair often leads to variable, short in-frame deletions or insertions, limiting the ability to reliably disable all of the alleles of a gene.

A programmable DNA binding protein that can recruit an effector domain to turn on and off transcription in a dynamic and quantitative manner offers, in principle, a more flexible tool for interrogating the many transcripts in complex genomes. Pioneering experiments with designed chimeric zinc finger and TALE proteins fused to transcription effector domains demonstrate that such an approach can modulate transcription of endogenous genes (Pubmed IDs: 9843940, 10660690, 21248753, 23664777, 23396285, 23377379, 23877069). However, as each transcript target requires a unique fusion protein, expanding these methods to genome-scale is arduous.

Recently, catalytically inactive Cas9 (dCas9) fusion proteins guided by gene specific sgRNAs have been used to localize effector domains to specific DNA sequences to either repress (CRISPRi) or activate (CRISPRa) transcription of target genes (Pubmed IDs: 23452860, 23849981, 24360272, 23979020, 23892898, 23977949, 23892895, 23761437, 23907171). To date, a very small number of sgRNAs have been tested, leaving unanswered whether CRISPRi/a is a feasible strategy for globally interrogating gene function and, if so, how best to target a gene to activate or repress transcription while minimizing off-target effects.

Here, the development and application of a method for high-specificity, genome-wide modulation of transcription of endogenous genes in human cells using CRISPRi/a is described. To accomplish this, a saturating screen was performed in which the activity of every nonredundant sgRNA tiling over 49 kilobases of DNA around the transcription start sites of 49 genes known to modulate cellular susceptibility to ricin was tested. From this, distinct rules for how and where either CRISPRi or CRISPRa maximally changes the expression of endogenous genes in human cells were extracted, as well as rules for predicting off-target effects, providing an algorithm to design a genome-scale library targeting each gene with 10 sgRNAs. This library was validated by first screening for genes essential for cell growth or survival, and in a second experiment screening for genes that govern response to a chimeric cholera/diphtheria fusion toxin (CTx-DTA) (22123862). The former robustly enriches for known categories of essential genes and the latter provides comprehensive insights into the molecular mechanisms of CTx-DTA intoxication. These experiments demonstrate our CRISPRi/a screening platform is robust, showing very high reproducibility and activity with undetectable intrinsic toxicity.

More generally, these experiments establish that CRISPRi/a transcriptional control is inducible, reversible, and can target essential genes. CRISPRi and CRISPRa can be used to control transcript levels for endogenous genes across a high dynamic range (up to ~1000-fold). Extensive evidence is also provided that properly designed CRISPRi/a reagents show exquisite specificity. As such, this method represents a transformative tool for defining transcript function across the breadth of transcripts encoded by the human genome.

III. Results

A. High Throughput-Tiling Screen Defines Rules for CRISPRi Activity at Endogenous Genes CRISPRi can repress transcription by directly blocking RNA polymerase activity (dCas9) or through effector domain-mediated transcriptional silencing (dCas9-KRAB). In order to better understand and optimize CRISPRi activity, a pooled high throughput screen was used to define rules that determine CRISPRi repression of endogenous genes. 49 genes that had previously shown to modulate cellular susceptibility to the AB toxin ricin (Pubmed ID: 23394947) were targeted. The resistance phenotype (protective or sensitizing) for these 49 genes had earlier been catalogued by RNAi mediated knock-down in K562 cells, showing that the amount of gene repression for these genes typically has a monotonic, near-linear relationship with the ricin resistance phenotype. This observation allowed the use of a ricin resistance score calculated by measuring sgRNA frequencies in a pooled screen to measure how much dCas9 or dCas9-KRAB repressed transcription for thousands of sgRNAs.

Using massively parallel oligonucleotide synthesis, a library of sgRNAs was generated that tiled the DNA in a 10-kilobase window around the transcription start site of these 49 genes (54,000 total sgRNAs) (Pubmed ID: 19448642) (FIG. 1A). sgRNAs were predicted to have off-target activity were excluded based on a provisional score that was developed using data from published Cas9 and dCas9 activity at near-consensus DNA binding sites containing mismatches (see below for an empirical measure of specificity) (Pubmed ID: 23873081, 23792628, 23452860). This cutoff filtered out most sgRNAs mapping to repetitive SINE or LINE elements. To determine how sgRNA length impacts CRISPRi function, sgRNAs between 19-25 base pairs in length were included, including overlapping variable length sgRNAs that share the same protospacer adjacent motif (PAM). 1,000 negative control sgRNAs that were picked according to the same principles as targeted sgRNAs, but derived from scrambled pseudo-genome sequences and predicted not to target any sites in the human genome were also included.

Figures 8A, 8B:
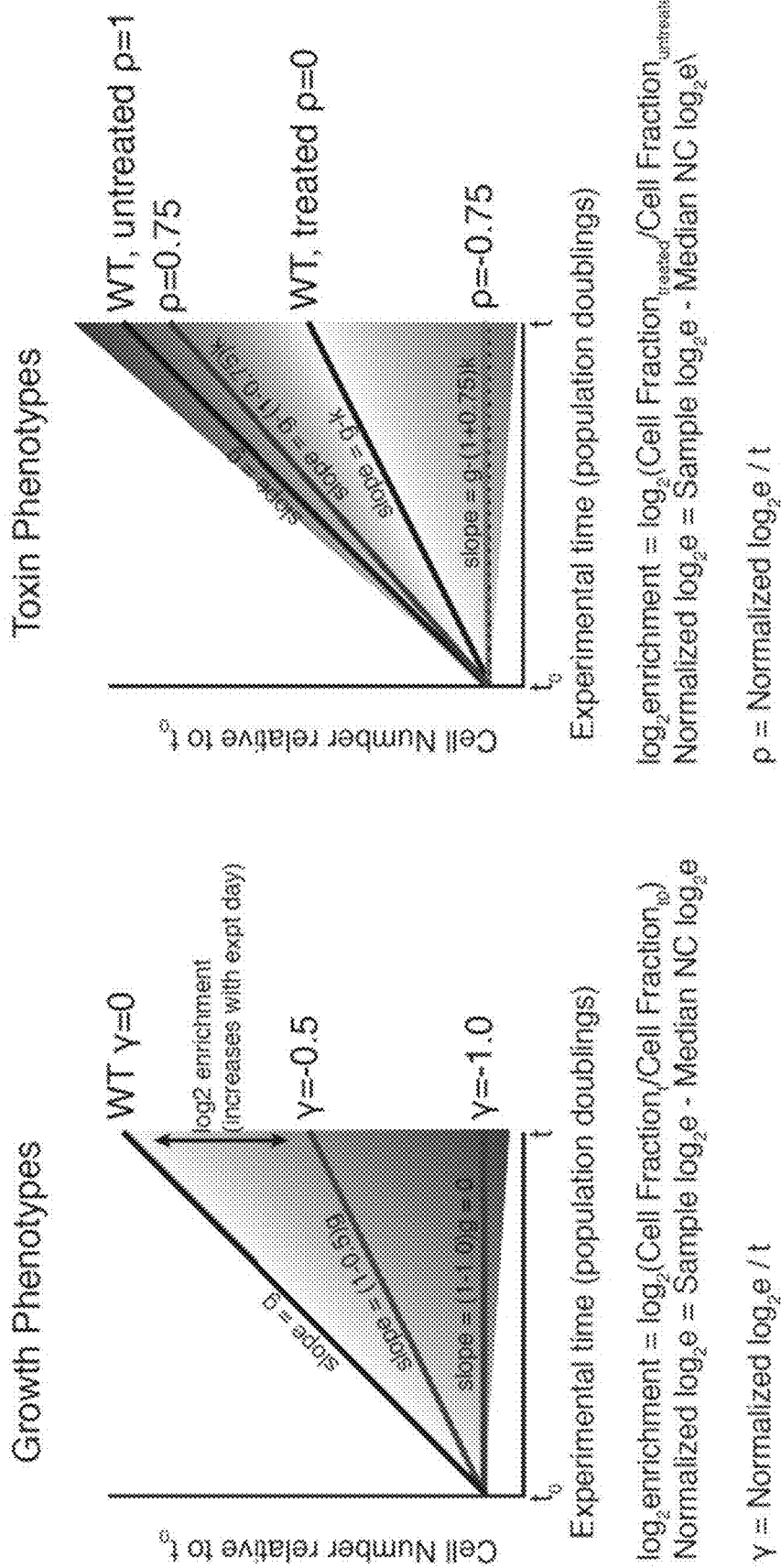
FIG. 8A-FIG. 8C: Mathematical framework for quantifying sgRNA phenotype and activity.

This test library of sgRNAs was packaged into lentiviral particles and used to transduce, K562 human myeloid leukemia cells stably expressing dCas9 or a dCas9-KRAB fusion protein (Pubmed ID: 23849981). To ensure that the majority of cells expressed no more than one sgRNA, the multiplicity of infection to was limited to 0.3. Populations of cells expressing this library of sgRNAs were either harvested at the outset of the experiment, grown under standard conditions, or treated with ricin. Two biological replicates of each screen were performed. The frequency of each sgRNA in the library following growth in each condition was then counted using deep sequencing to determine how each sgRNA in the library modulates cell growth and cellular susceptibility to ricin, phenotypes that were defined quantitatively as gamma and rho, respectively (See FIG. 8A and FIG. 8B and Pubmed ID: 23739767).

Figure 1B:
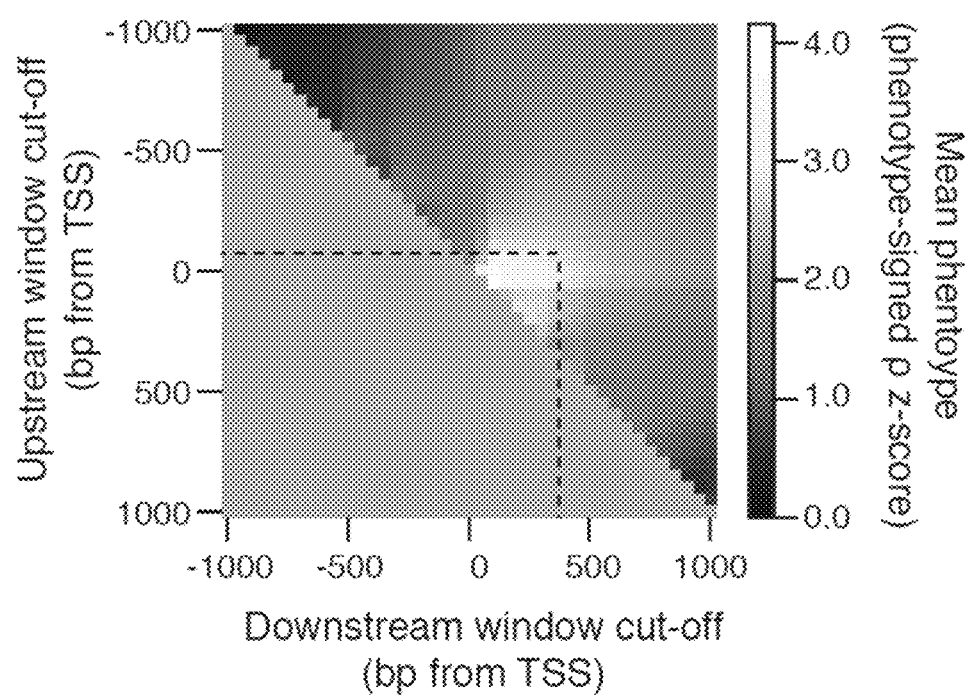
Figure 1C:
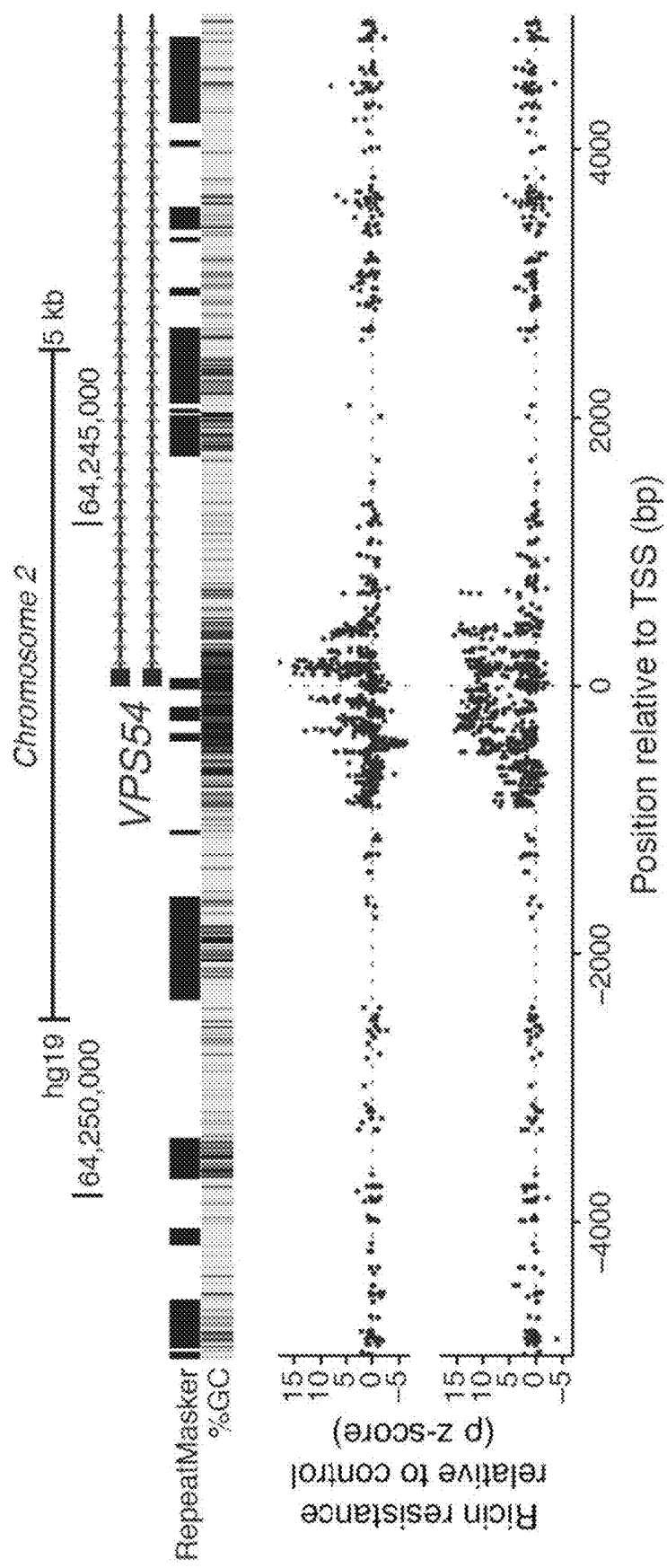
Figure 1D:
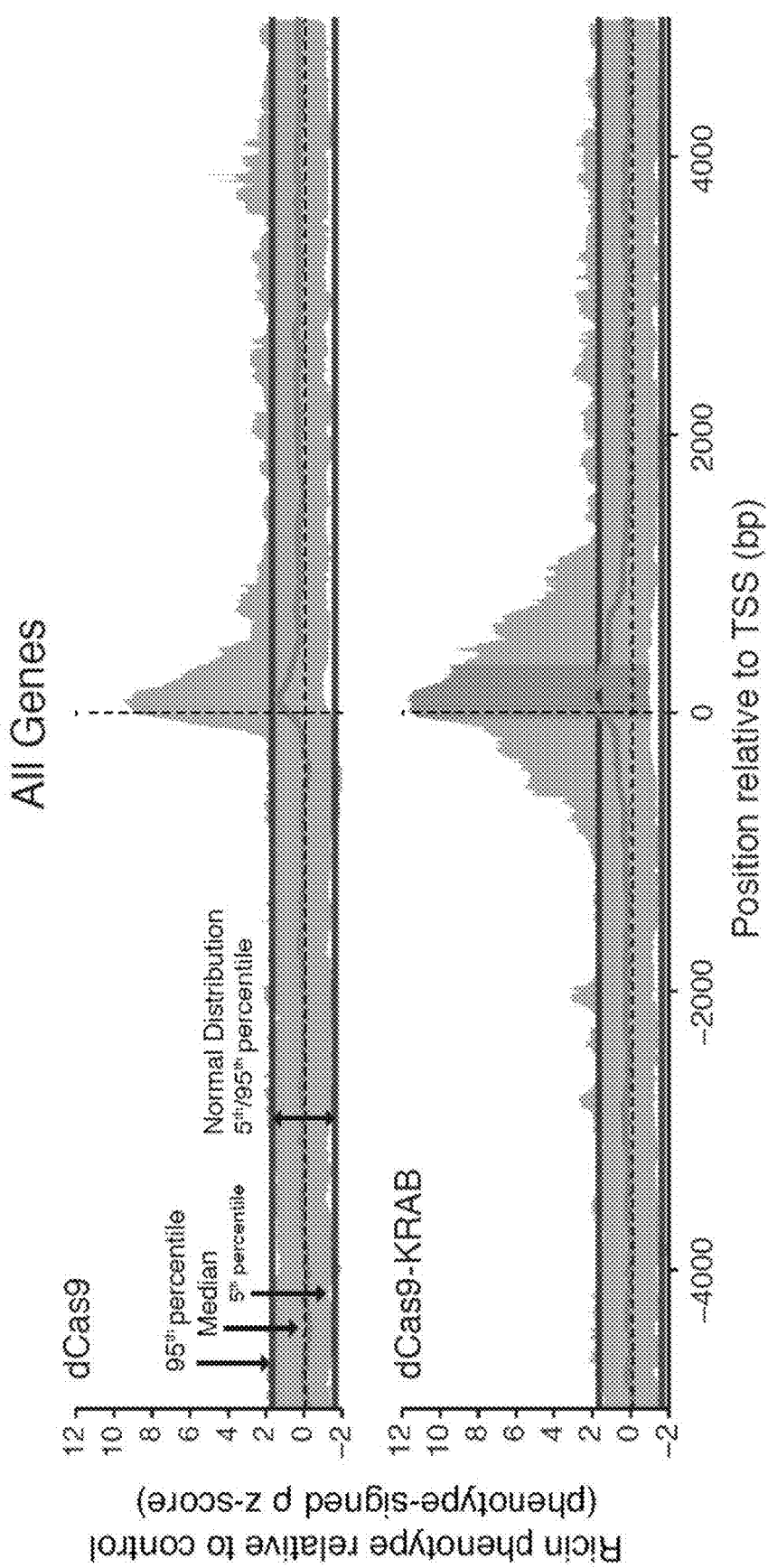
Figure 9A:
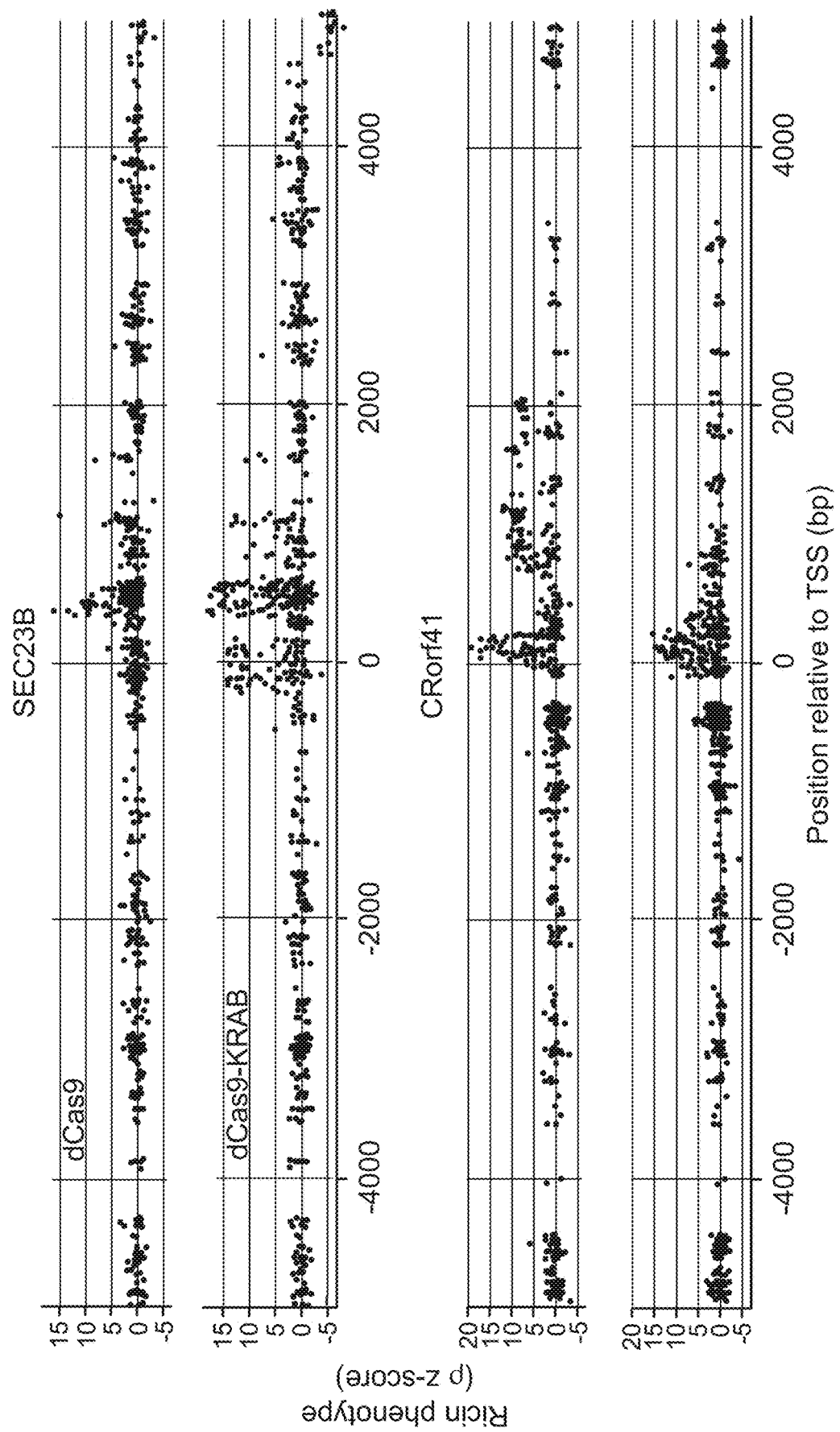

Initial inspection of data revealed that many sgRNAs potently repress gene expression, as evidenced by their impact on ricin sensitivity (FIG. 1C and FIG. 9A). Plotting this data for all 49 genes showed that active sgRNAs cluster around or just downstream from the transcription start site of each gene for dCas9-KRAB and dCas9, respectively (FIG. 1D). This activity pattern is consistent with the KRAB domain acting as a transcription repressor and dCas9 inhibiting transcription by interfering with RNA polymerase activity (Pubmed IDs: 23452860, 23849981).

Figure 9B:
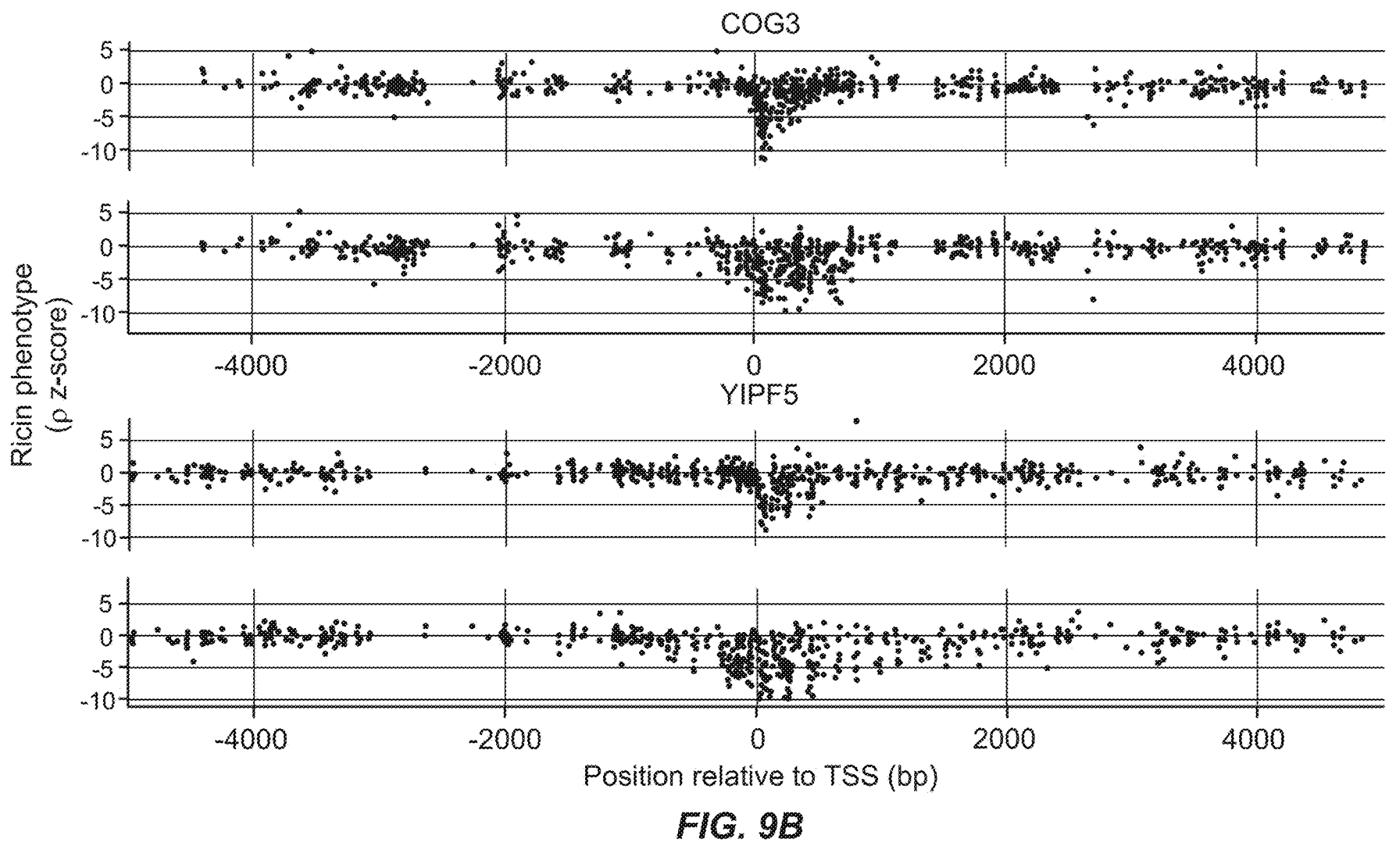
Figure 9C:
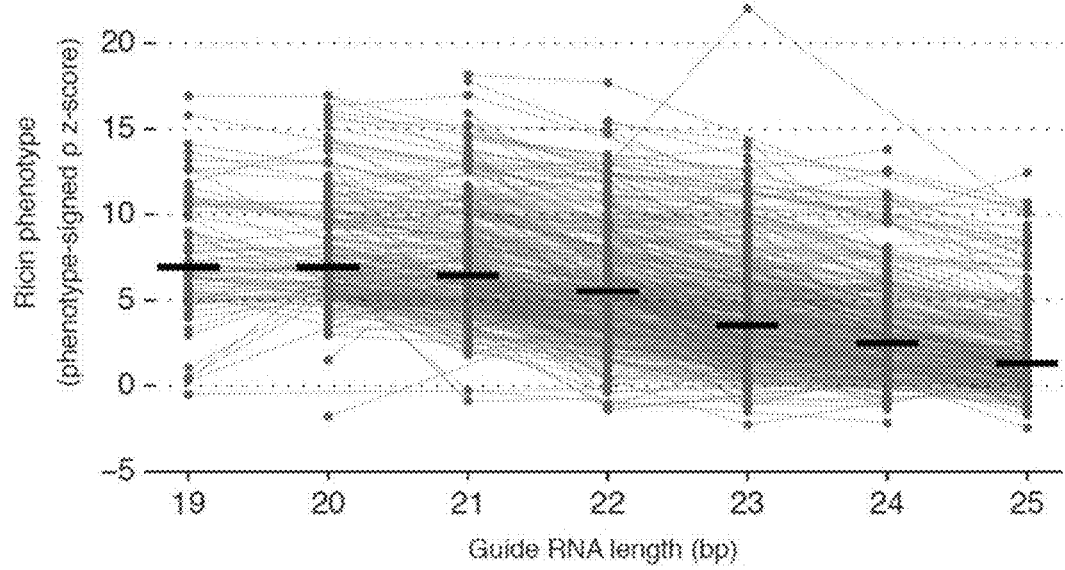
Figure 9D:
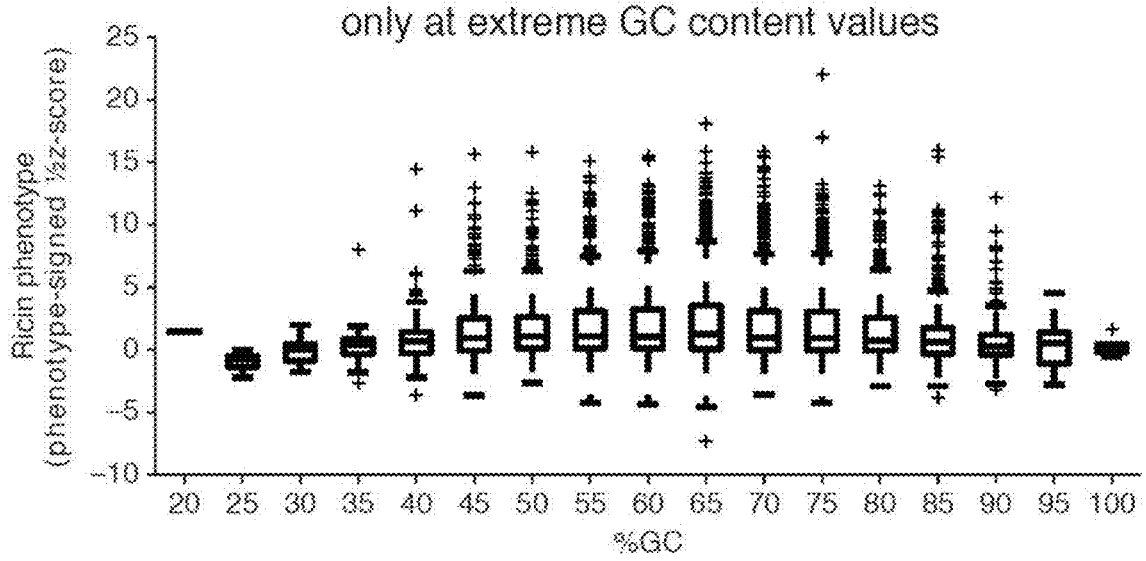
Figure 9E:
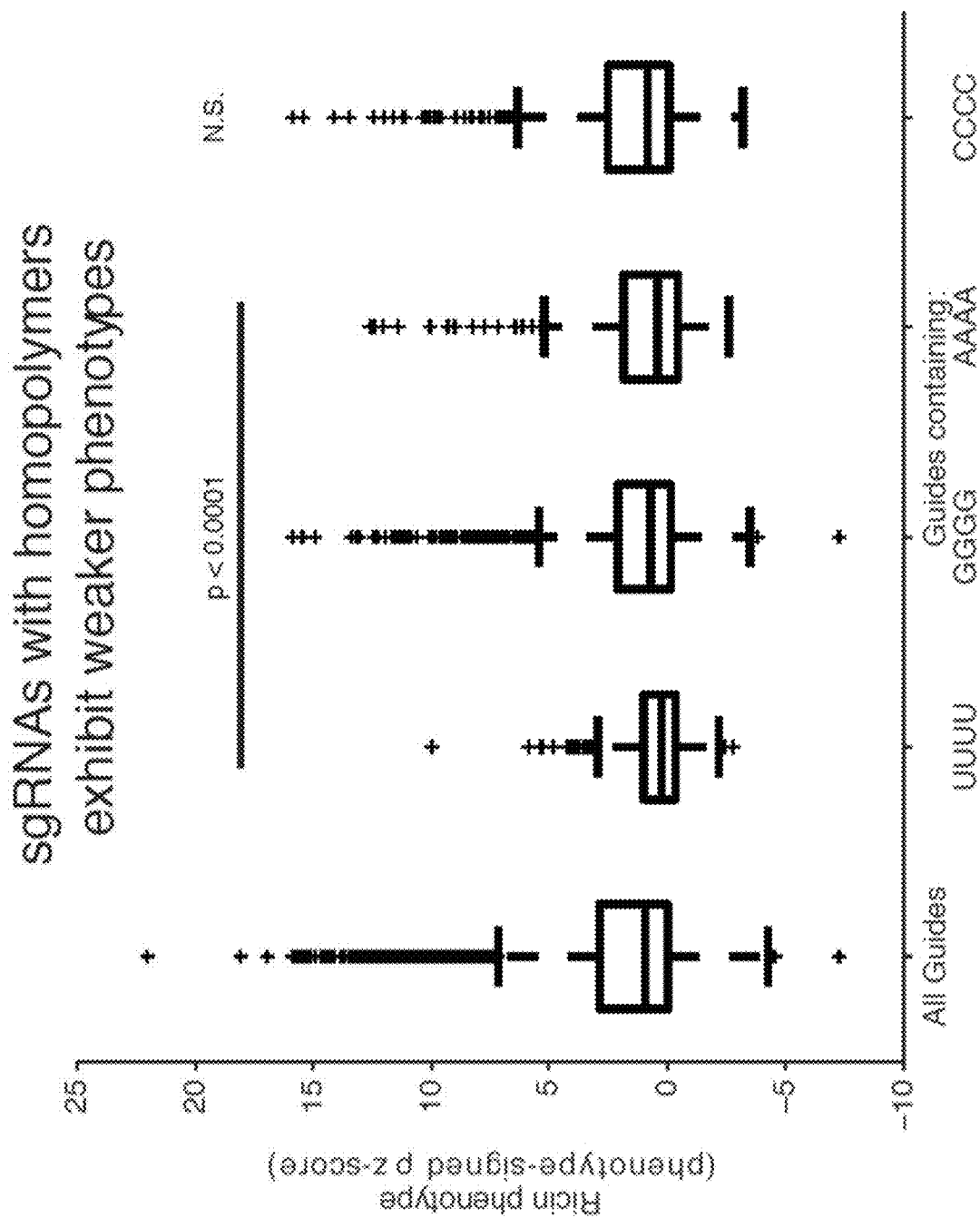

Strong CRISPRi activity was obtained by targeting dCas9-KRAB to a window of DNA from ~50 to +350 bp relative to the transcription start site of a gene, with a maximum in the ~50-100 bp region just downstream of the TSS (FIG. 1B, FIG. 1D). This suggested that optimal activity leverages the combined activity of dCas9 interference along with repression from the KRAB domain. It was also observed that sgRNAs with protospacer lengths of 18-21 base pairs were significantly more active than longer protospacer containing sgRNAs (FIG. 9B). Nucleotide homopolymers had a strongly negative effect on sgRNA activity (FIG. 9C). However, neither the DNA strand that was targeted nor the sgRNA GC content across a broad range strongly correlated with sgRNA activity (FIGS. 9D-9E).

Figure 1E:
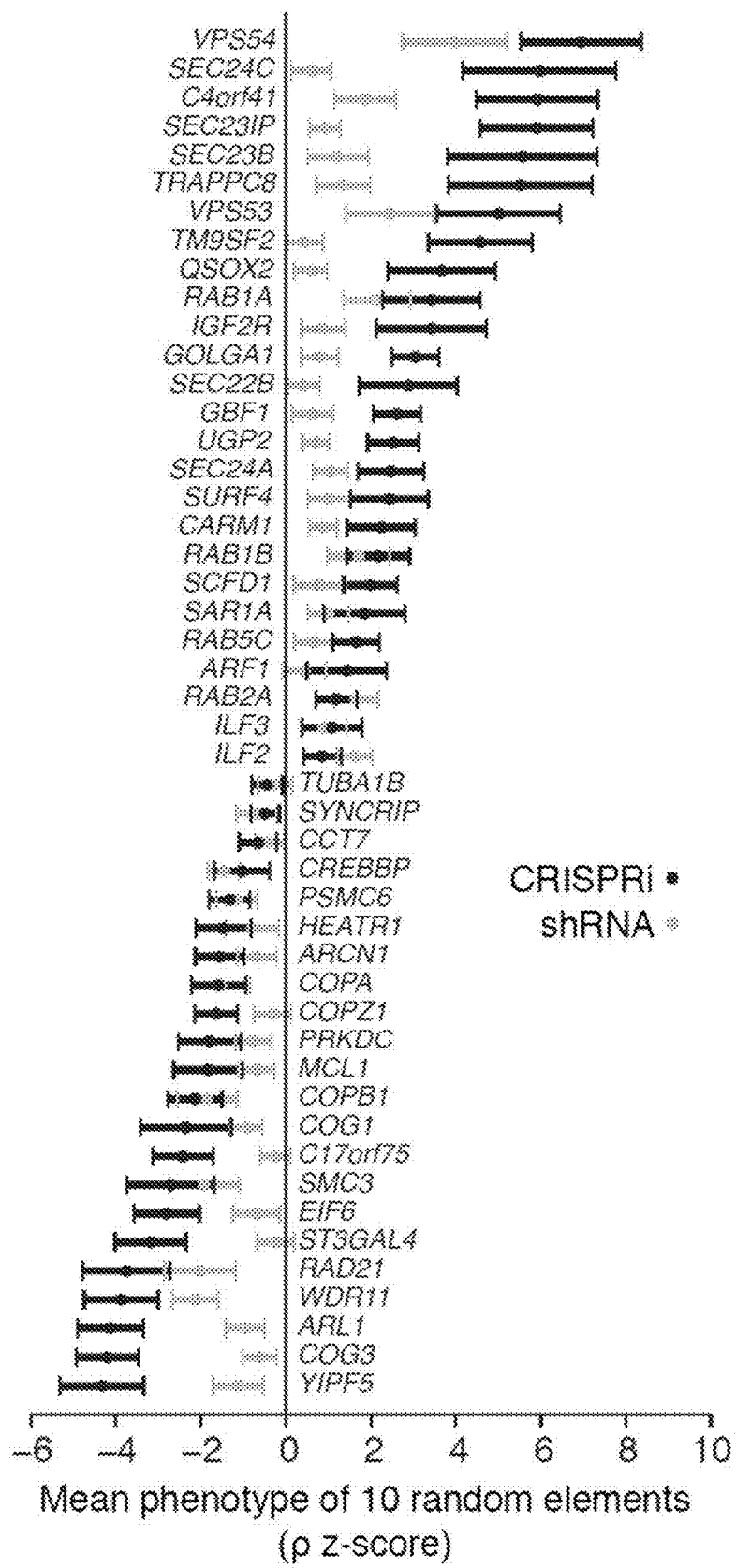
Figure 8C:
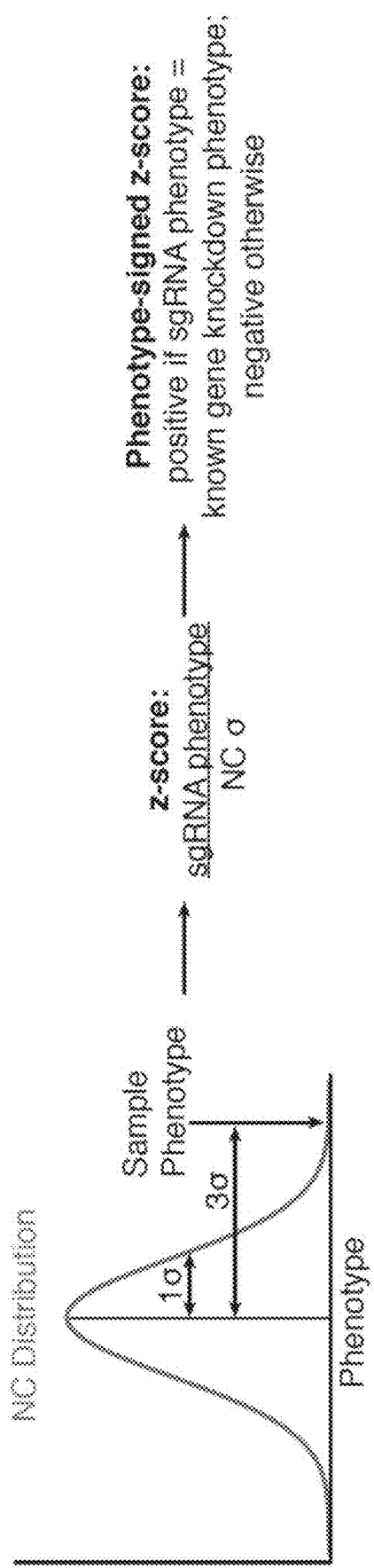
Figure 9F:
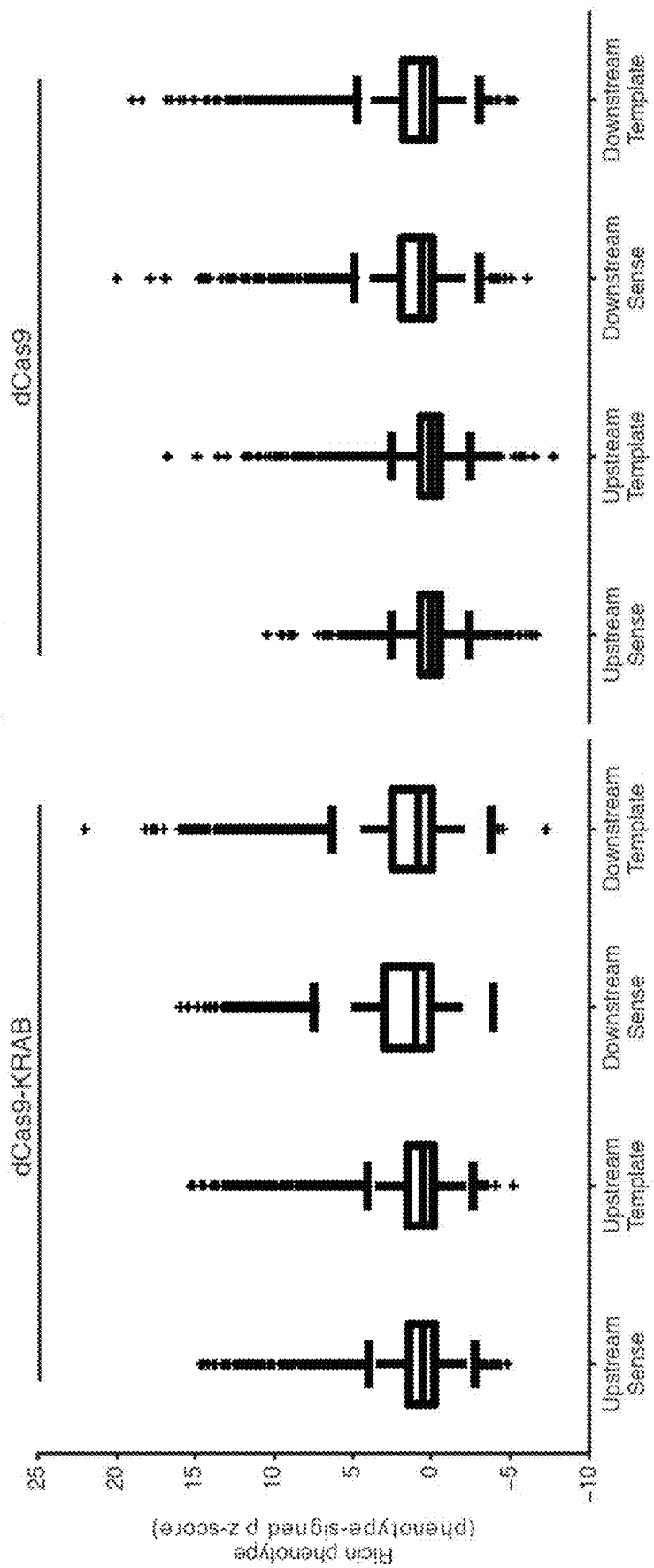
Figure 9G:
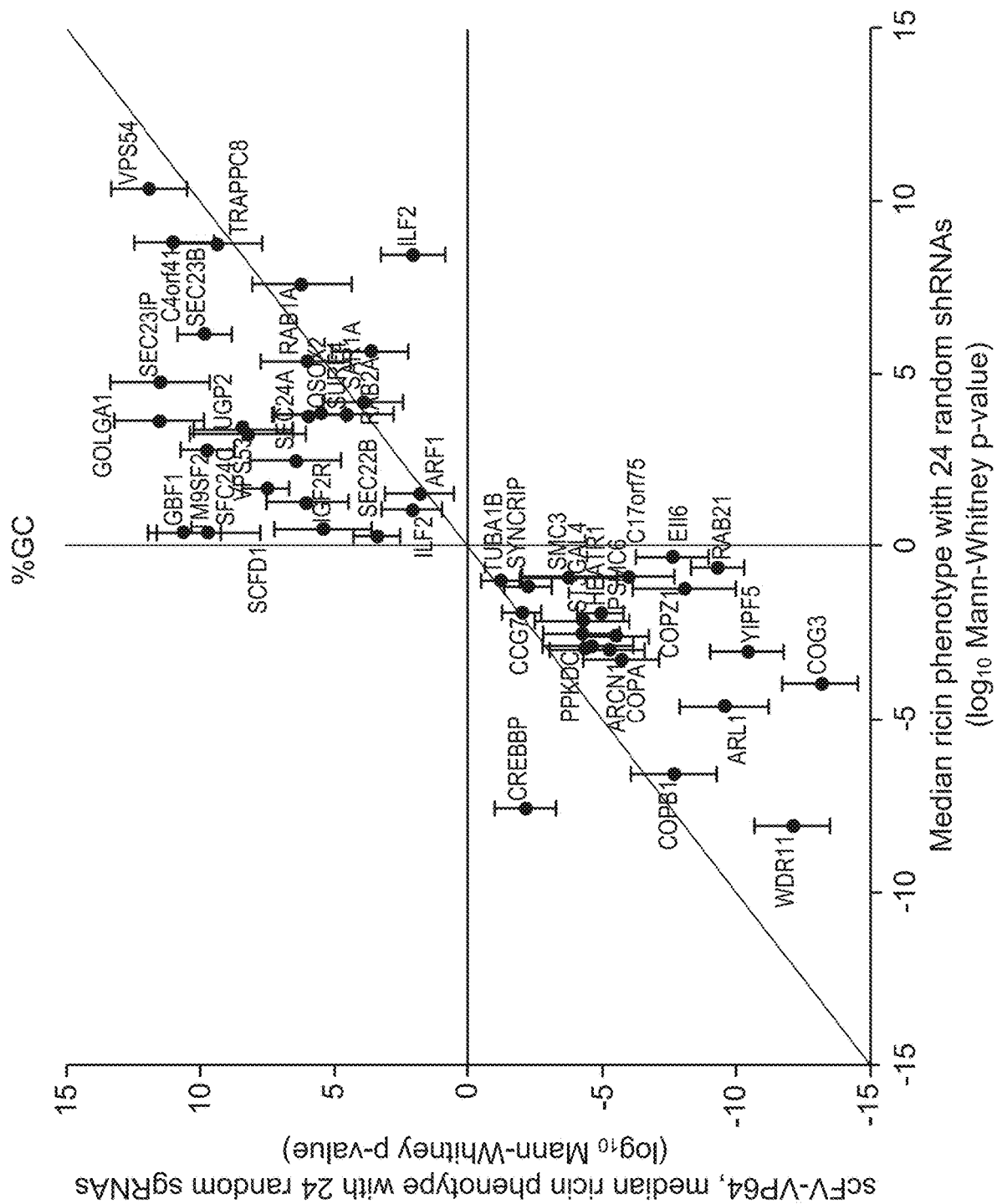

To evaluate the feasibility of genome-wide genetic screens based on CRISPRi, the strength of phenotypes obtained with CRISPRi was compared to a previously published RNAi library, applying the rules described above and then randomly subsampling the data from the sgRNA tiling library to pick sets of 10 sgRNAs. A normalized phenotype z-score was calculated by dividing mean phenotypes for each gene by the standard deviation of phenotypes of sgRNAs from the non-targeting control set (FIG. 8C). Significant ricin phenotypes were seen for each of the 49 genes. Moreover, in virtually every case the normalized ricin phenotype was stronger (in many cases far stronger) than seen with a comparably sized shRNA library (generated by sub sampling our published data). Thus CRISPRi significantly outperforms the published RNAi library (FIG. 1E and FIG. 9F). As discussed below this is due to combination of high efficacy as well as low off-target effects.

Figure 2:
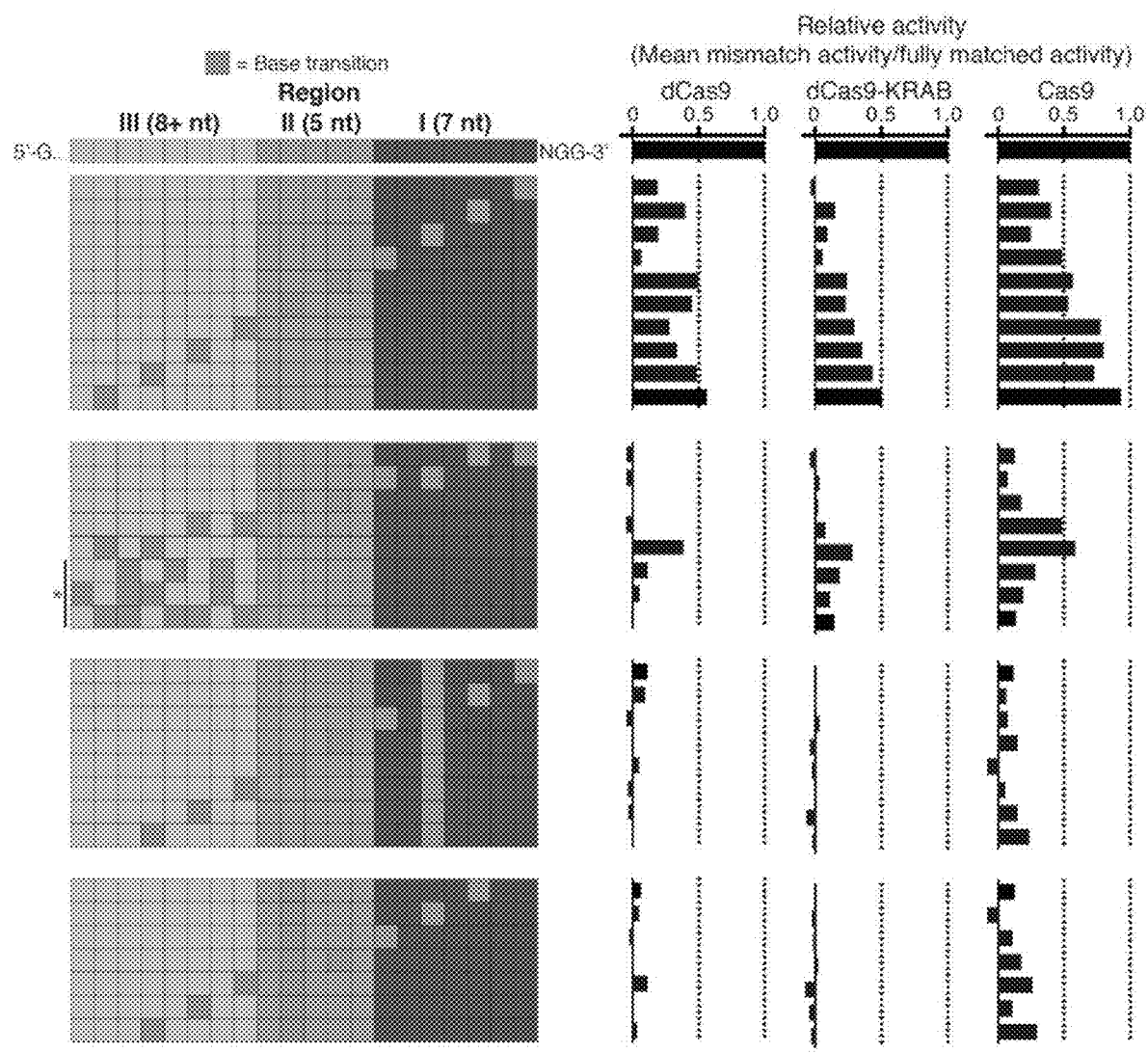
FIG. 2: CRISPRi Activity is Highly Sensitive to Mismatches Between the sgRNA and DNA sequence. The on- and off-target activity of dCas9, dCas9-KRAB and Cas9 was measured for a series of sgRNAs with a varying number and position of mismatches. The measured off-target activity of each sgRNA with one or more mismatch is displayed as percent of the on-target activity for the corresponding sgRNA with 0 mismatches. The sgRNA series denoted with a star represents sgRNAs with 3, 4, or 5 mismatch base pairs randomly distributed across region 3 of the sgRNA sequence. Data are displayed for each mismatch position as the mean of all sgRNAs with that mismatch; see FIG. 10 for individual sgRNA activities. sgRNAs were included in the analysis only if the fully matched guide was highly active (phenotype-signed z-score>=4); N=5 for dCas9, 11 for dCas9-KRAB, and 10 for Cas9.
Figure 10:
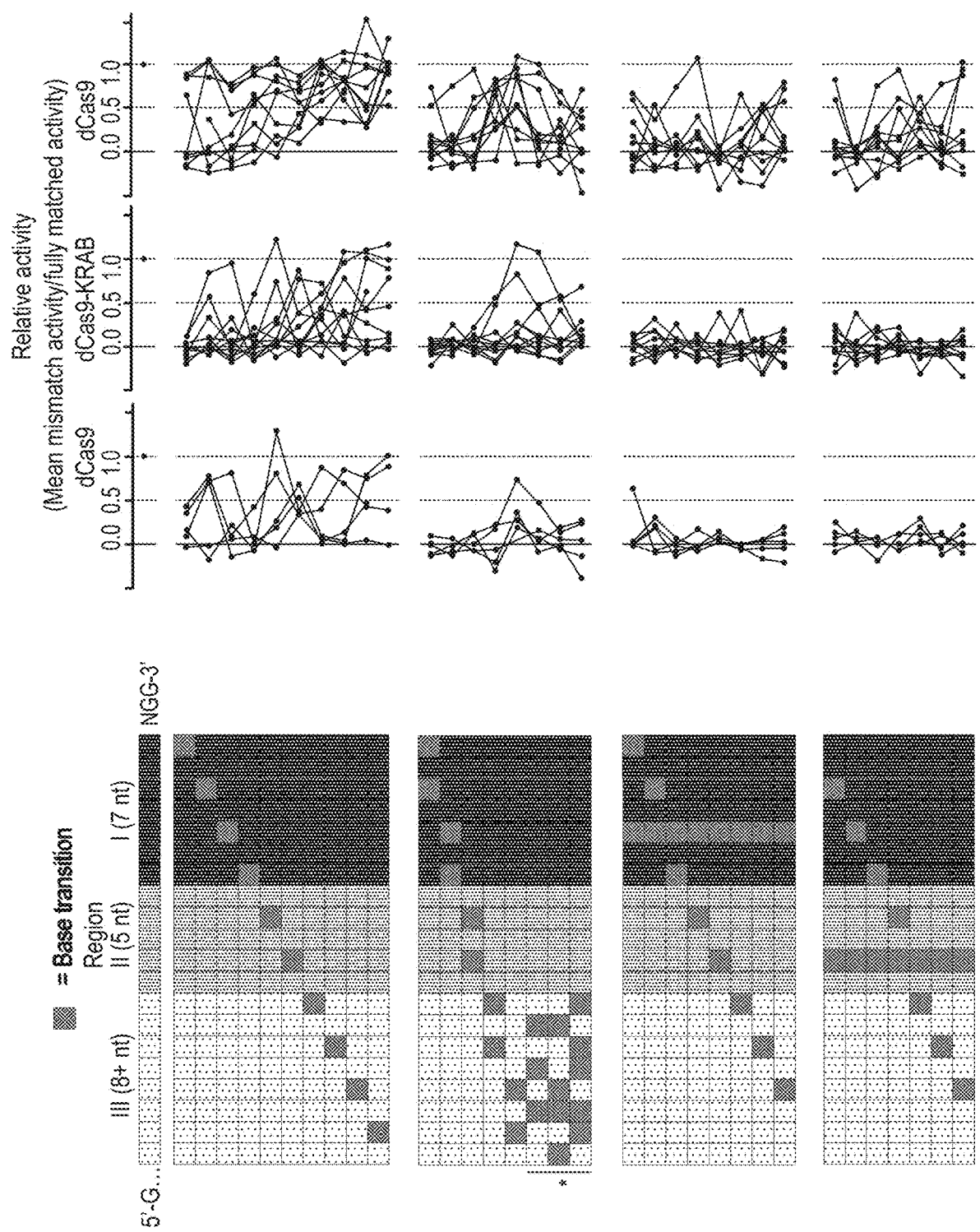
FIG. 10: CRISPRi Activity is Highly Sensitive to Mismatches Between the sgRNA and DNA sequence. The on- and off-target activity of dCas9, dCas9-KRAB and Cas9 was measured for a series of sgRNAs with a varying number and position of mismatches. Each sgRNA is a point with the related mismatch series connected by lines. The measured off-target activity of each sgRNA with one or more mismatch is displayed as percent of the on-target activity for the corresponding sgRNA with 0 mismatches. The sgRNA series denoted with a star represents sgRNAs with 3, 4, or 5 mismatch base pairs randomly distributed across region 3 of the sgRNA sequence. sgRNAs were included in the analysis only if the fully matched guide was highly active (phenotype-signed z-score>=4); N=5 for dCas9, 11 for dCas9-KRAB, and 10 for Cas9.

B. CRISPRi Transcriptional Silencing is Highly Sensitive to Mismatches Between Target DNA Site and the sgRNA To define rules for CRISPRi off-target activity at endogenous genes, a set of highly active sgRNAs from the test library was selected. For each of these sgRNAs, the activity of a series of derivative sgRNAs with a variable number and position of mismatches was tested (FIG. 2). This experiment allowed measurement of the amount of off-target gene repression for sgRNAs with mismatch base pairing relative to sgRNAs for which high on-target activity was established. Even a single mismatch at the 3' end of the protospacer decreased CRISPRi activity while sgRNAs that passed the bioinformatics off-target filter, showed very little activity (FIG. 2 and FIG. 10). The dCas9 and dCas9-KRAB proteins showed greater sensitivity to mismatches between the sgRNA and target DNA than observed with Cas9-mediated gene deletion. From this analysis, it was concluded that CRISPRi has minimal off-target transcriptional repression activity at sites with 3 or more mismatches, even if the sgRNA binding site is close to a transcription start site (FIG. 2).

C. A High Throughput-Tiling Screen Defines Rules for CRISPRa Activity at Endogenous Genes dCas9 fused to the herpes virus VP16 domain can activate transcription when targeted upstream of the transcription start site of a gene (Pubmed ID: 23849981). Initial CRISPRa experiments suggested that robust activation of transcription required multiple sgRNA binding sites in the promoter of a gene or multiple sgRNAs targeted to one promoter, which would limit the utility of CRISPRa for library-based screens (Pubmed IDs: 23849981, 23979020, 23892898, 23977949, 23892895, 23907171). However, an improved CRISPRa method, termed sunCas9, in which expression of a single sgRNA with one binding site is sufficient to robustly activate transcription. In the sunCas9 system, a single dCas9 fusion protein bound to DNA recruits multiple copies of the activating effector domain, thus amplifying our ability to induce transcription.

To define rules for CRISPRa, the tiling library targeting genes that modulate cellular sensitivity to ricin was used to define how and where CRISPRa activates transcription. It was previously shown for 5 out of the 49 genes in this tiling library that knockdown and plasmid overexpression resulted in the opposite ricin phenotypes. For example, knockdown of SEC23A sensitized cells to ricin, whereas SEC23A overexpression desensitized cells to ricin. This observation provided internal positive control genes for CRISPRa activity (Pubmed ID: 23394947).

Figure 3A:
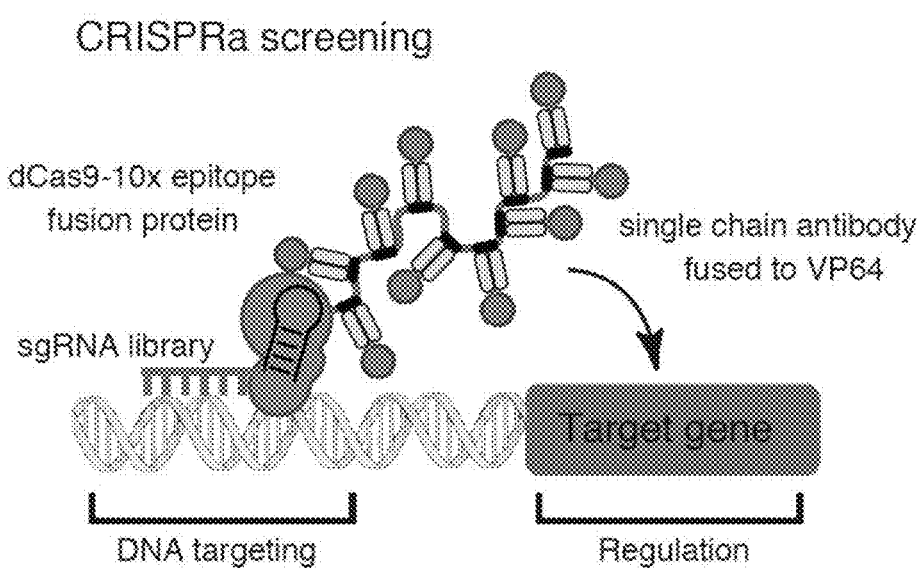
FIGS. 3A-3E: A Tiling sgRNA Screen Defines Rules for CRISPRa Activity at Endogenous Genes in Human Cells.
Figure 3B:
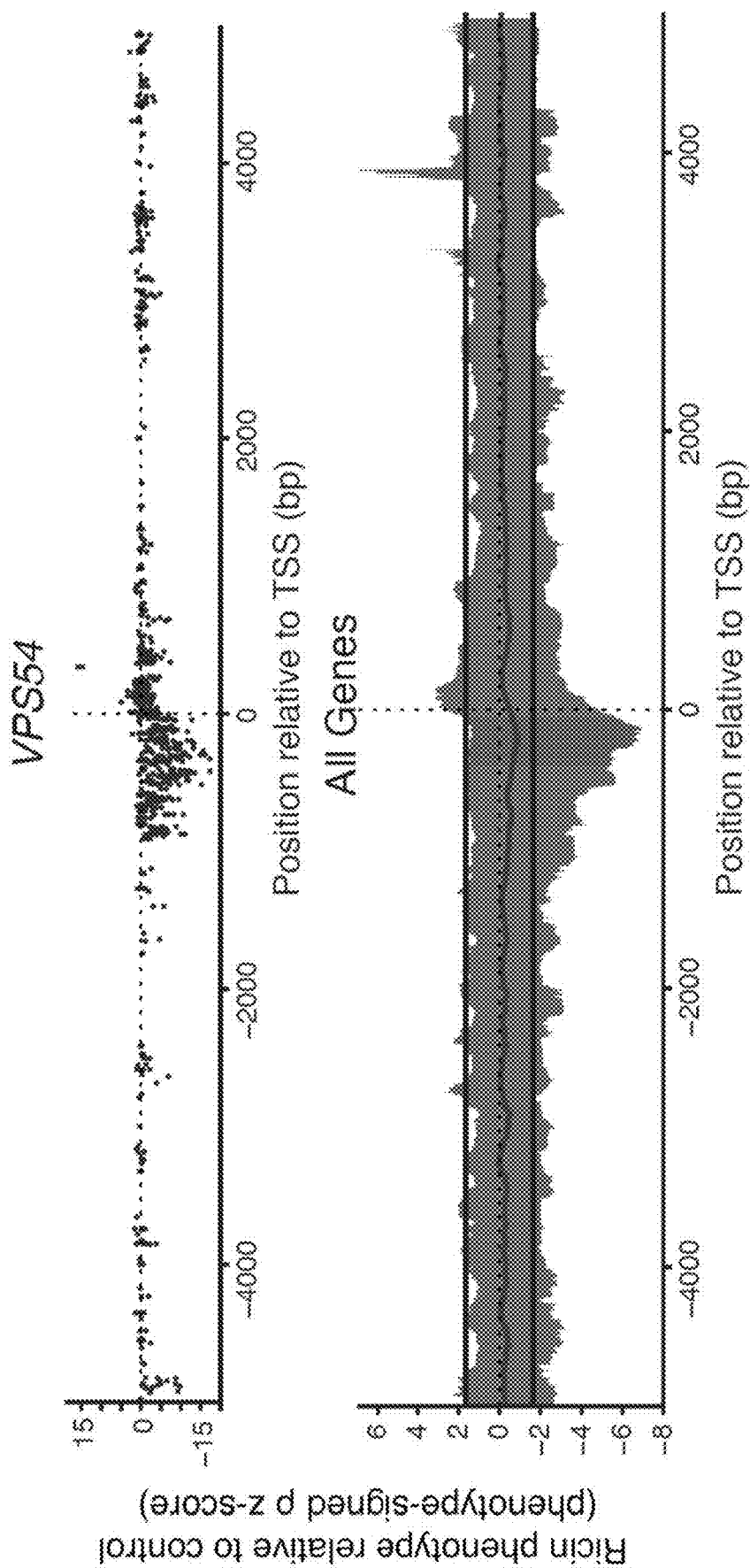
Figure 11A:
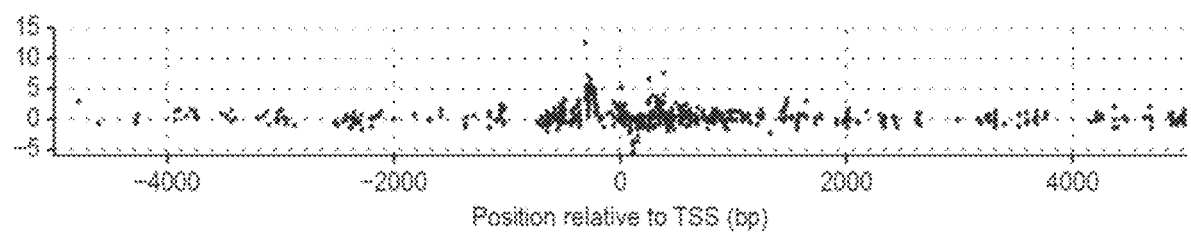
FIG. 11A-FIG. 11B: A Tiling sgRNA Screen Defines Rules for CRISPRa Activity at Endogenous Genes in Human Cells.
Figure 11A:
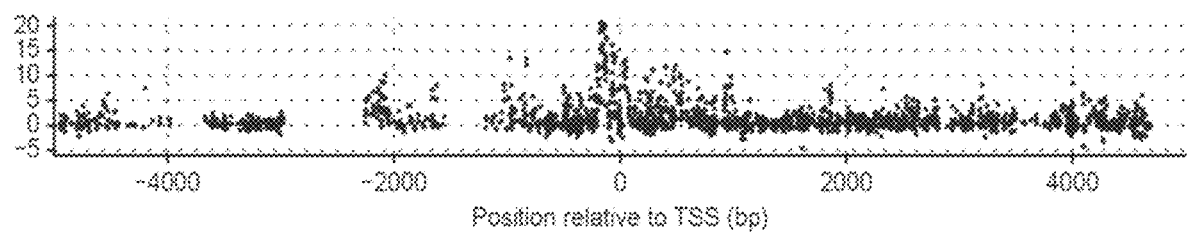
Figure 11A:
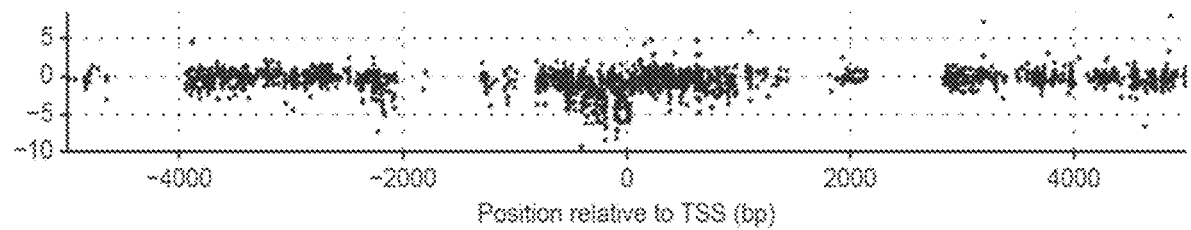
Figure 11A:
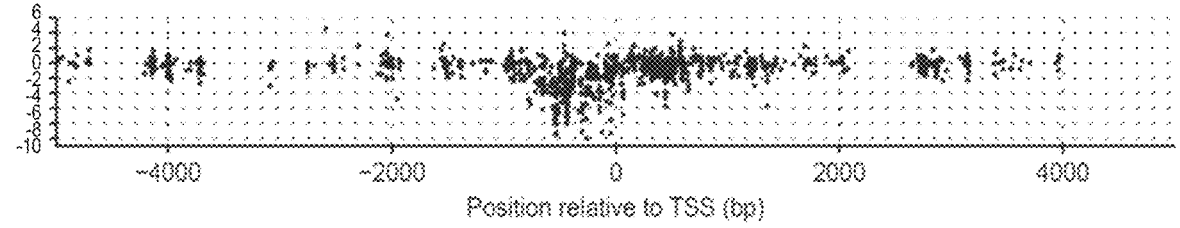
Figure 11B:
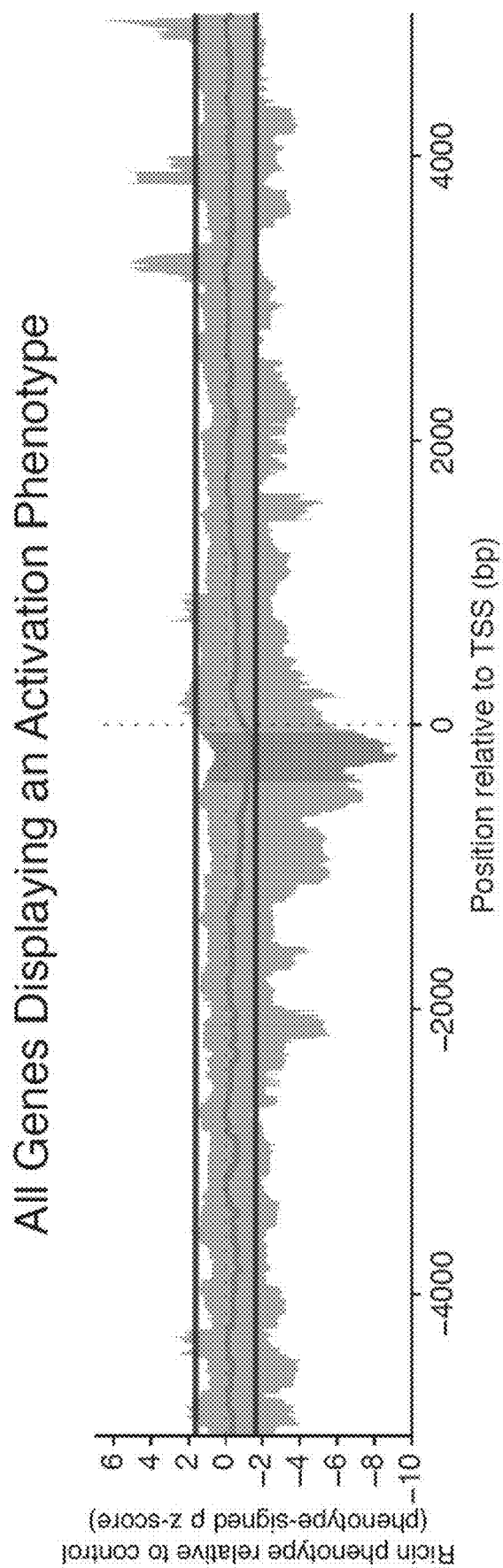
Figure 12A:
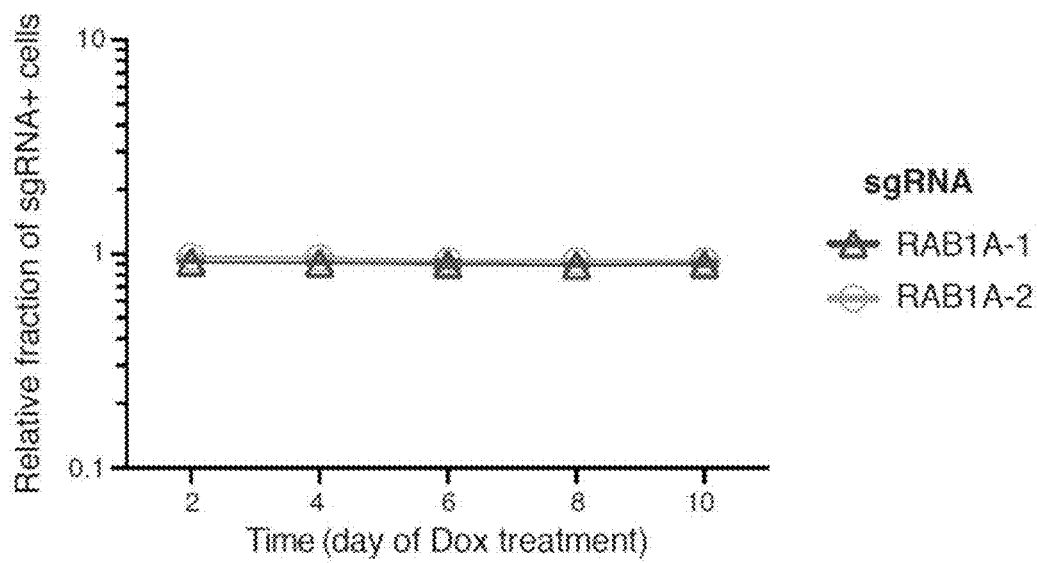
FIG. 12A-FIG. 12B: CRISPRi Can Inducibly and Rapidly Repress Transcription.
Figure 12B:
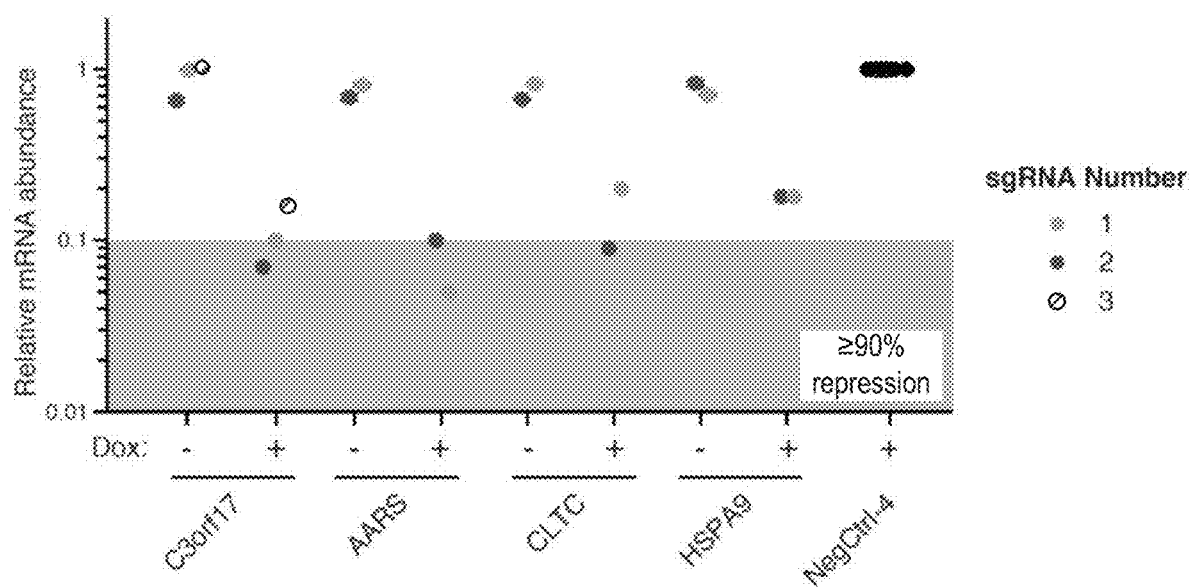

K562 cells were transduced to stably express the sunCas9 system (FIG. 3A) with the sgRNA tiling library and screened for ricin phenotypes as described for CRISPRi above. Analysis of data for individual genes or averaged data for all 49 genes demonstrated that many sgRNAs for each gene affected ricin resistance, suggesting many sgRNAs potently activate gene expression (FIG. 3B and FIG. 11A-FIG. 11B). Importantly, negative control sgRNAs showed very little activity and were not correlated between biological replicate screens, suggesting that CRISPRa activity is specific. A peak of active sgRNAs for CRISPRa was observed at −400 to −50 bp upstream from the transcription start site (FIG. 3B). This activity pattern fits with a model in which each VP16 domain can bind the mediator complex and recruit basal transcription machinery, which actives transcription when spaced appropriately from a transcription start site (Pubmed ID: 14657022). With this system genes that are poorly expressed can be turned on and the expression of well-expressed genes can be increased. In some cases, when a well-expressed gene is only modestly turned up, this increase in gene expression can robustly modulate cellular sensitivity to ricin. These CRISPRi/a tiling screens provided rules for how CRISPRi/a controls expression of endogenous genes. These tiling sgRNA libraries could be used as a tool for evaluating the activity and specificity of future dCas9 fusion proteins or further iterations of CRISPRi/a.

Figure 3C:
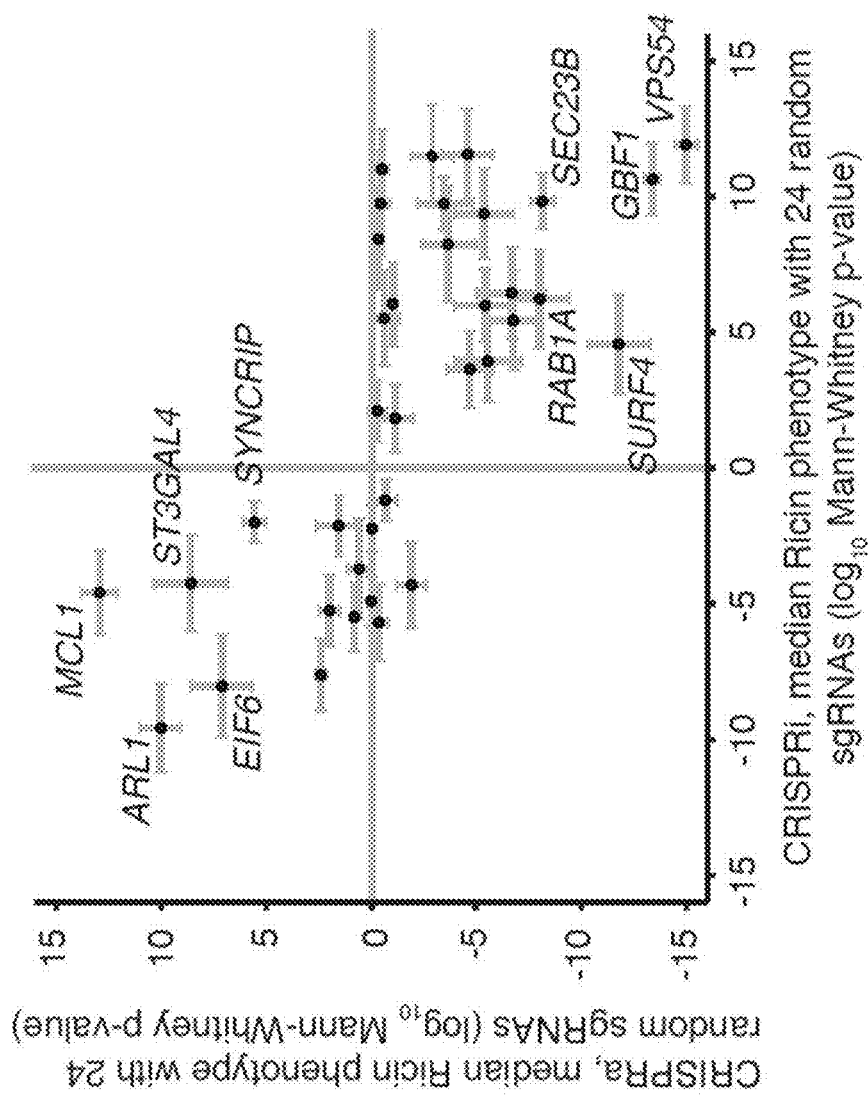

D. An Allelic CRISPRi/a Series of Transcript Activation and Repression Demonstrates Protein Abundance Dynamically Modulates the Cellular Response to Ricin For many genes, it is unknown how the relative abundance of the encoded protein relates to its function. A strong anti-correlation was observed in our ricin screens between CRISPRa phenotypes and CRISPRi or RNAi phenotypes for individual genes (FIG. 3C). This result suggests the abundance of many proteins can modulate both resistance and sensitivity to a toxin. As the genes targeted by the test library were selected based on a knockdown phenotype, all genes showed phenotypes in the CRISPRi screen, but only a subset showed phenotypes in the CRISPRa screenNo genes show the same phenotype when overexpressed as when repressed.

Figure 3D:
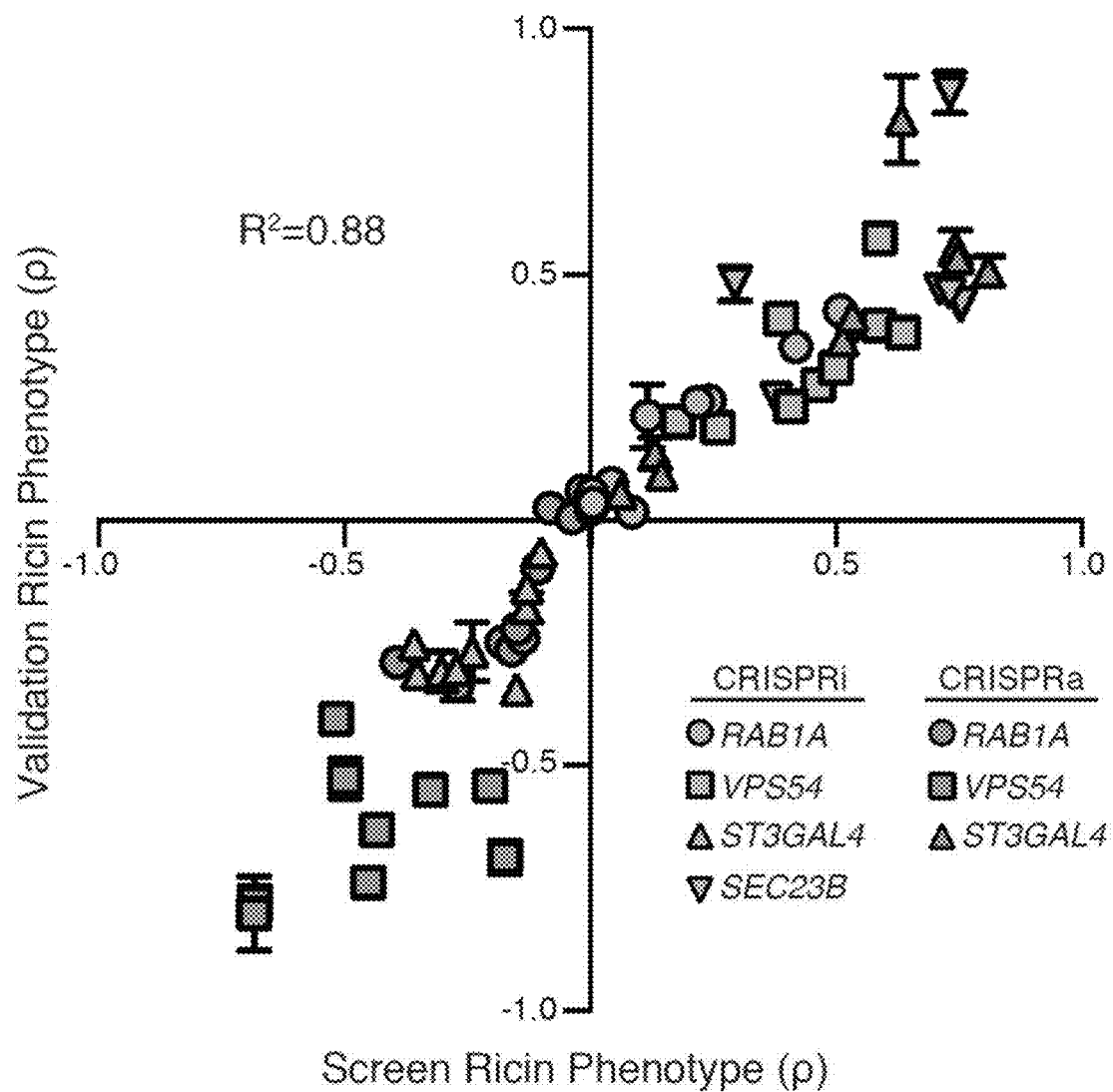
Figure 3E:
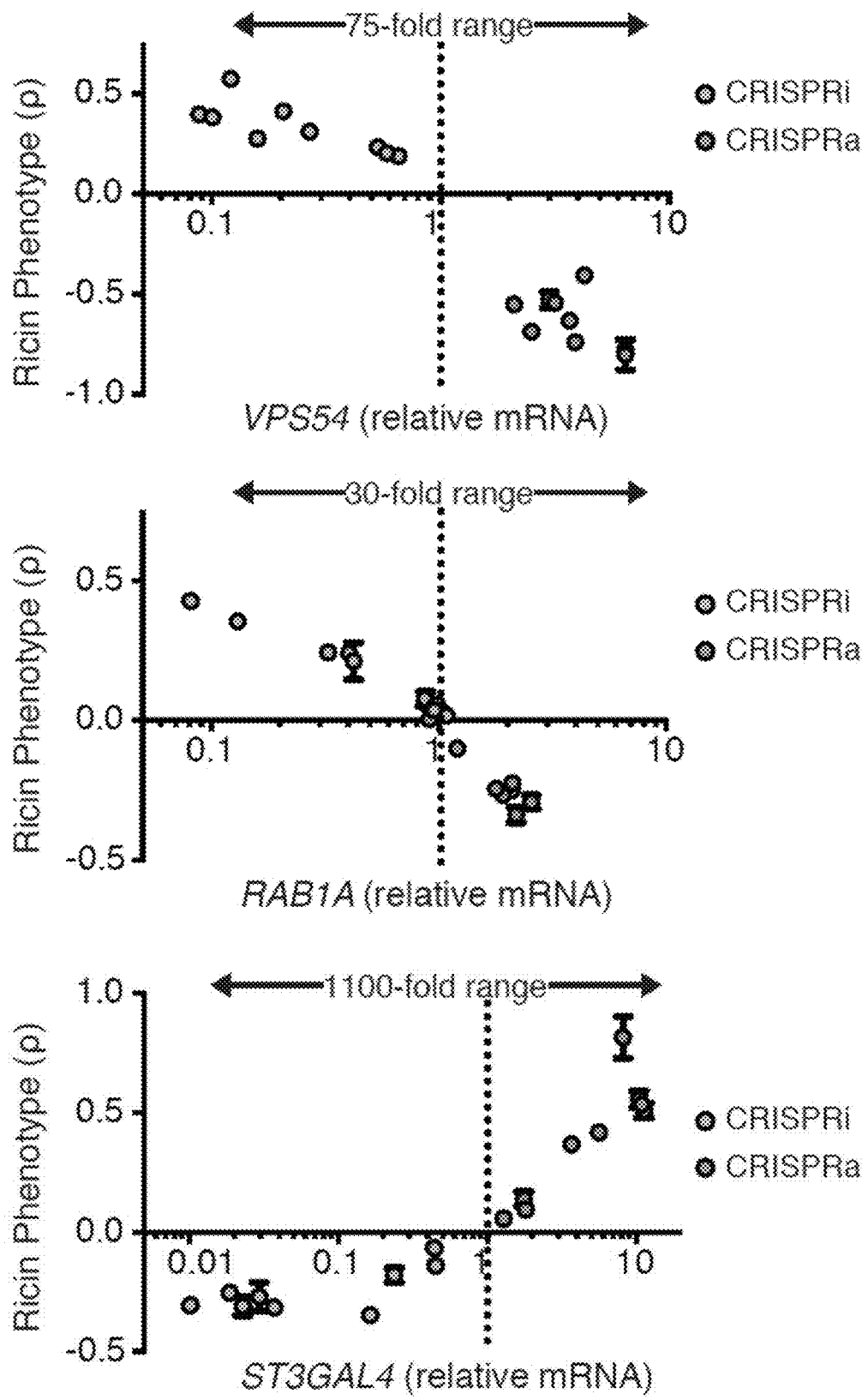

The results from both the CRISPRi and CRISPRa screens were validated as follows. An allelic series of sgRNAs were selected by phenotype from the screen and each sgRNA was individually re-tested. For each sgRNA, both the ricin phenotypes as well as the change in abundance of the targeted transcript were quantified (FIG. 3D-FIG. 3E). The results show that the CRISPRi/a screens produced reliable phenotype scores that were robustly reproduced in re-test experiments. CRISPRi/a can activate and repress the transcription of endogenous genes over a wide dynamic range (up to ~1000-fold) (FIG. 3E). Thus, CRISPRi/a can be used to produce an allelic series of overexpression and knockdown for endogenous genes, enabling systematic interrogation of how gene dosage controls cellular functions of interest (FIG. 3D-FIG. 3E).

E. A Robust and Highly Specific Genome-Scale CRISPRi Screening Platform

The results of the test CRISPRi screen demonstrated the ability to pick active sgRNAs with low off-target activity and provided a set of rules enabling the design of a robust genome-scale sgRNA library. A library size of 10 sgRNAs/gene was chosen for the following reasons. Over half of the sgRNA conforming to these rules gave clear ricin phenotypes suggesting that, for a library with 10 sgRNAs per gene, 94% of the genes would have 2 or more highly active sgRNAs. Additionally, qPCR validation of the CRISPRi allelic series for ST3GAL4 demonstrated that 40% of sgRNAs picked by our activity algorithm showed at least a 10-fold reduction in target gene expression. Finally, computational sub-sampling of the phenotypic data from the tiling library sgRNA data to 10 sgRNAs per gene and calculation of p values for hit genes indicated that a library with 10 sgRNAs per gene would reliably detect hit genes.

A genome-scale CRISPRi sgRNA library targeting 15,997, human protein-coding genes (10 sgRNAs per TSS, targeting 19,000 TSS) with 11,000 non-targeting control sgRNAs for a total of 211,894sgRNAs was synthesized and cloned. Library sgRNAs were designed as protospacers of 18-21 base pairs targeting the transcription start site (or sites) of each gene in a −50 to +350 base pair window with spacing rules to prevent overlapping sgRNA sequences and excluding sgRNAs with predicted off-target activity as defined by the mismatch sgRNA series analysis.

The library was evaluated by first screening for genes essential for cell growth in K562s cells. Briefly, the genome-scale CRISPRi library was transduced (using lentivirus) into K562 cells stably expressing dCas9-KRAB. The entire genome-scale library was then screened by growing cells for 10 days at a minimum library coverage of 3,750-fold in a single spinner flask. Two biological replicate screens were conducted to estimate variation.

Figure 4A:
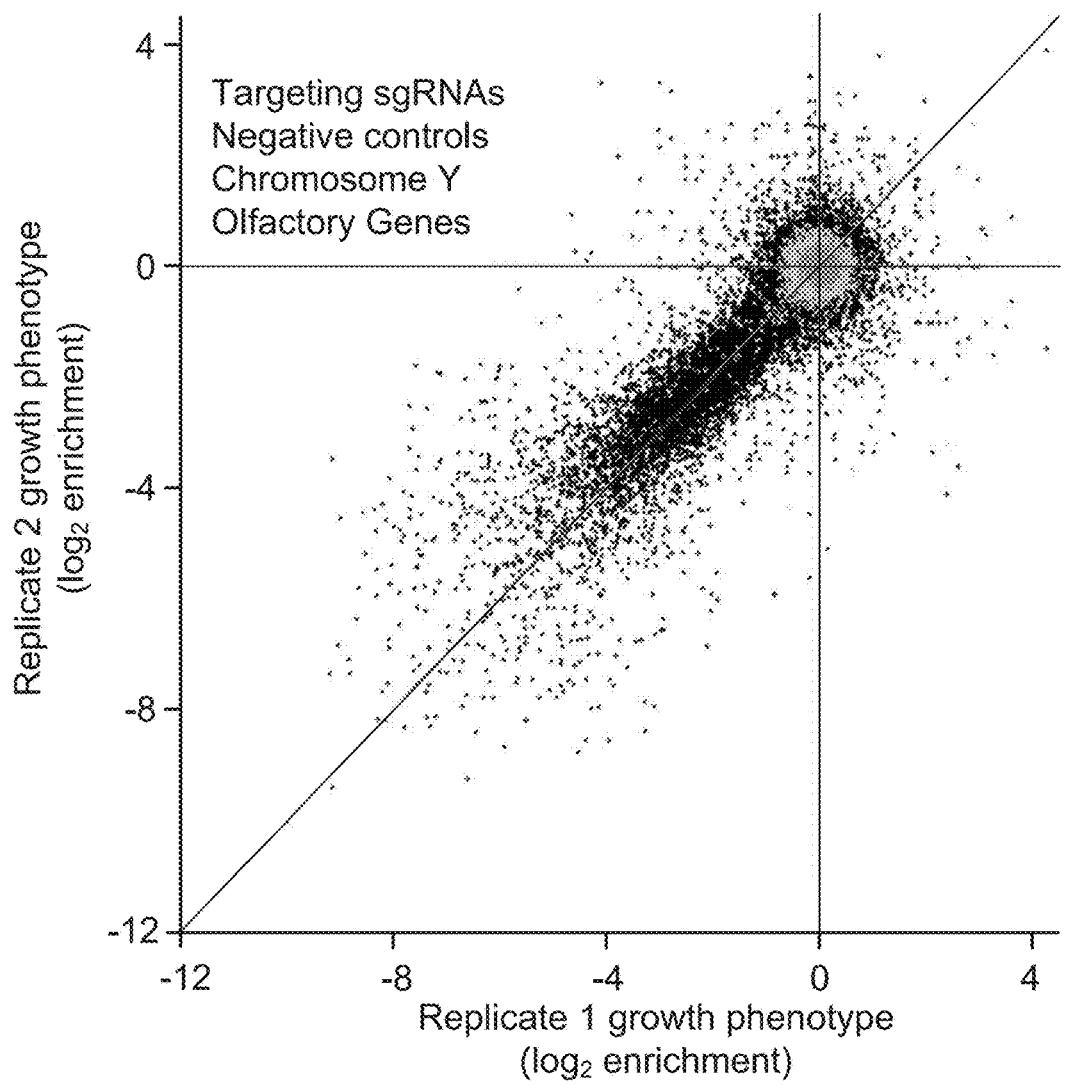
FIGS. 4A-4D: A Genome-Scale CRISPRi Screen Reveals Genes Required for Cell Growth in Human Cells.

To characterize the screening methodology and library design, the correlation between screen replicates and the negative control distributions was examined. The sgRNA phenotypes observed in each biological replicate were strikingly well correlated indicating the screen is highly reproducible (FIG. 4A). Individual sgRNAs showed dramatic depletion (up to 256-fold) over a 10-day screen, demonstrating individual sgRNAs can have profound effects on cell growth. The distribution of negative-control sgRNAs was very narrow with little correlation between replicates, suggesting the off-target activity of these controls is very low (FIG. 4A). While 99.7% of the negative controls were essentially inactive, a very small number of sgRNAs showed significant activity that was correlated between replicate screens.

Figure 4B:
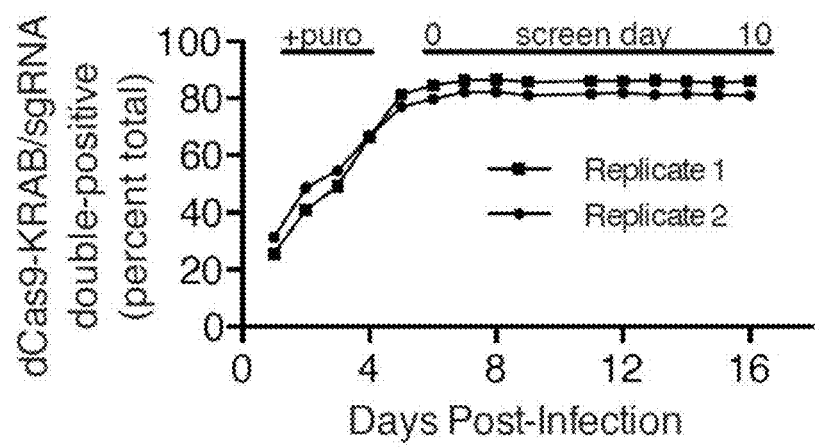

To further explore the prevalence of off-target effects, two classes of genes that should not show any on-target activity in the screen were examined: olfactory receptors and genes on the Y chromosome. The sgRNAs targeting these genes were designed and picked in the same manner as the rest of library; however, olfactory receptors should not be expressed in this cell type and, as K562 cells are female, sgRNAs targeting genes on the Y chromosome have no DNA target. Both negative control gene sets showed on average no phenotype and very little correlation between replicates, suggesting that the few observed phenotypes are due to stochastic noise (FIG. 4A). Additionally, no evidence of non-specific toxicity due to expression of dCas9-KRAB or the sgRNA library was observed in K562s, suggesting that dCas9 bound to the genome is not toxic under these conditions (FIG. 4B). These data suggest that CRISPRi is highly specific and non-toxic.

F. Defining Essential Genes, Complexes and Pathways in Human Cells by CRISPRi

Figure 4C:
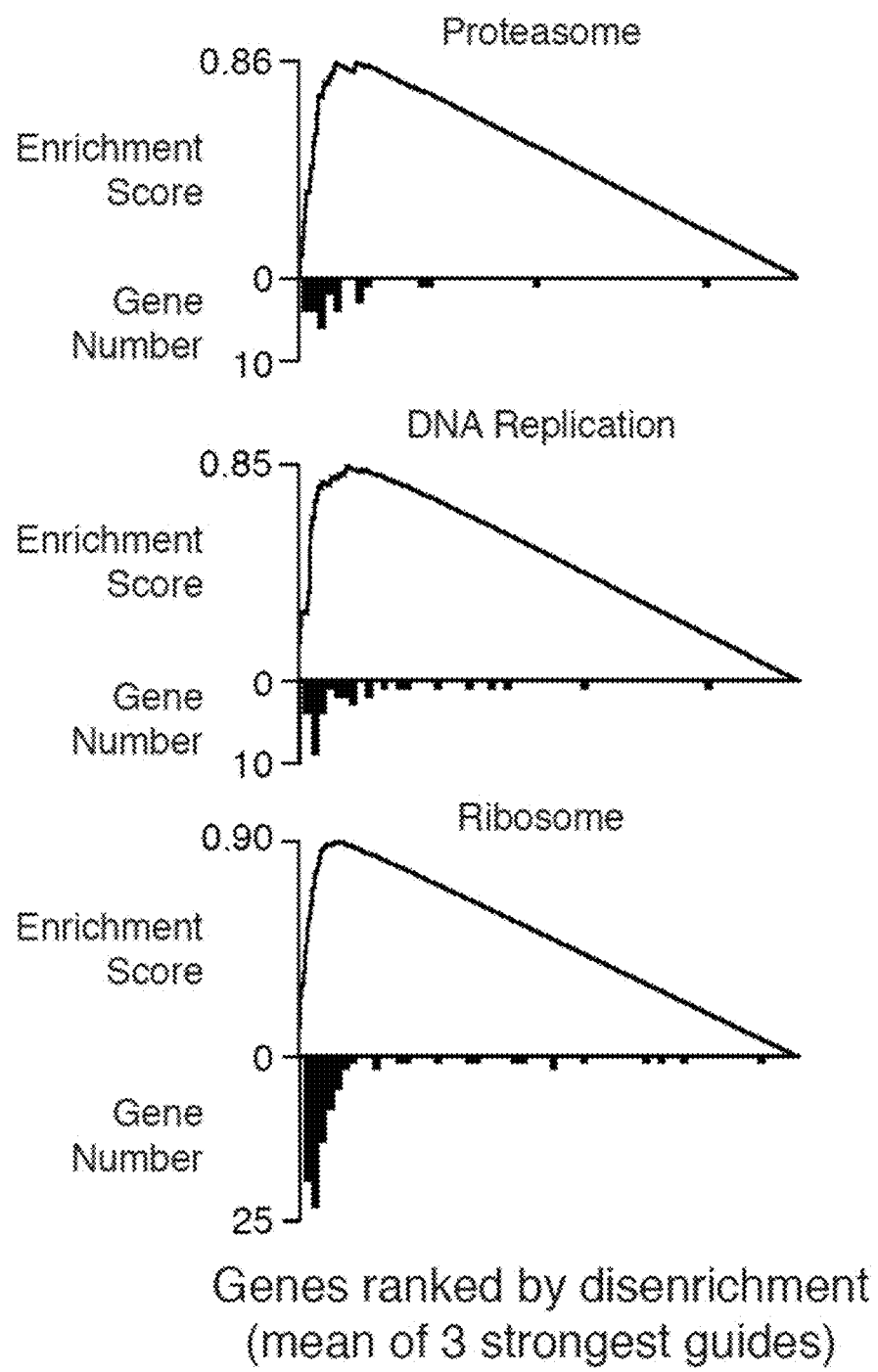
Figure 4D:
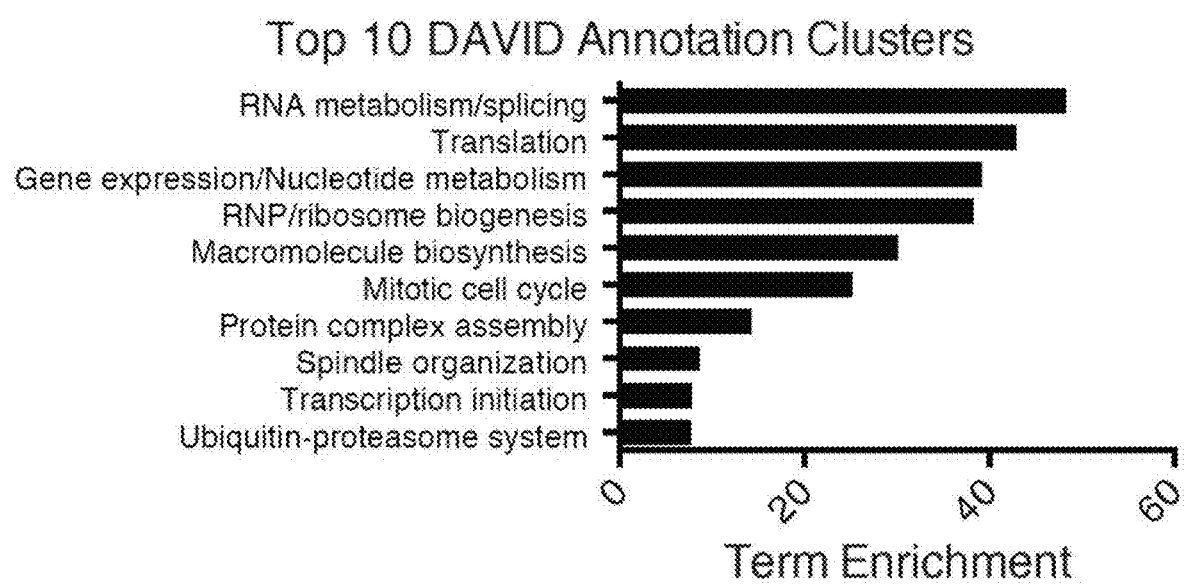

To identify hit genes in this screen, a metric of average growth phenotype ($\gamma$) for the top three sgRNAs for each gene was used (see methods). Using this metric, many genes involved in essential cellular processes were observed to strongly deplete. The top functional categories of depleted genes were transcription, splicing, and translation machinery, and biosynthetic and metabolic pathways (FIG. 4C). sgRNAs targeting components of the ribosome, the proteasome, and DNA replication machinery were strongly depleted (FIG. 4D). These data validate the sgRNA activity algorithm and demonstrate that CRISPRi can be used as a loss of function screening method.

G. Dynamically Controlling Gene Expression with CRISPRi

Figure 5A:
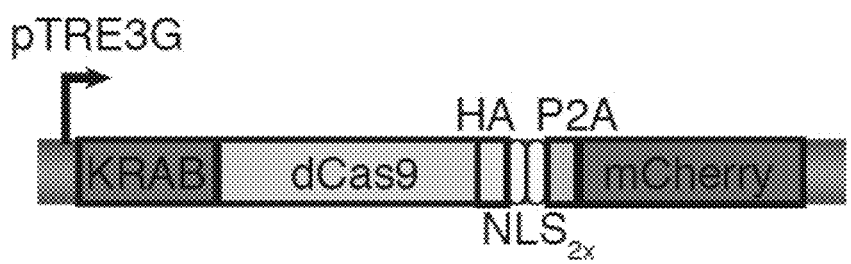
Figure 5B:
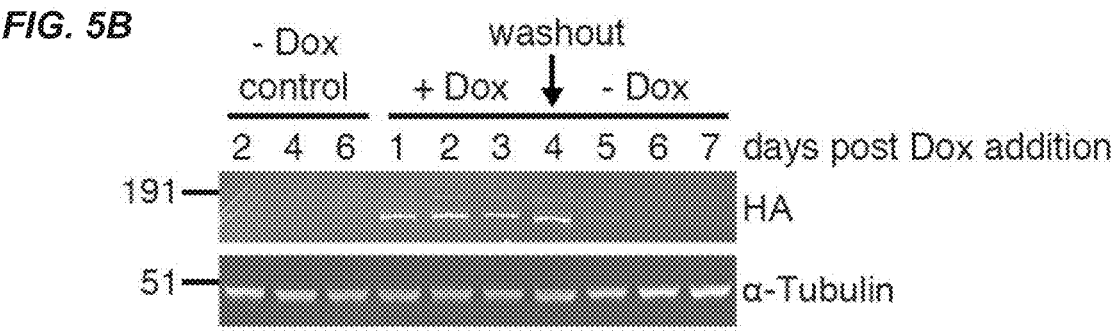
Figure 5C:
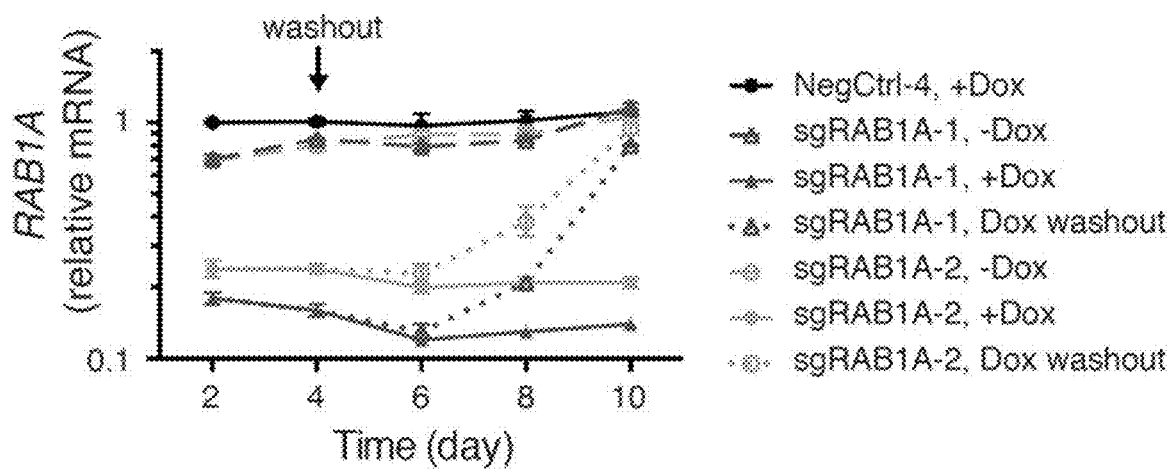

The ability to reversibly tune the expression of select transcripts is a powerful tool for evaluating transcript function, especially in the context of animal models used to study normal development and disease. To evaluate the applicability of CRISPRi to this purpose, a lentiviral expression construct was cloned that places an optimized KRAB-dCas9 fusion protein under the control of a doxycycline-inducible promoter. The ability of this expression construct to dynamically control gene expression in human cells was tested (FIG. 5A). Expression of KRAB-dCas9 from this construct was strongly activated in the presence of doxycycline (FIG. 5B), and in cells transduced with either of two sgRNAs targeting RAB1A (validated in this study), this induction of KRAB-dCas9 robustly depleted RAB1A mRNA (FIG. 5C). The induced repression was reversible following withdrawal of doxycycline from the cell culture media, demonstrating that KRAB-dCas9 does not create a permanently repressive chromatin state at targeted promoters.

Figure 5D:
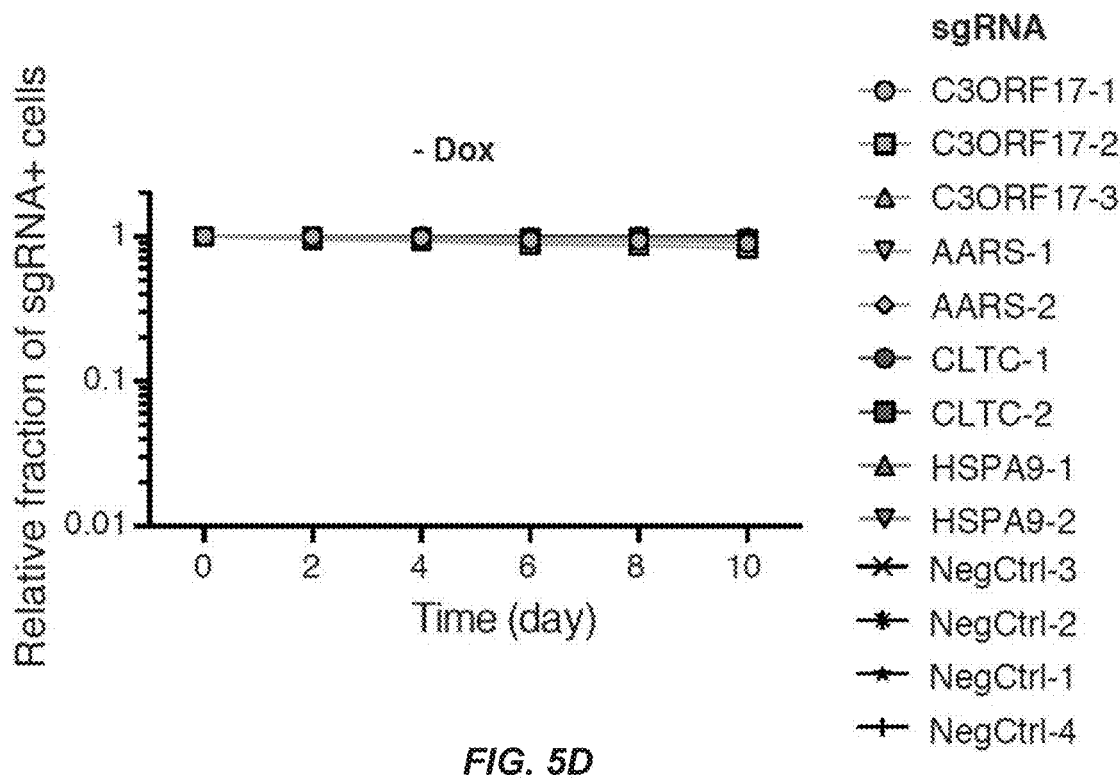

To evaluate dynamic control of CRISPRi-mediated phenotypes, the inducibilty of growth defects caused by repression of several genes identified in the genome-scale CRISPRi growth screen was evaluated. These genes included C3orf17, which has no described function. For each gene, 2 or 3 sgRNAs were selected and the effects on growth from each were quantified with and without KRAB-Cas9 induction (FIG. 5D). Cells expressing these sgRNAs showed almost no growth phenotype in the absence of doxycycline but rapidly and robustly depleted from the population following addition of doxycycline (FIG. 5D). In the strongest cases, over 95% of sgRNA-expressing cells with induced KRAB-dCas9 were depleted in 10 days (sgAARS-1 and sgHSPA9-1).

Figure 5E:
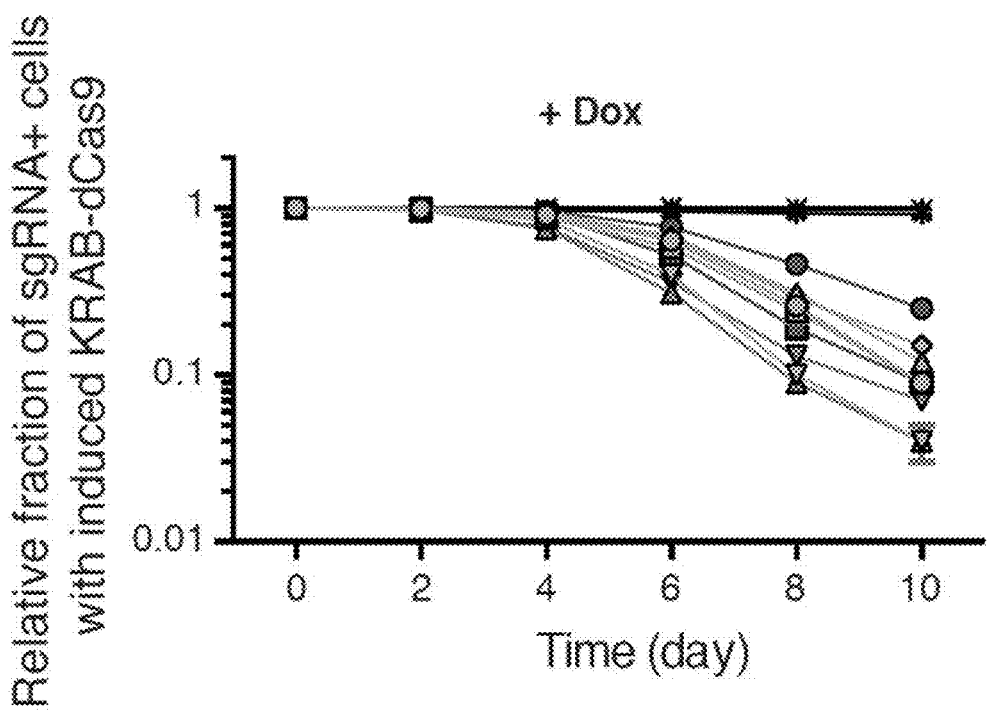
Figure 5H:
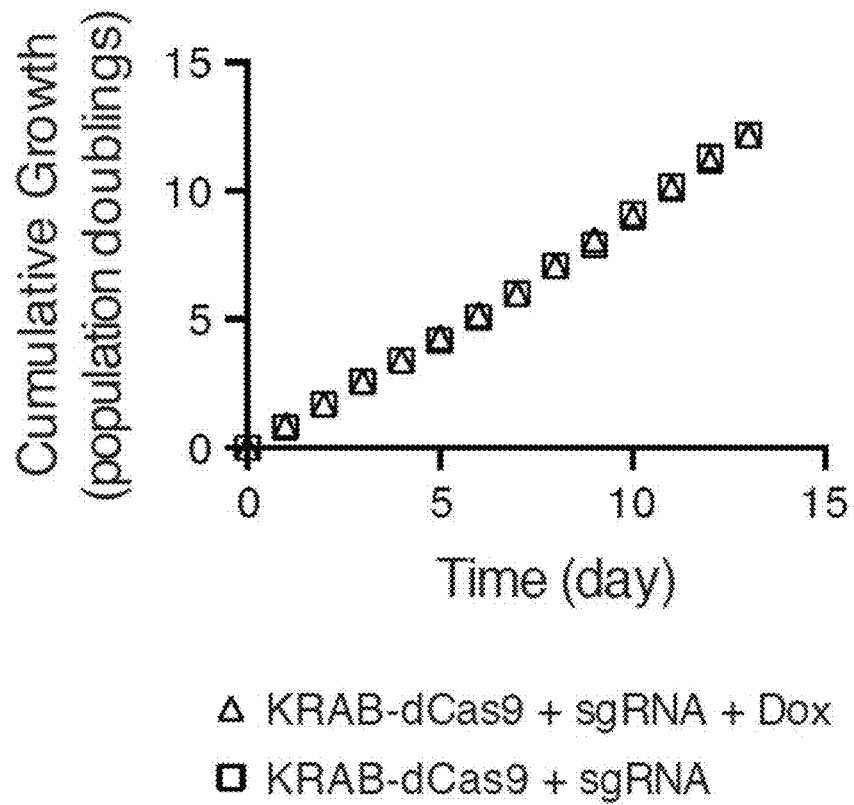

To test dynamic control of gene expression of essential genes on a larger scale, a sub-library targeting 426 manually curated genes (10 sgRNAs/TSS or 5,773 total sgRNAs, with 750 non-targeting controls) was cloned. These were identified in the genome-scale growth screen or were predicted to be required for cell growth by published data sets (Pubmed ID: 23394947). The sgRNAs present in this library were selected independently of the genome-scale CRISPRi library but were designed using the same sgRNA activity algorithm. This library was transduced into K562 cells stably expressing our inducible KRAB-dCas9 fusion protein and evaluated for cell growth effects in the presence and absence of doxycycline. Consistent with the individual results, only 4 sgRNAs depleted strongly in the absence of doxycycline; however, with induction of KRAB-dCas9, many sgRNAs strongly depleted (FIG. 5E). Negative control sgRNAs produced a narrow distribution of phenotypes that was uncorrelated between biological replicates with or without doxycycline (FIG. 5D). Additionally, no evidence that targeted KRAB-dCas9 generally decreases cell growth was found (FIG. 5F). Taken together, these results demonstrate CRISPRi is non-toxic, inducible and reversible.

Figure 6A:
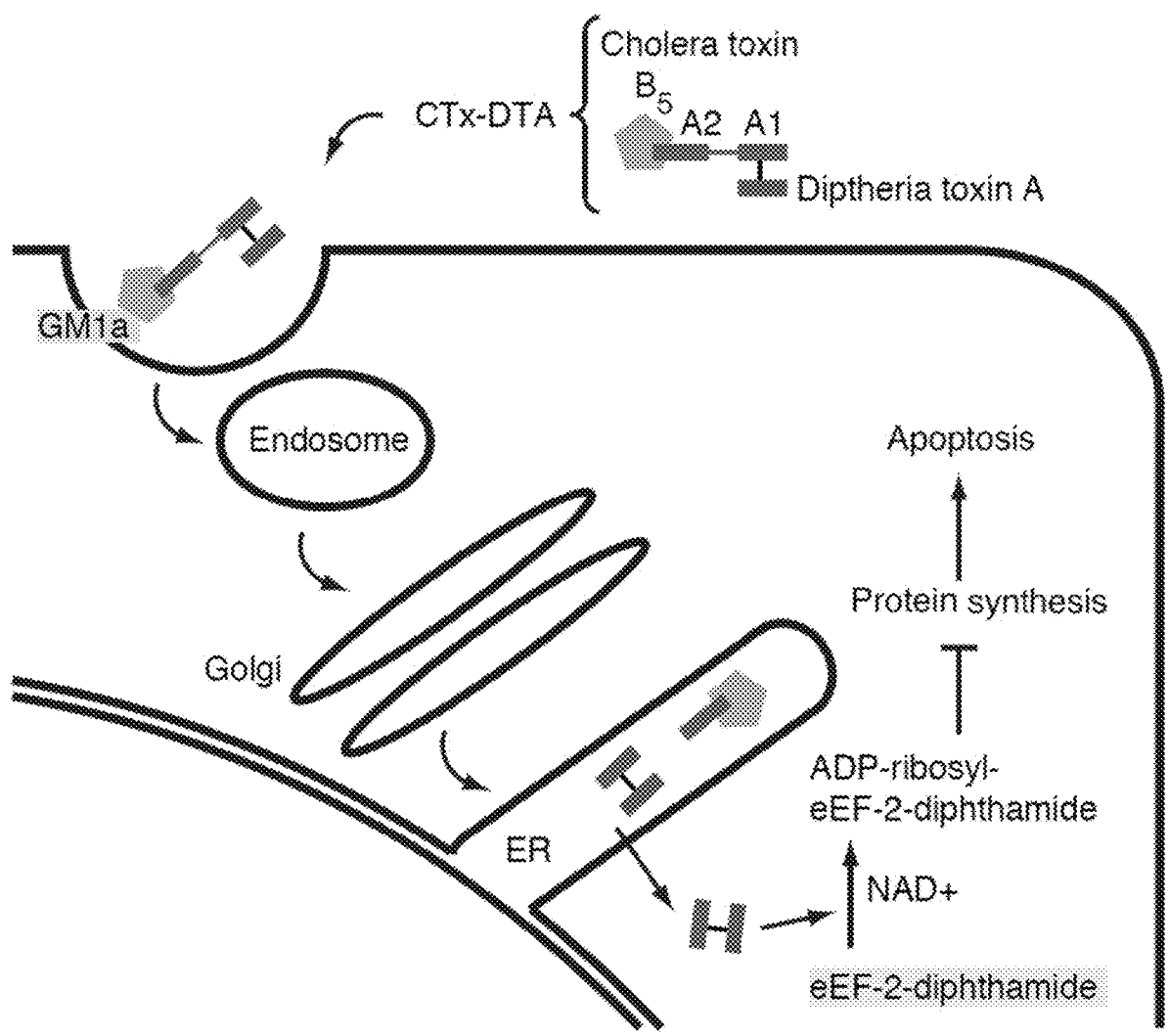
FIG. 6A-FIG. 6C: A Genome-Scale CRISPRi Screen Reveals Known and New Pathways and Complexes Governing the Response to a Choler-Diptheria Fusion Toxin.

H. A Genome-Scale CRISPRi Screen Reveals Pathways and Complexes that Govern Response to Cholera and Diptheria Toxin To test the performance of the CRISPRi approach for the detection of genes controlling a more complex cellular phenotype, a genome-scale CRISPRi screen was performed for genes that modulate sensitivity to a chimeric toxin composed of the diphtheria toxin catalytic A subunit covalently linked to cholera toxin (CTx-DTA, FIG. 6A). The mechanism of cellular entry and toxicity of both cholera toxin and diphtheria toxin are partially characterized. Furthermore, genes controlling CTx-DTA sensitivity have previously been identified using a haploid mutagenesis approach (Pubmed ID: 22123862). The B subunit of cholera toxin binds to GM1 gangliosides on the cell surface and this interaction is required for toxin internalization (FIG. 6A) (Pubmed ID: 22919642, 22069586, 7000782). After endocytosis, the B subunit mediates retrograde trafficking via the Golgi to the endoplasmic reticulum (ER), where a disulfide bond between the cholera toxin A1 and A2 moieties is reduced. The ER-associated degradation (ERAD) machinery is thought to mediate retro-translocation of the A1 subunit and the fused diphtheria toxin A subunit to the cytosol. Once the chimeric toxin is localized to the cytoplasm, the diphtheria catalytic subunit ADP-ribosylates the diphthamide residue in Elongation Factor 2, halting translation and killing the cell (FIG. 6A).

Figure 13A:
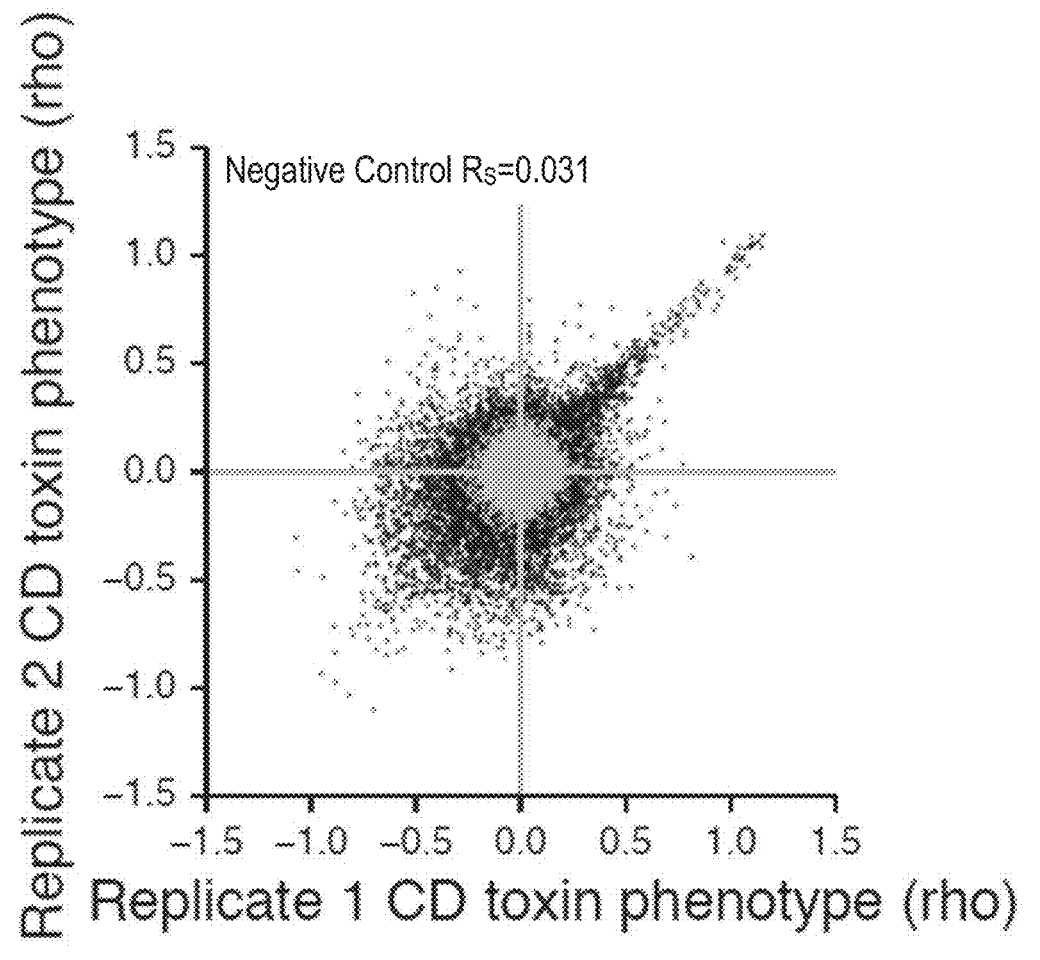

K562 cells stably expressing dCas9-KRAB were transduced with a genome-scale CRISPRi library. Cells expressing this library of sgRNAs were either grown under standard conditions or treated with several pulses of CTx-DTA over the course of 10 days. This screen was carried out in two biological replicates (FIG. 13A). Strong highly correlated enrichment and depletion of many sgRNAs was observed, indicating that CRISPRi can identify genes that modulate both resistance and sensitivity to a selective pressure. These results demonstrate that the screening approach yields reproducible results in screens in which a strong selective pressure is applied.

Figure 6B:
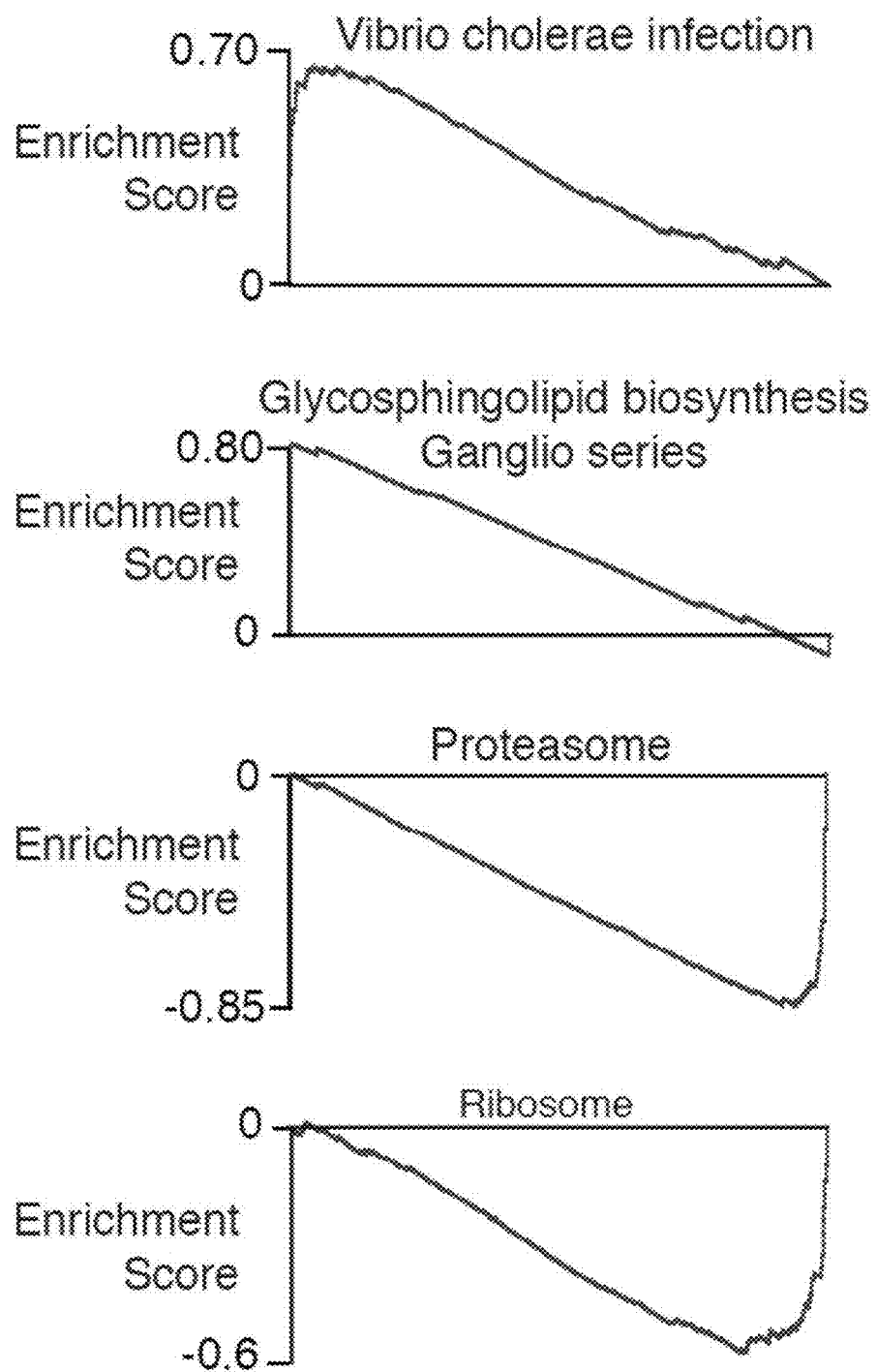

To evaluate the biological validity of the screen, genes were ranked by the average phenotype of their three strongest sgRNAs, and the 50 hits with the strongest protective effect and the 50 hits with the strongest sensitizing effect were defined as "top hits" (all of these are far outside of the range seen with otherwise matched negative control sgRNAs). Gene set enrichment analysis (GSEA) (Pubmed ID: 12808457) revealed that the two most significant KEGG pathways enriched for top protective hit genes were "Infection with *Vibrio cholerae*" and "Glycosphingolipid biosynthesis, ganglio series" (FIG. 6B) consistent with the requirement for the ganglioside receptor for cholera toxin uptake. Among the three KEGG pathways most enriched for top sensitizing genes were "ribosome" and "proteasome" (FIG. 6B). Since the diphtheria toxin catalytic subunit inhibits protein translation, depletion of the ribosome can be expected to sensitize cells to the toxin. Sensitization of cells by knockdown of the proteasome suggests that the proteasome counteracts CTx-DTA toxicity after it enters the cytosol. A similar function for the proteosome in degrading ricin, another retro-translocating toxin, was recently demonstrated (Pubmed ID: 23394947). Taken together, the unbiased GSEA analysis provides support for the high specificity in hit gene identification by our CRISPRi approach.

Figure 6C:
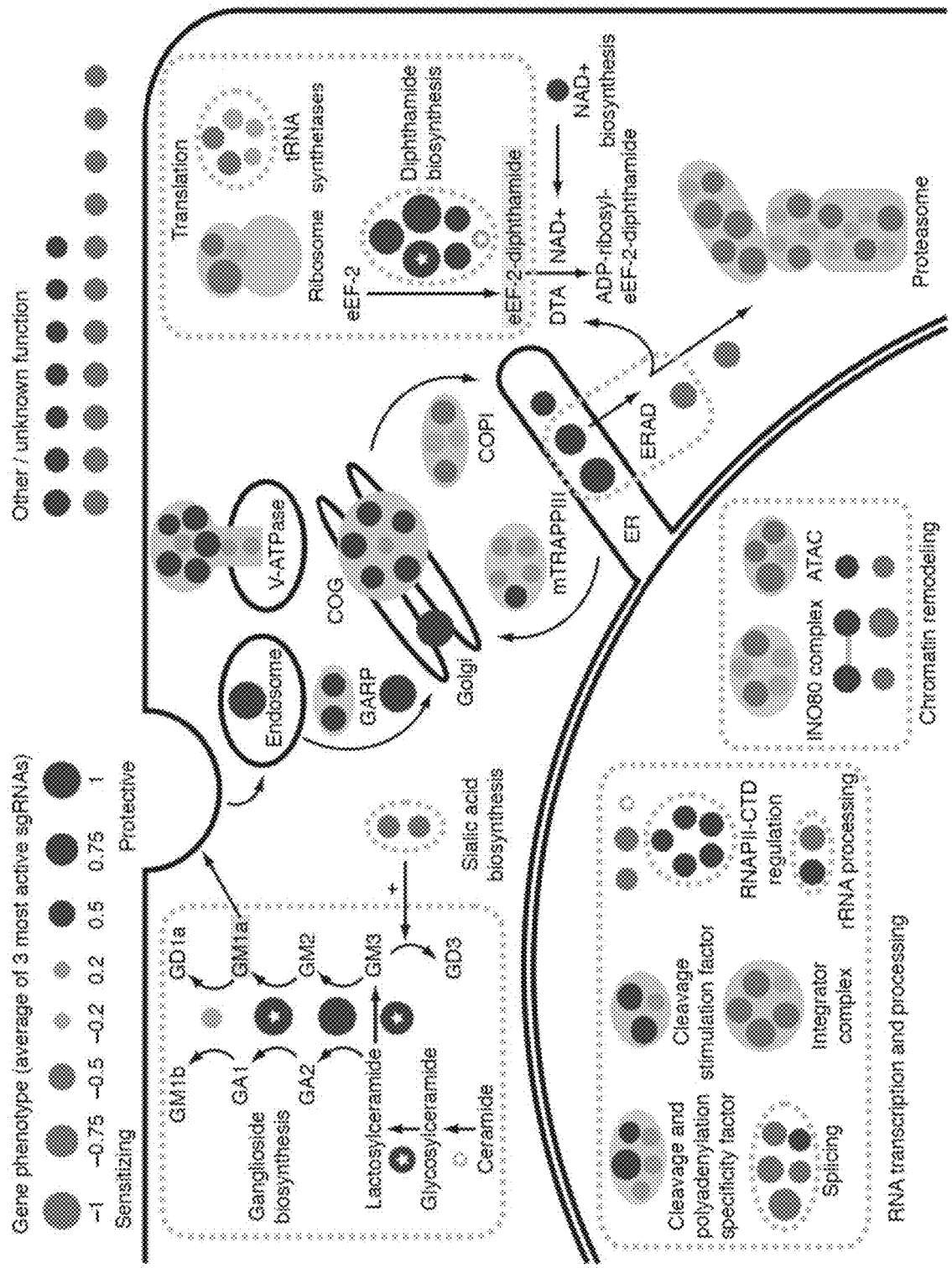
Figure 13B:
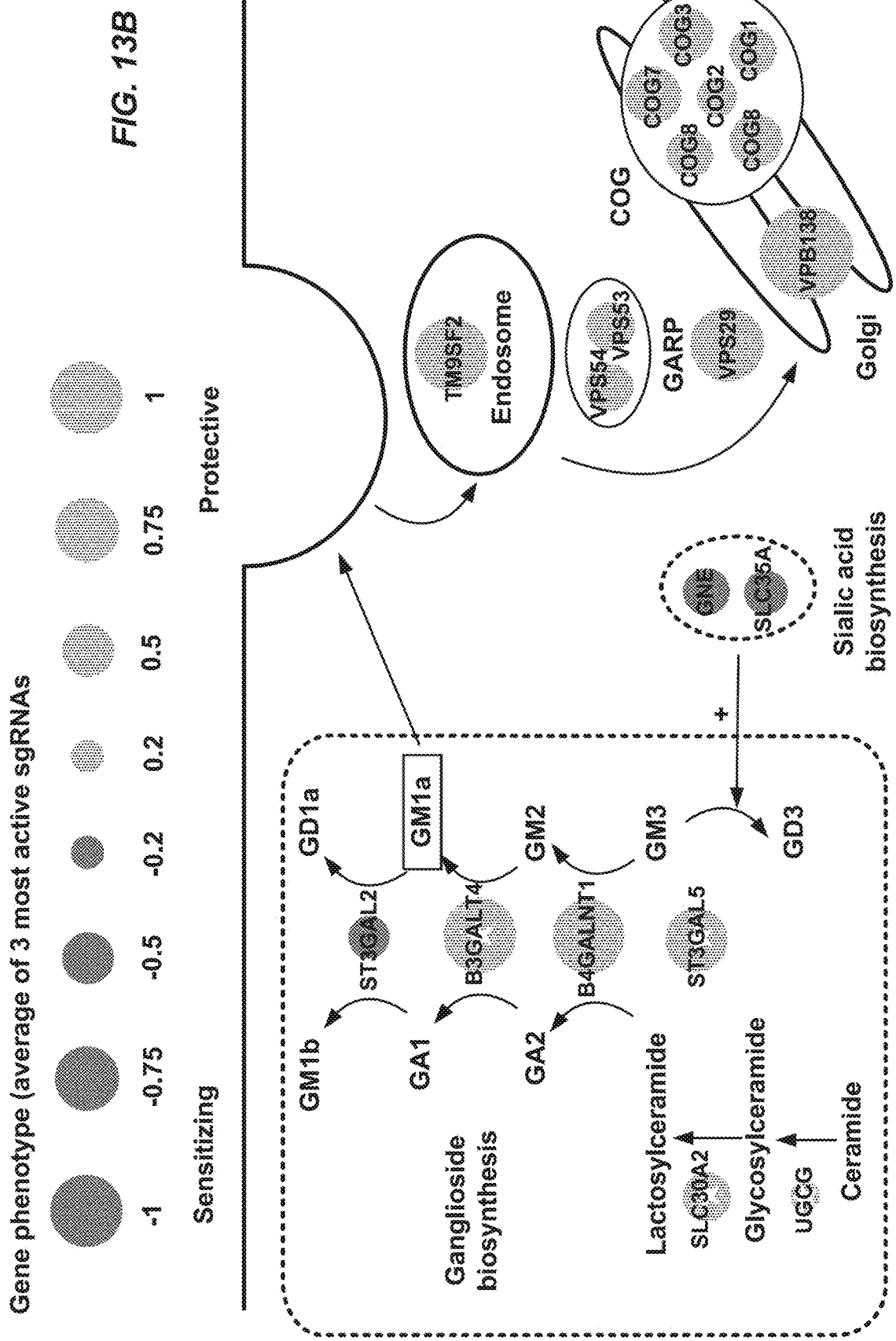
Figure 13C:
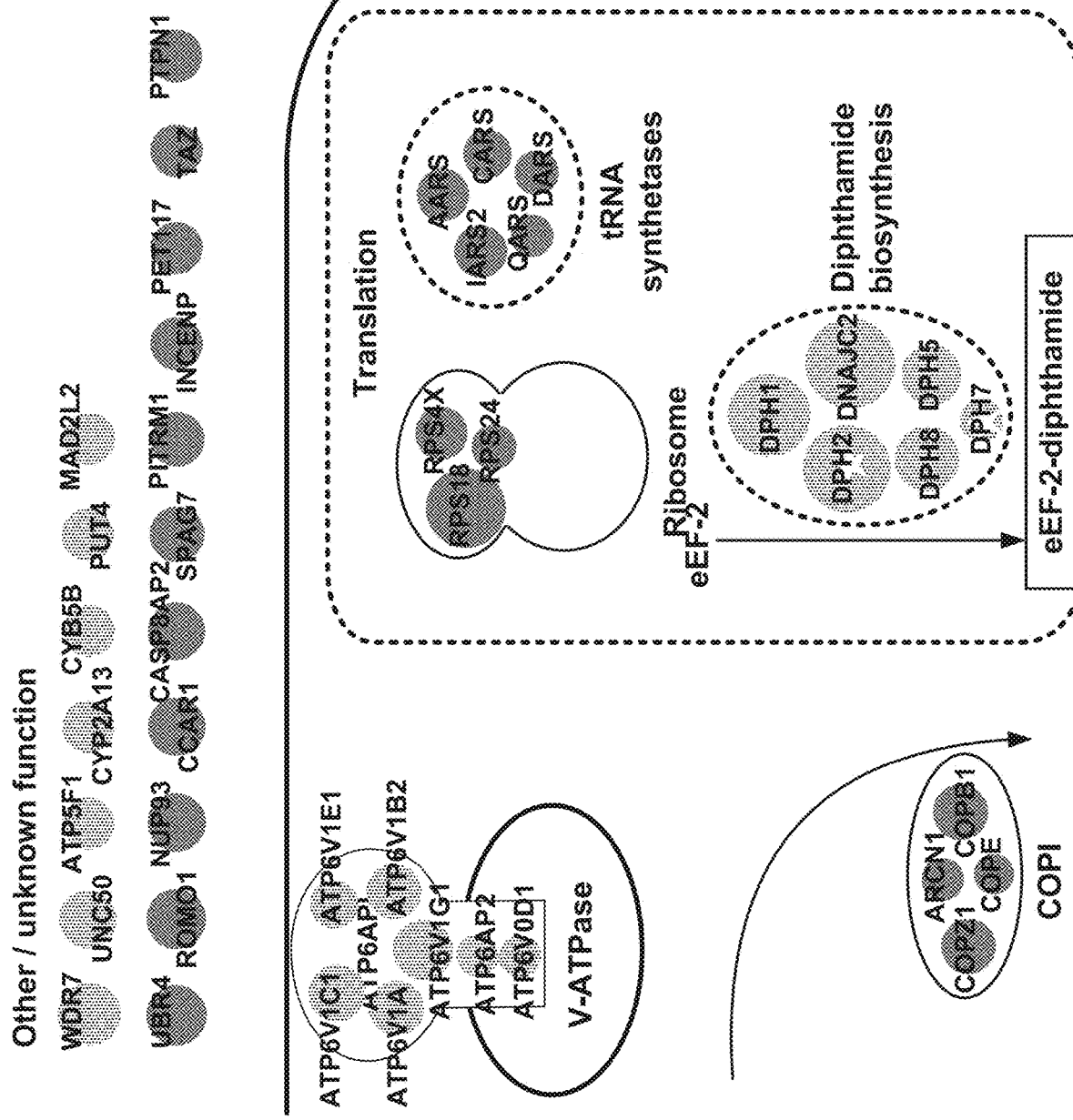
Figure 13D:
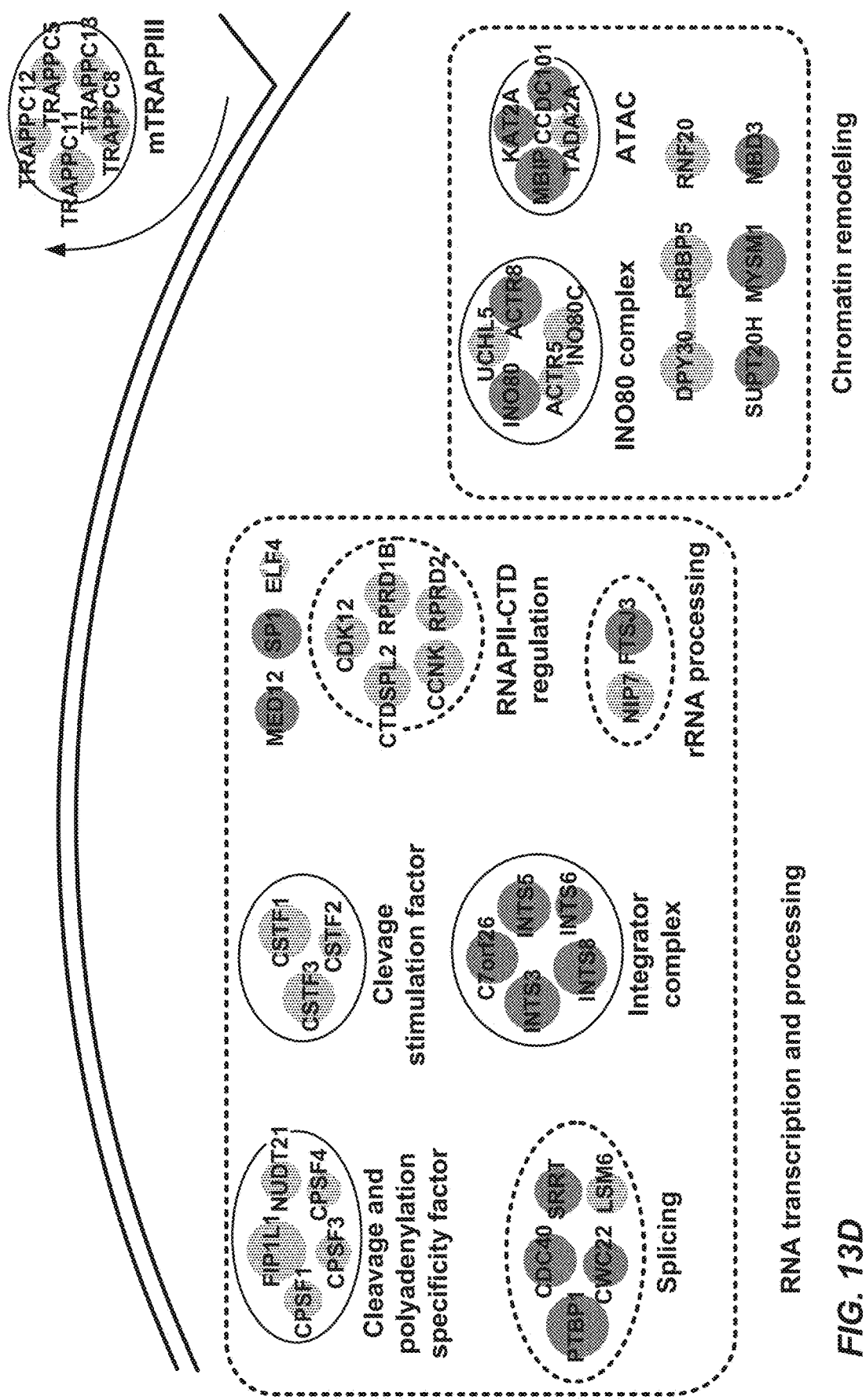
Figure 13E:
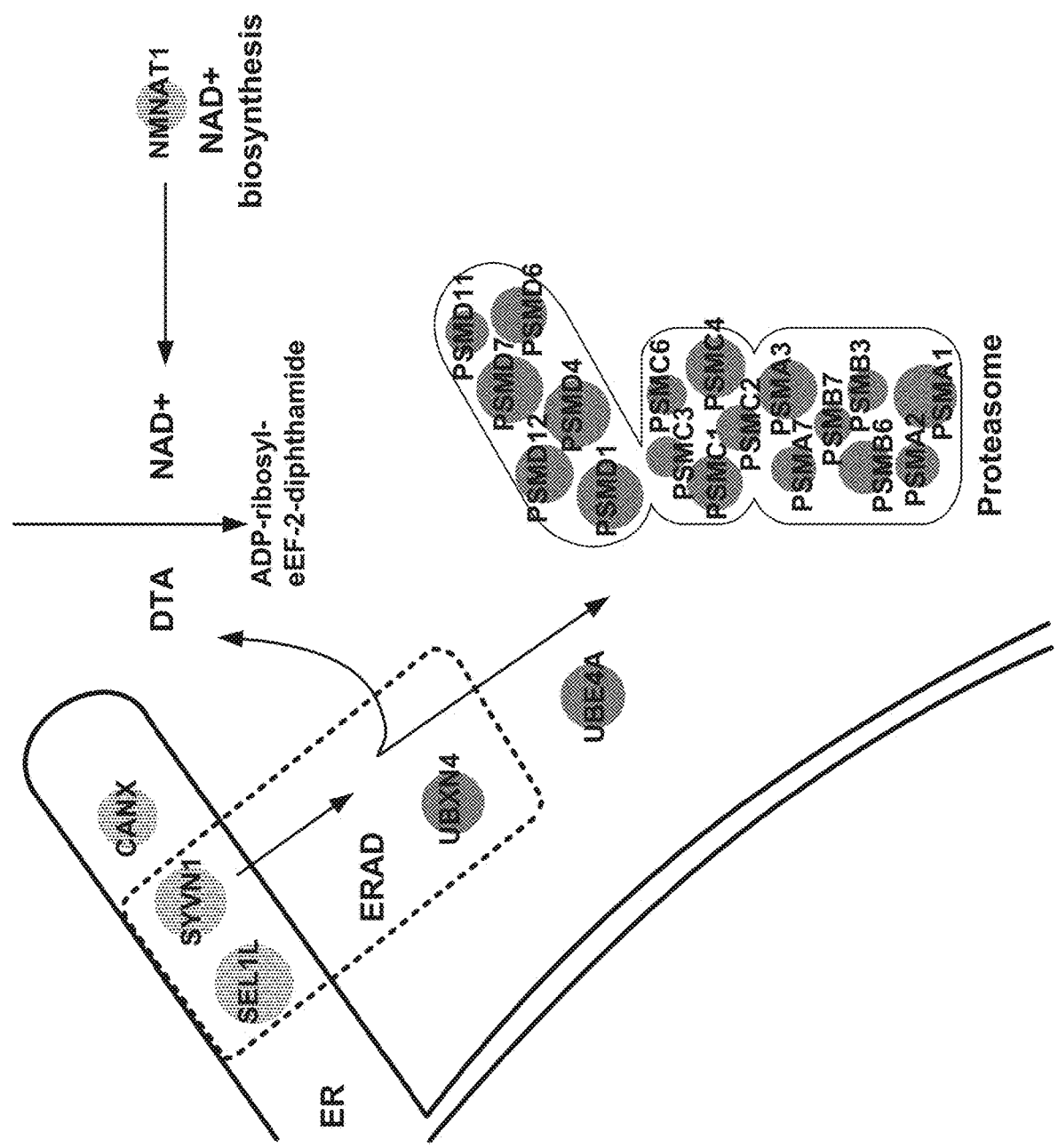

The top hit genes were further characterized by assigning them to cellular pathways and protein complexes according to their previously characterized roles (FIG. 6C and FIG. 13B). The CRISPRi screen identified a protective effect of knockdown for all of the top hits recovered in the previously published haploid mutagenesis screen (denoted with a white star). The two top pathways identified by haploid mutagenesis as modulating cellular sensitivity to CTx-DTA are the diphthamide biosynthesis pathway (required to generate eEF-2-diphthamide, the target of diphtheria toxin) and the ganglioside biosynthesis pathway (required to produce GM1, the cell-surface receptor for cholera toxin). The CRISPRi screen validated the top hits from the haploid mutagenesis screen and identified many additional core components of each pathway. While knockdown of all hits in the diphthamide biosynthesis pathway had a protective effect, the results for ganglioside biosynthesis genes showed a differentiated pattern: knockdown of enzymes involved in the production of GM1a were protective, whereas knockdown of enzymes that catalyze the production of other ganglioside species (including GM1b) was sensitizing. These results argue that GM1a is the relevant cell-surface receptor for CTx-DTA and more broadly illustrate the value of being able to reliably detect both sensitizing and protective genes to dissect biological pathways.

Many of the top hits are components of cellular pathways and protein complexes that were previously identified in targeted biochemical and cell biology experiments to be important for retrograde trafficking and retro-translocation of other toxins such as Ricin and Shiga toxin (Pubmed IDs: 19678899, 23394947). However, it remains unclear how Ctx is trafficked through the Golgi network (Pubmed ID: 22069586). The screen herein revealed a critical role for the COG and GARP complexes in CTx-DTA retrograde transport; targeting of the vast majority of the subunits of these complexes leads to strong resistance. These two complexes tether late endosomes to the trans-golgi network or modulate intra-Golgi retrograde transport (Pubmed ID: 16936697). Retro-translocation of the catalytic chain of CTx has been proposed to be mediated by the ER-associated degradation (ERAD) pathway although this pathway was not identified in previous genetic screens. Consistent with this proposed role for the ERAD machinery, knockdown of members of the ERAD E3 ubiquitin ligase complex, SYVN1 (encoding Hrd1) and SEL1L (the mammalian homolog of yeast Hrd3) rendered cells resistant to CTx-DTA. Factors mediating cytosolic degradation of ERAD substrates (in particular UBXN4, also known as UBXD2/erasin and the proteasome) were sensitizing hits, suggesting that they may reduce cytosolic levels of the catalytic toxin chains in WT cells.

Other top hit genes were tightly clustered in a number of protein complexes involved in gene expression, including the Integrator complex, factors involved in mRNA cleavage and adenylation, and chromatin remodeling. Repression of all canonical components of the cleavage stimulating factor complex and most of the core components of the cleavage and polyadenylation specificity factor complex protected cells from CtxDTA (see below for validation of one of these hit genes). This illustrates the ability of unbiased CRISPRi screens to identify complexes that modulate specific processes with very high saturation. These pathways had not previously been implicated in the control of cholera toxin or diphtheria toxin sensitivity. The ability to robustly identify novel pathways in a process as intensely studied as toxin entry highlights the potential of CRISPRi as a discovery platform.

Figure 7A:
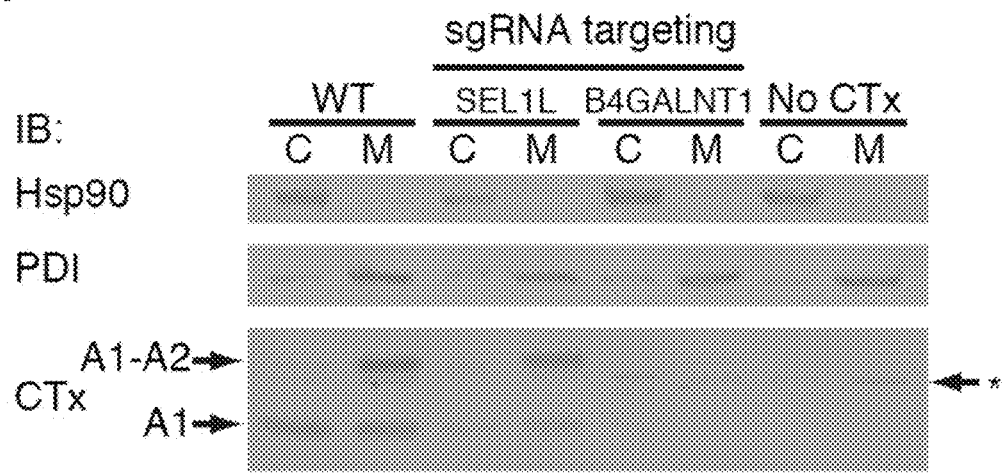
FIG. 7A-FIG. 7G: CRISPRi Strongly Represses Gene Expression Resulting in Robust Reproducible Phenotypes, which Enables Compaction of A Genome Wide Library.
Figure 7B:
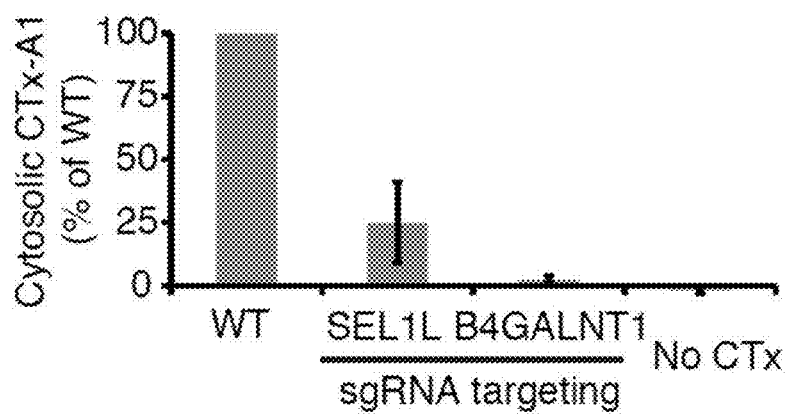
Figure 7C:
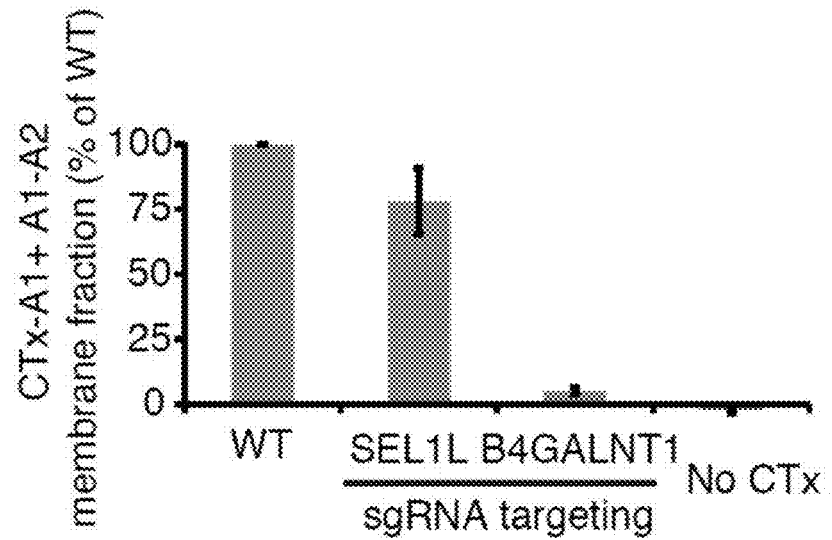

I. Potent Phenotypes and Knockdown Levels Achieved by the Genome-Scale CRISPRi Library To validate the suggested role of the identified ERAD factors in toxin retrotranslocation from the ER to the cytosol, incubated K562 cells were transiently (90 min) transfected with unmodified CTx and the amount of CTx chains in the cytosol and membrane fractions was quantified. SEL1L knockdown resulted in a dramatic reduction of cytosolic CTx-A1, whereas levels in the membrane fraction were much less affected (FIG. 7A-FIG. 7C). By contrast, knockdown of B4GALNT1, an enzyme required for the synthesis of the CTx receptor GM1a, resulted in a nearly complete absence of CTx chains from both the cytosolic and the membrane fraction (FIG. 7A-FIG. 7C). This highly efficient block of CTx binding and uptake by a single sgRNA, which is mirrored by the strong CTx-DTA resistance achieved by B4GALNT1 knockdown (FIG. 7D), underscores the ability of the CRISPRi library described herein to achieve potent loss-of-function phenotypes.

Figure 7D:
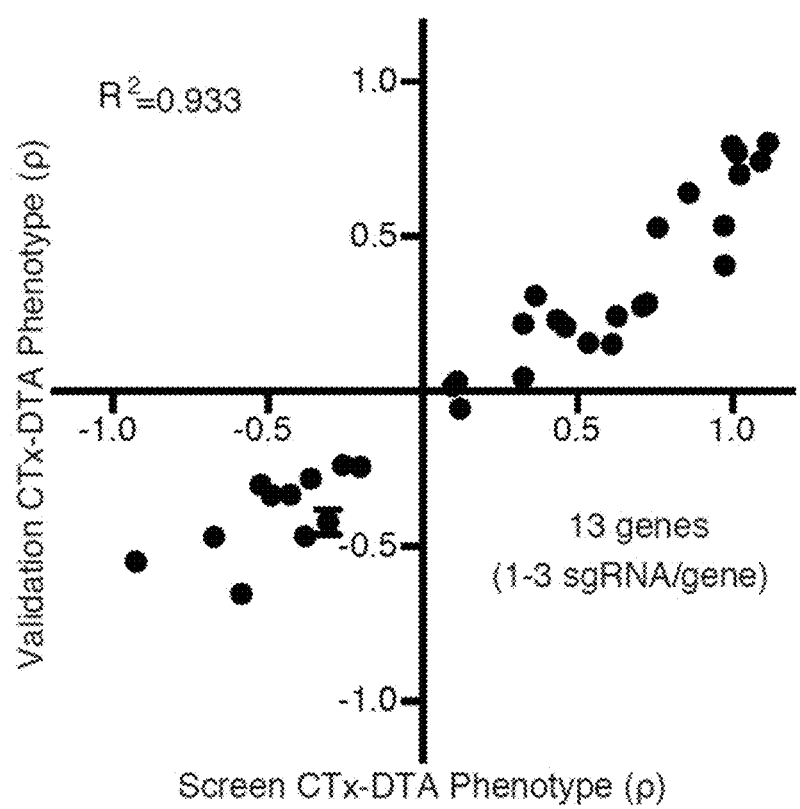
Figure 7E:
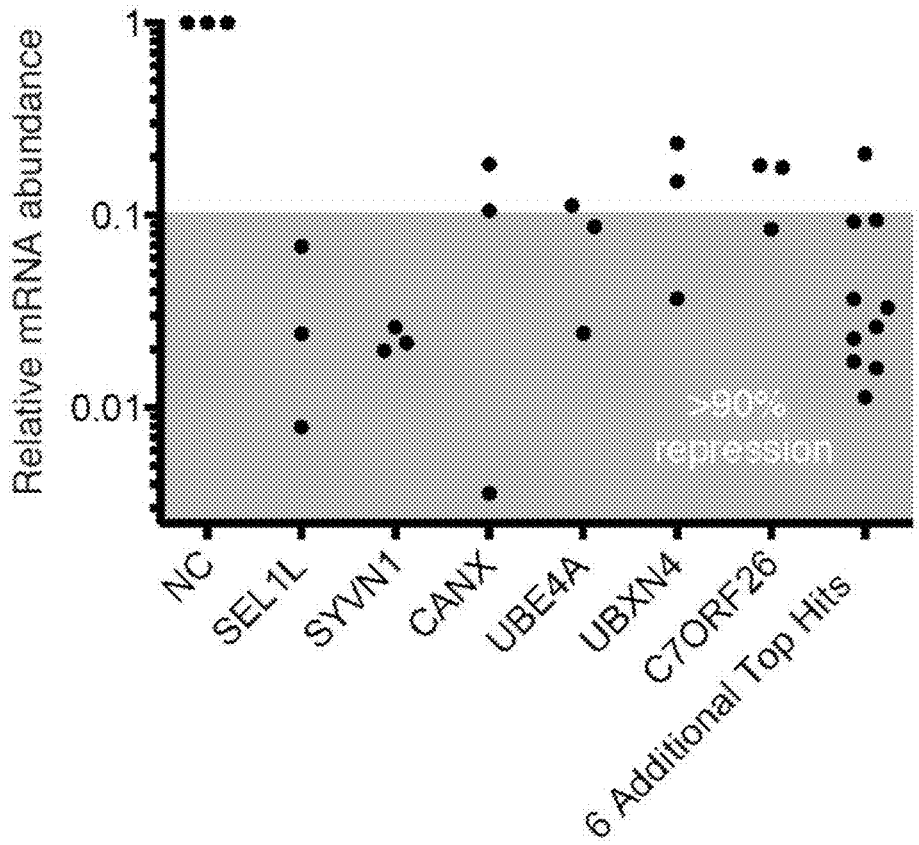

To technically validate the results from this screen sgRNAs which putatively modulate cellular response to CTx-DTA in mechanistically diverse ways were re-tested. For each sgRNA, the ricin phenotypes were quantified as well as the change in abundance of the targeted transcript by qPCR. The re-test experiments were highly correlated with data from the primary screen (FIG. 7D). In the validation experiments across 5 screens and 75 sgRNAs, the activities of 74 out of 75 sgRNAs robustly retested and were highly correlated (R^2=0.879) with the results obtained in the primary screen, demonstrating the reliability of phenotype scores obtained in the primary screens. qPCR data showed robust repression, with 80-99% knockdown for each sgRNA and at least 90% for every gene (FIG. 7E).

J. Refinement of sgRNA Rules Enables More Compact Design of Future CRISPRi Libraries The results of genome-scale CRISPRi for growth and CTx-DTA resistance provided a set of active and inactive sgRNAs for a larger group of genes. These data were used as a training set to discern further rules that would be predictive of sgRNA activity.

Figure 14A:
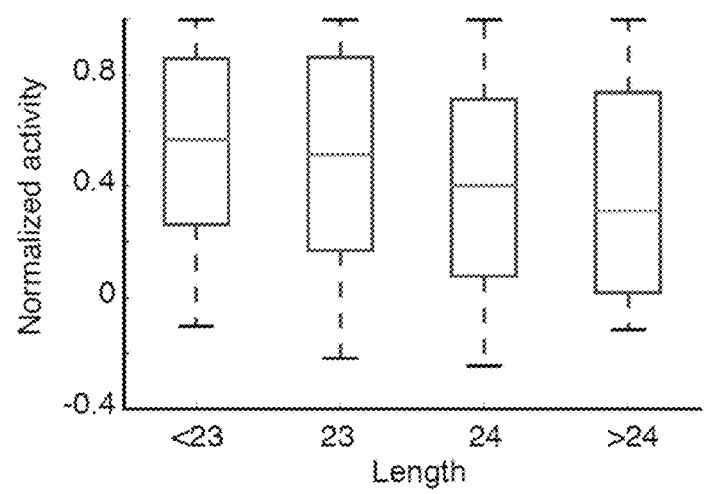
FIG. 14A-FIG. 14E: Exemplary rules for further improving CRISPRi library performance.
Figure 14B:
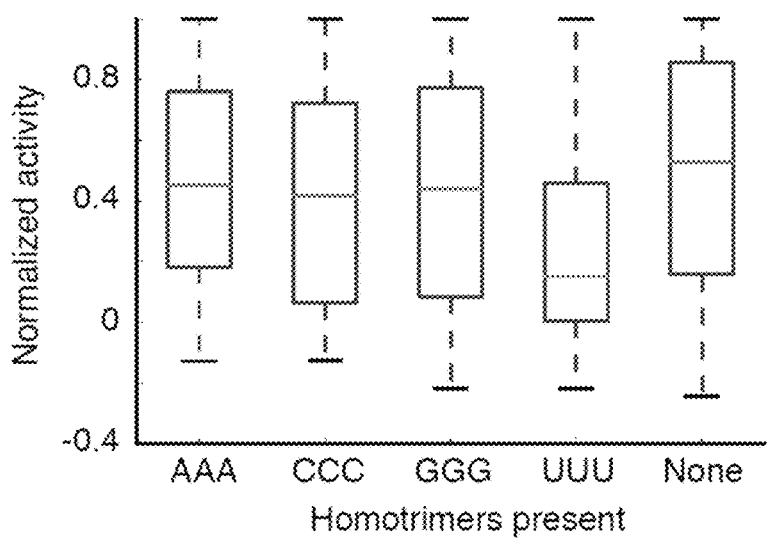
Figure 14C:
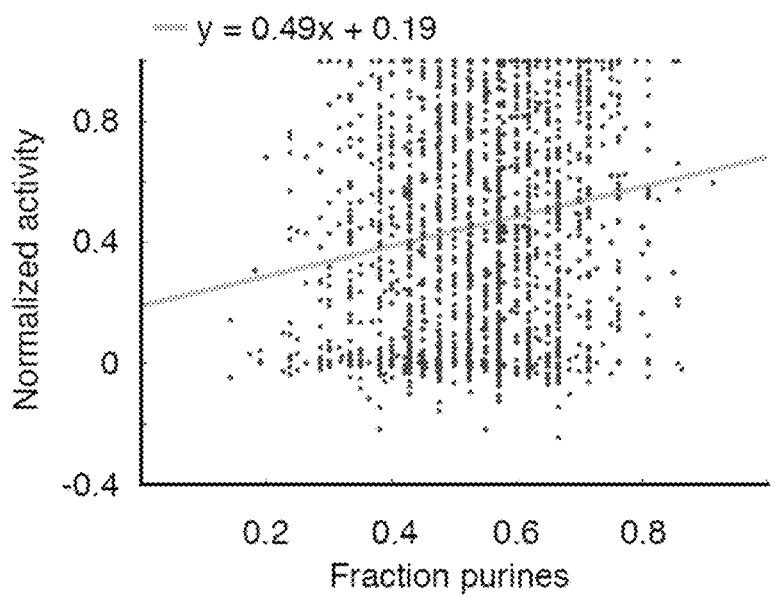
Figure 14D:
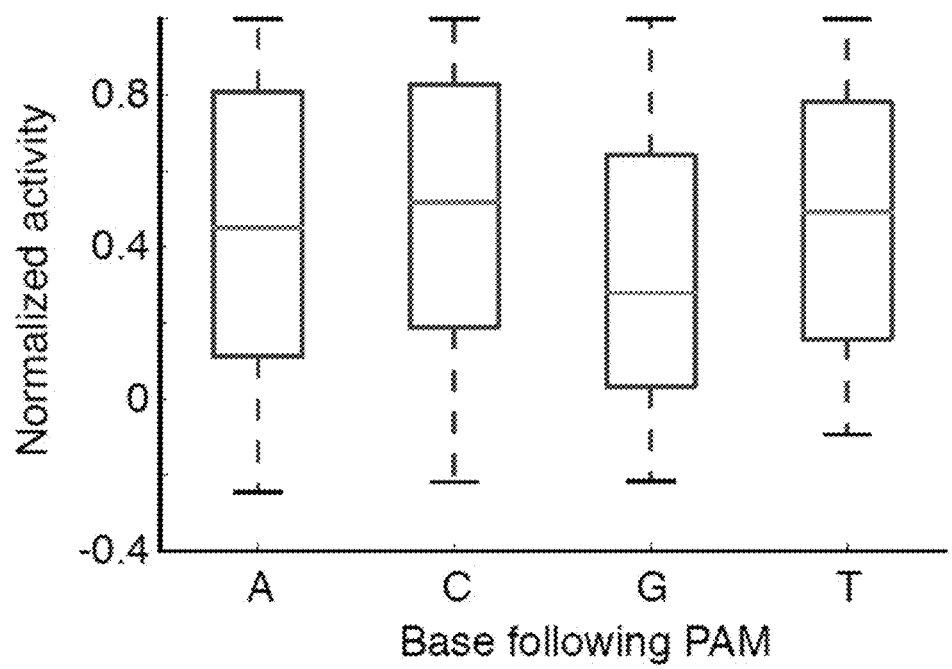
Figure 14E:
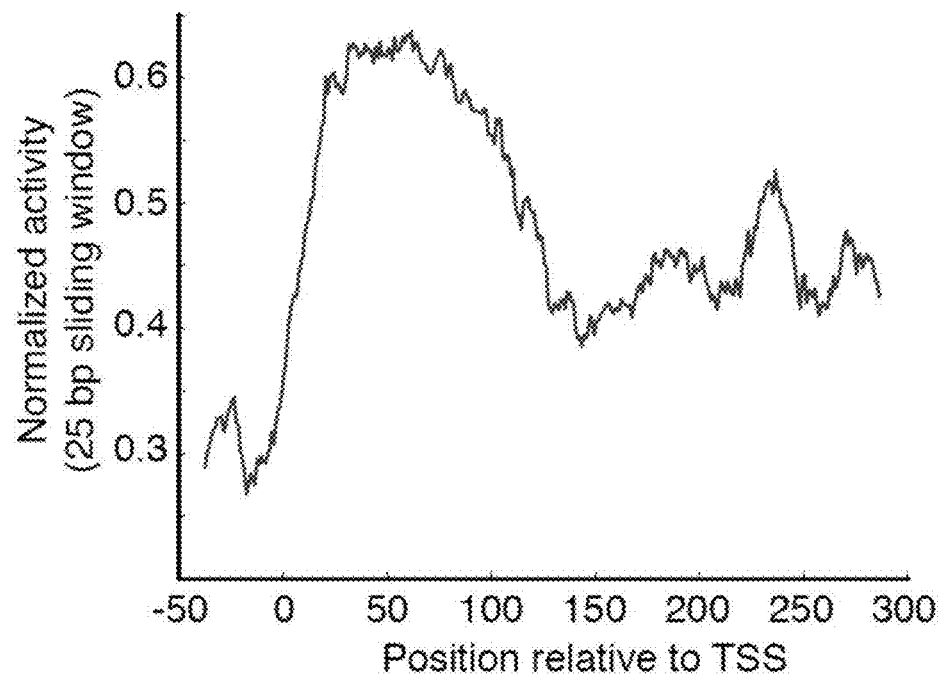

The trend for shorter sgRNAs to show higher activity was confirmed for sgRNAs in the genome-wide library (FIG. 14A). sgRNAs containing the UUU homotrimer resulted in less pronounced phenotypes than other sgRNAs (FIG. 14B). Overall higher purine content was predictive of higher sgRNA activity (FIG. 14C). The negative impact of pyrimidines specifically in the 3' end of the sgRNA that had been previously reported (Pubmed ID: 24336569) was not observed. Decreased activity for sgRNAs targeting genomic sites in which the PAM (NGG) was followed by a G was observed (FIG. 14D). Finally, a metagene analysis revealed maximum sgRNA activity in a window of +25 to +100 bp downstream of the TSS (FIG. 14E), consistent with earlier observations (FIG. 11B).

Figure 7F:
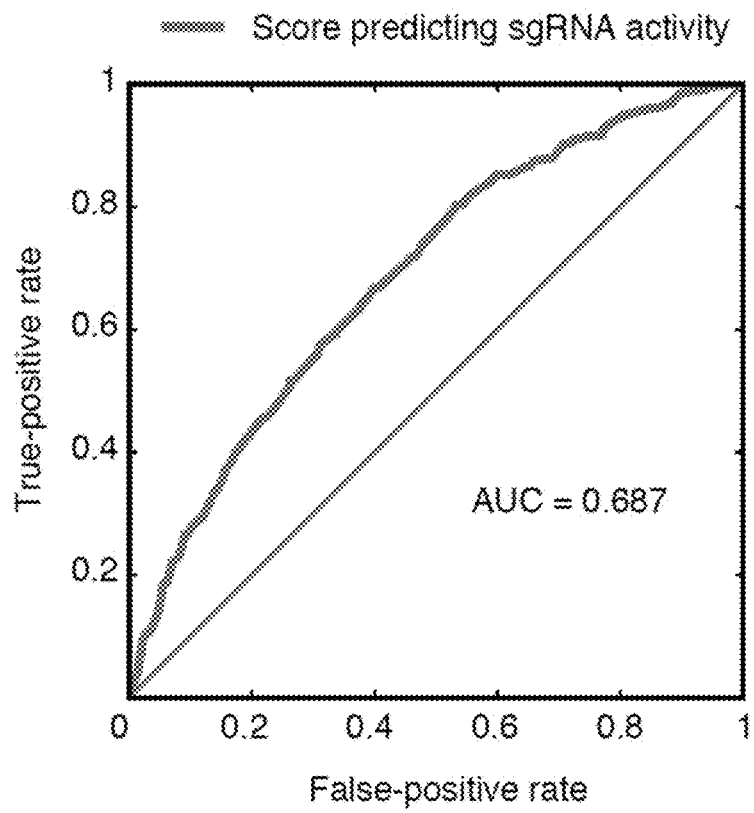
Figure 7G:
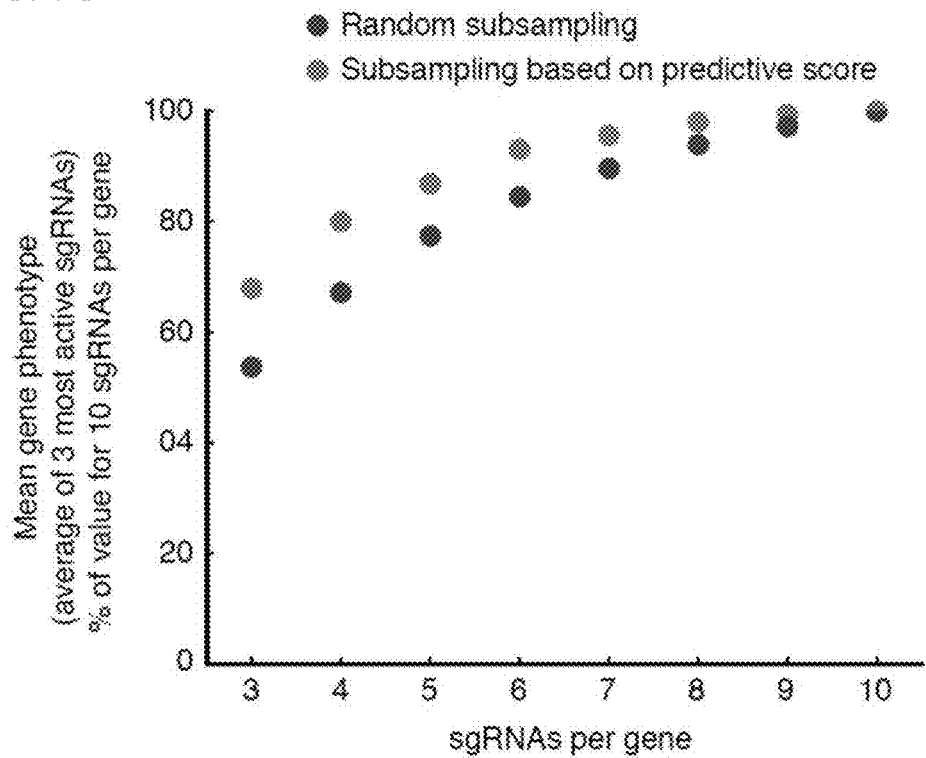
Figure 16B:
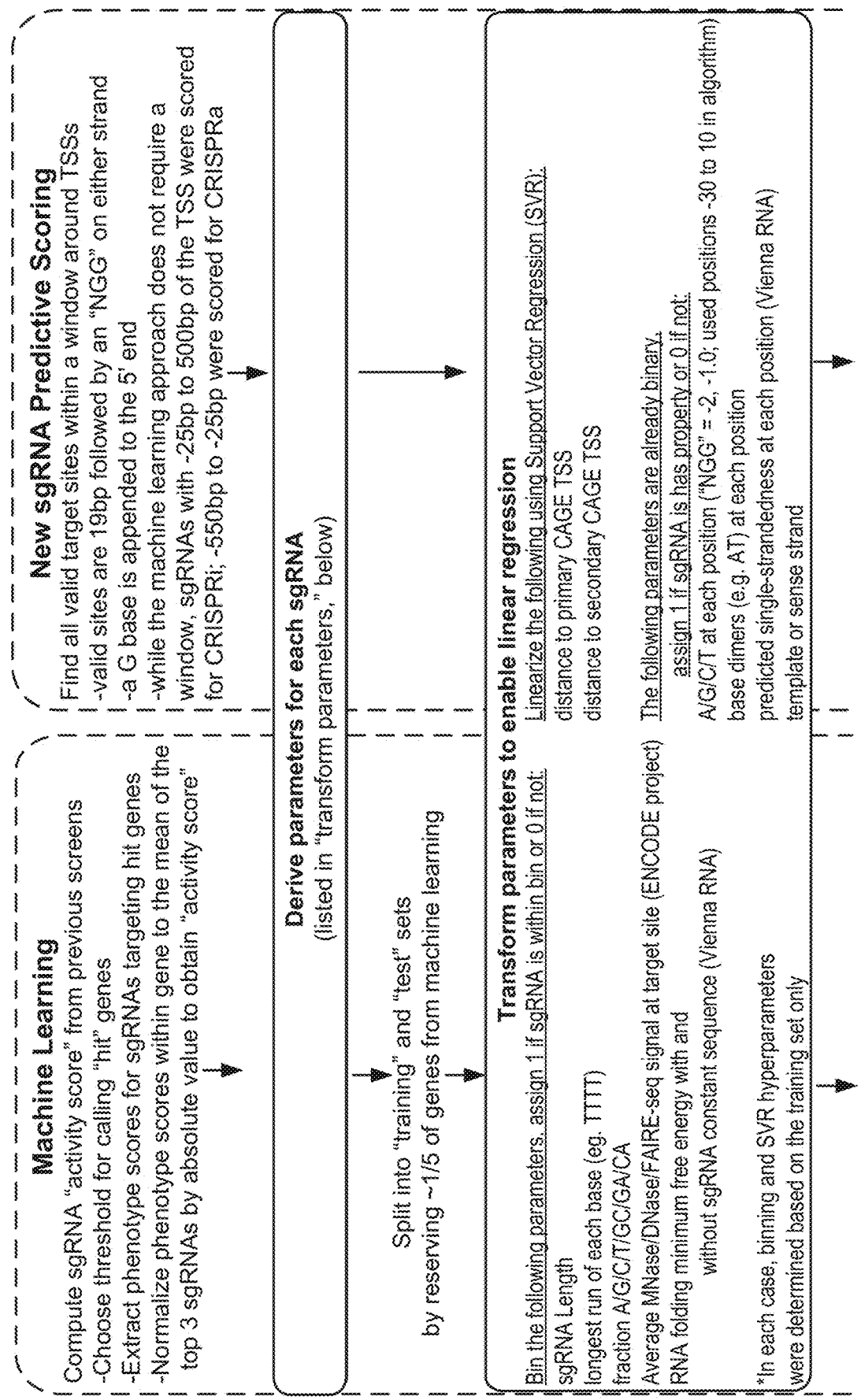
Figure 16C:
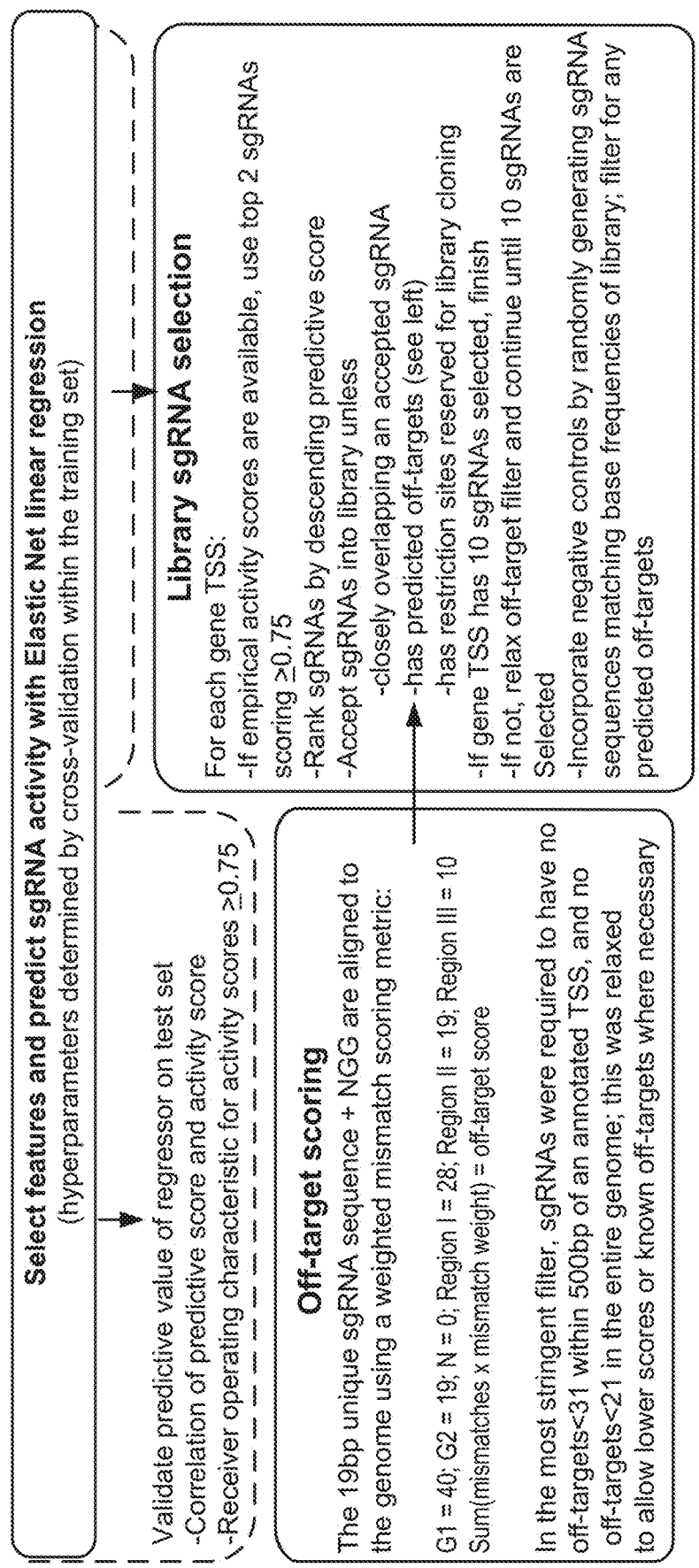

Using stepwise logistic regression, these rules were integrated into a quantitative score that predicted sgRNA activity with an ROC area under the curve of 0.687 (FIG. 7F, see Materials and Methods for details). To validate the hypothesis that this predictive score will enable the design of potent, compact CRISPRi libraries in the future, phenotypes from two genome-scale CRISPRi screens were computationally subsampled by either choosing random subsets of sgRNAs for each gene, or selecting subsets based on the refined algorithm (FIGS. 16A-16C). By selecting 6 out of 10 sgRNAs per gene based on the predictive score, >93% of the library activity, as quantified by the metric used to identify hit genes in the screens (average phenotype of the strongest 3 sgRNAs per gene) was maintained. Compaction of the genome-scale CRISPRi library by 40% further facilitates pooled screens by reducing the scale of the cell populations and the number of sequencing reads required for analysis.

IV. Discussion

CRISPRi and CRISPRa is established herein as robust methods for systematically turning on and off transcription of endogenous genes in human cells. CRISPRi/a can be used to screen for both loss-of-function and gain-of-function phenotypes rapidly in a pooled format. Thus known and unexpected genes required for growth or which modulate sensitivity to a toxin (CTx-DTA) can be identified. An allelic series of gene expression spanning a broad range, from ~100-fold repression to ~10-fold induction can also be created to examine and define how the abundance of a protein relates to function.

The experiments described herein demonstrate that a key feature of CRISPRi is the very low incidence of off-target effects, as evidenced by the near-absence of activity for three large and distinct classes of negative control sgRNAs in the genome-scale CRISPRi library. This feature simplifies validation and interpretation of screening results. The observed specificity stems from two distinct properties of the system. First, CRISPRi/a complexes bound outside a narrow window around the TSS largely fail to modulate transcription; this dramatically shrinks the sequence space across the genome where off-target binding will produce significant off-target activity. Additionally, CRISPRi activity is highly sensitive to mismatches between the sgRNA and target DNA suggesting that off-target binding seen in Chip-Seq experiments (Pubmed IDs: 24752079, 24837660, 24980957) is too transient to impact transcription. The combination of strict sequence requirements and positional rules renders CRISPRi activity exquisitely specific.

A current implementation of CRISPRa described herein uses the sunCas9 fusion protein to recruit multiple copies of one activation domain to directly engage basal transcription machinery. Many copies of a single or multiple effector domains can be recruited using similar approaches to create highly active artificial enhancers or silenced heterochromatin to modulate gene expression over an even broader range. The pooled phenotype-based screening approach provides a tool for the evaluation of on- and off-target activities of future variations on CRISPRi and CRISPRa.

CRISPRa screening provides a new approach for exploring the diversity of transcripts across complex genomes. Classically, gene activation has been used to dissect the limiting component of a biochemical process (Pubmed ID: 22419077). For example, overexpression screens have been used to identify the molecular target of a drug or to activate key rate-limiting steps in a pathway. Two early examples of such screens in eukaryotic cells are the identification of DPAGT1 as the target of tunicamycin and MyoD as the limiting component of fibroblast to myoblast differentiation (Pubmed IDs: 6316322, 3690668). More recently, a combinatorial activation screen identified four genes that when co-expressed reprogram fibroblasts into pluripotent stem cells (Pubmed ID: 16904174). CRISPRa should greatly accelerate similar searches for combinations of factors with emergent properties. In addition, CRISPRa will likely provide insight into cellular pathways where redundancy hampers loss of function genetic approaches. Allelic series of sgRNAs that quantitatively activate and repress gene expression may also provide deeper understanding of how genetic polymorphisms, copy number variation or mutations outside the exome contribute to disease susceptibility (Pubmed ID: 17597780).

The ability to control transcription with high specificity provided herein simplifies the analysis and validation of high-throughput screening data. The genome-scale CRISPRi library described herein contains 10sgRNAs/TSS; the resulting library size allows it to be screened in a cell population grown in a single spinner flask. However, the observed high specificity, and further understanding of rules governing sgRNA activity should enable the creation of more compact sgRNA libraries. By compacting the genome-wide libraries, larger numbers of cell lines, chemical compounds, time points or reporter constructs can be screened. Alternately, an sgRNA library designed to activate or repress a broader range of transcripts in the human genome can reveal the function of many non-canonical RNAs encoded in the human genome. As most non-coding transcripts are nuclear and lack an open reading frame, methods that directly modulate transcription are optimally suited for interrogating the function of these RNAs (Pubmed ID: 22955988).

Systematic genetic interaction (GI) maps have proven to be powerful tools for revealing gene functions within pathways or complexes (Pubmed IDs: 23394947, 14764870, 16487579, 20093466, 16269340, 17314980, 17510664, 24906158). A CRISPRa GI map or a combined CRISPRi/a GI map could yield rich novel biology elucidating how networks of proteins dictate cellular function (Pubmed ID: 21572441). More generally, quantitative methods of turning on and off one or multiple transcripts represents a critical tool for understanding how expression of the genes encoded in our genomes controls cell function and fate.

V. Methods

A. Plasmid Design and Construction

Previously described vectors were used to express dCas9, dCas9-KRAB and the sunCas9 CRISPRa system. Using Gibson cloning an optimized CRISPRi fusion protein was cloned. The protein is expressed from the inducible TRE3G promoter (Clontech) in a pHR lentiviral backbone (Addgene). Using this vector, an mRNA molecule encoding the CRISPRi fusion protein and mCherry separated by a viral T2A sequence was expressed. The CRISPRi fusion encodes mammalian codon optimized *Streptococcus pyogenes* dCas9 (DNA 2.0) fused at the N-terminus with the Kox1 KRAB domain and at the C-terminus with two SV40 nuclear localization sequences (NLS). To generate a Cas9 expression plasmid matched to a lentiviral dCas9-BFP fusion construct, residues 10 and 840 were reverted from alanine to aspartic acid and histidine using standard quick change mutagenesis (Agilent). The optimized sgRNA was previously described (Pubmed ID: 24360272). Briefly, the sgRNA was expressed using a lentiviral U6 based expression vector derived from pSico which co-expresses either BFP, GFP or mCherry and a puromycin resistance cassette separated by a T2A sequence from either the CMV or Ef1 Alpha promoter. The sgRNA constant region was modified to clone the genome scale CRISPRi library by altering one base pair in the sgRNA stem sequence that introduces a Blp1 restriction site. This change does not diminish sgRNA activity as tested using a GFP reporter as previously described (Data not shown) (Pubmed ID: 23849981). The sgRNA expression plasmids for validation experiments were cloned by PCR from an existing sgRNA template using a common 3' primer and a unique 5' primer containing the desired protospacer. The PCR product and the lentiviral U6 based expression vector were digested with BstXI and XhoI and the two pieces of DNA were ligated together.

B. CRISPRi TSS Library Specifications

Genes were selected from the entire set of protein coding genes. A subset of Unassigned genes and Membrane_Protein not likely to be expressed in most cells and with a RPKM of 0 in a K562 RNA-seq expression data were excluded. The final targeted gene total was 15,977. Transcription start sites were selected from GencodeV19/Ensembl release 74 transcripts, selecting all transcripts annotated by the appris pipeline when possible, or all transcripts of the same biotype ('protein_coding', 'processed_transcript', etc) as the corresponding gene. In all cases only 'KNOWN' or 'NOVEL' transcripts were used, unless none existed or the gene itself was 'PUTATIVE'. Where no transcripts matching this criteria were found, all Refseq (accessed Nov. 19, 2013) transcripts with NM accession numbers were used.

For 50 bp upstream and 300 bp downstream of each TSS, every guide adjacent to an NGG PAM, starting with a G, and having length 18-25 was computed. Guides were scored by uniqueness in the genome, as determined by an empirically derived (and CRISPRicin-verified) scoring metric: PAM G1=40, PAM G2=19, PAM N=0, Region I=28, Region II=19, Region III=10. If sum(mismatches*mismatch-score) <threshold, the mismatched site is considered an off-target. The threshold was systematically lowered to allow less unique guides to be considered where necessary. In some cases, threshold was held stringent and the number of allowed targets was increased to tolerate very similar gene families Each guide ID was given a uniqueness string corresponding to threshold (e flag of bowtie) and allowed targets (m flag). In decreasing order of stringency: e39m1, e30m1, e20m1, e11m1, e1m1, e39m2, e39m3, fail For each gene, a minimum of 10 guides were selected. The script attempted to target each TSS with 10 guides (with individual guides counted toward multiple TSSs where applicable), although in cases where this led to >25 guides for a gene, the script then defaulted to requiring only at least 3 guides for each TSS. Guides were ranked as follows: 1. uniqueness according to off-target score, 2. the number of TSSs the guide is in range to target (high to low), 3. the number genes the guide targets (low to high; for the vast majority of guides this was 1, but in cases guides were close to 2 genes those guides were avoided), 4. guides of length 18-21 were considered 'short' and ranked first, while guides of length 22-25 were considered 'long' and ranked according to their length (low to high), 5. a random ranking was applied to choose among guides equivalent in criteria 1-4. Guides were not selected if they are separated from another accepted guide by fewer than 5 bases as defined by the 'left side' of the sequence (5' end for +strand oligos, 3' end for −strand). Only ~40 genes did not completely meet this standard.

As GC content increases at transcription start sites and sgRNA placement depends on the 3' NGG motif, the sgRNA set was particularly enriched for sgRNAs in this region. To buffer against incorrectly annotated transcription start sites sgRNAs were picked for the genome wide library in a window from −50 to +350 bp relative to the transcription start site of each gene. This window is broader than the absolute maximum peak of CRISPRi activity from +50 to +100 but safeguards against closely spaced alternate TSS or incorrectly annotated TSS.

Negative control guides were designed on randomized human essential gene TSS regions and afterwards selected using the same rules as above.

Exemplary CRISPR target sequences identified using one or more of the rules described herein for activation or repression are provided in the co-filed sequence listing as Table 2 for human CRSPRa sgRNA targets, Table 3 for human CRISPRi sgRNA targets and Table 4 for mouse CRISPRi sgRNA targets.

C. CRISPRi/a Library Cloning

CRISPRi/a libraries were prepared by methods similar to those previously described for shRNA libraries (Pubmed IDs: 19448642, 24992097). Complex oligonucleotide pools were synthesized by Agilent or Custom Array. Each library was amplified by PCR, digested with either BstX1 and XhoI or BstX1 and Blp1 and cloned into an sgRNA expression vector.

D. Cell Culture, DNA Transfections, and Viral Production and Construction of CRISPRi/a Cell Lines HEK293 cells were maintained in Dulbecco's modified eagle medium (DMEM) in 10% FBS, 2 mM glutamine, 100 units/mL streptomycin and 100 μg/mL penicillin. K562 cells were grown in RPMI-1640 with 25 mM HEPES and 2.0 g/L NaHCo3 in 10% FBS, 2 mM glutamine, 100 units/mL streptomycin and 100 μg/mL penicillin. Lentivirus was produced by transfecting HEK293 with standard packaging vectors using TransIT®-LTI Transfection Reagent (Mirus, MIR 2306). Viral supernatant was harvested 72 hours following transfection and filtered through a 0.45 μm PVDF syringe filter.

To construct CRISPRi/a cell lines, K562 cells were lentivirally transduced to express Cas9, dCas9, dCas9-KRAB, scFV-sfGFP-VP64 or the rtTA from the SFFV promoter, or dCas9-GCN4-10× from the TRE3G promoter. Pure polyclonal populations of each CRISPRi/a cell line were sorted by flow cytometry using a BD FACS Aria2 for stable GFP, BFP or mCherry expression. For CRISPRa, single cell clones were then isolated and analyzed as described previously.

To construct the inducible CRISPRi K562 cell line, a clonal K562 cell line that constitutively expresses a standard doxycycline inducible transactivator was generated without a selection marker by lentiviral transduction and identified using western blot analysis. These cells were then transduced with an inducible KRAB-dCas9 fusion protein marked by P2A-mCherry (pHR-Tre3G-KRAB-dCas9-P2A-mCherry). Doxycycline was added following infection and flow cytometry was used to sort cells that expressed mCherry. These cells were then grown in the absence of doxcycycline until mCherry returned to uninduced levels.

E. High Throughput Pooled CRISPRi/a Screening

CRISPRi/a K562 cell lines were infected with sgRNA libraries as previously described (Pubmed ID: 23394947). The infection was scaled to achieve a multiplicity of infection of one sgRNA per cell. Two days after infection, cells were selected with 0.65-0.75 μg/mL puromycin (Tocris) for 3 days, and then washed into fresh medium for ~24-48 hour recovery. Each growth or toxin screen was carried out until untreated cells had undergone 12 population doublings and we achieved at least 6 population doublings difference between untreated and toxin treated cells. For the CRISPRi/a tiling ricin screens, cells were passaged or treated with 3 or 4 pulses of 0.5 ng/mL ricin over 16 days. For the CRISPRi genome-scale growth and CTx-DTA screen, cells were passaged or treated with two pulses of 0.4 nM CTx-DTA over 10 days. For both toxins, we spun cells out of the toxin at 24 hours and re-suspended cells in fresh media. Cells were maintained at a density of between 500,000 and 1,000,000 cells/mL continually maintaining a library coverage of at least 1000 cells per sgRNA. Cells were collected for genomic DNA extraction immediately populations of cells expressing this library of sgRNAs were either harvested at the outset of the experiment (the t0 time point), grown under standard conditions (untreated), or treated with toxin. Genomic DNA was harvested from all samples; the sgRNA-encoding regions were then amplified by PCR and sequenced on an Illumina HiSeq-2500 using custom primers with previously described protocols at high coverage. Two biological replicates of each screen were performed. From this data, the frequencies of cells expressing different sgRNAs were quantified in each sample. From this data the phenotype of each sgRNA, which was previously defined for growth ("gamma") or resistance to treatment ("rho") was quantified. To calculate a normalized z-score for these phenotypes, gamma or rho were divided by the standard deviation of negative-control sgRNA phenotypes.

F. Bioinformatic Analysis of Hit Genes

Hit genes were ranked based on average phenotype of the 3 most extreme sgRNAs targeting them. Pathways and gene sets enriched among hit genes were identified using GSEA and DAVID software. In the sgRNA tiling experiment it was observed that half of the sgRNAs in the window of maximum activity had a Z-score over 2 suggesting the large majority genes have three active or more active sgRNAs in the CRISPRi library. The genome scale data was analyzed using the metric of average phenotype of the top 3 sgRNAs. Using more sgRNAs can dilute the signal with inactive sgRNA whereas using fewer could fail to take advantage of the full set of active sgRNAs. Statistical significance of the average phenotype can then be evaluated based on clear differentiation from the signal seen for non targeting control sgRNAs.

G. Individual Re-Test of sgRNA Phenotypes and CRISPRi/a Transcript Repression and Activation Individual phenotype re-test experiments for sgRNAs from the CRISPRi/a ricin tiling screens, the CRISPRi genome scale cholera screens, and sub-library screen of essential genes were performed as competitive growth experiments on a partially transduced populations of K562 cells. Briefly, cells were partially transduced ~25-60%. Three or four days following infection, cells were counted and seeded in 24 well plates at 0.25-0.5 million cells/mL. Triplicate samples for each sgRNA were grown under standard conditions or, for toxin challenge experiments, were treated with 0.5 ng/mL of ricin or 0.4 nM CTx-DTA. Each population of cells was allowed to grow or recover for 6 days. For both toxins, cells were spun cells out of the toxin at 24 hours and re-suspended cells in fresh media. The absolute cell number and percentage of cells that express BFP (indicating sgRNA expression) was measured for each sample at the beginning and end of the experiment. Rho scores were calculated as described. For cell proliferation re-test experiments, cells were grown under standard conditions in the presence and absence of doxycycline. Doxycycline concentration was daily adjusted to 50 ng/mL assuming a half-life of 24 hours. Relative cell proliferation was determined by the percentage of cells that maintained expression of mCherry (as a surrogate for induced KRAB-dCas9) and BFP (indicating sgRNA expression).

To determine the amount of gene knockdown or activation for individual sgRNAs, partially transduced cells expressing individual sgRNAs, which were used for re-test experiments, were selected with a maximum of 3 ug/mL puromycin for 4-5 days. Cells were allowed to recover from selection and then were harvested for RT-qPCR directly or were treated with doxycycline (to induced KRAB-dCas9) prior to collection.

H. Negative Selection Screening of Essential Gene Sub-Library

Lentivirus was prepared by cotransfection of library plasmid DNA with lentiviral packaging vectors (expressing Gag, Pol, Rev, and Tat) into 293T cells using TransIT®-LTI Transfection Reagent (Mirus, MIR 2306). Media was changed the following day. Viral supernatant was harvested the second day post transfection, filtered through a 0.45 µm PVDF syringe filter, and processed for storage at −80° C. in two ways: (screen replicate 1) direct flash freezing in liquid nitrogen, (screen replicate 2) concentration using Alstem Precipitation Solution (Alstem, VC100), according to manufacturer instructions, followed by treatment with 50 U/mL Benzonase Nuclease (Sigma, E1014-25KU) for 30 minutes at 37° C. prior to flash freezing.

Inducible KRAB-dCas9 K562 cells were infected with screen virus as previously described (Pubmed ID: 23394947). The infection was scaled to achieve a target multiplicity of infection of (% infection) at representation of the 5776-element sub-library. Two days after infection, cells were selected with 0.65 µg/mL PURO for 3 days, and then washed into fresh medium for ~24 hour recovery. Cells were grown for 13 days, maintained at a density of ~500,000 to 1,000,000 cells/mL with a representation of >1,000-fold, in the presence or absence of doxycycline. Throughout the screen doxycycline was daily adjusted to 50 ng/mL assuming a half-life of 24 hours. Cells were collected for genomic DNA extraction immediately prior to doxycycline addition and again 13 days later. Replicate infections were screened in duplicate, and data from these duplicate end points were averaged.

I. Quantitative RT-PCR

Cells were harvested and total RNA was isolated using the NucleoSpin RNA II (Macherey-Nagel), according to manufacturer's instructions. RNA was converted to cDNA using AMV reverse transcriptase under standard conditions with oligo dT primers and RNasin (Promega). Quantitative PCR reactions were prepared with a 2× master mix according to the manufacturer's instructions (Quanta Biosciences). Reactions were run on a LightCycler thermal cycler (Roche).

J. Western Blot

Cells were lysed in TBS (20 mM Tris, 150 mM NaCl) supplemented with 0.5% Igepal, 1× protease inhibitor (Roche), and 500 U/mL Benzonase Nuclease (Sigma, E1014-25KU). Whole cell lysates were run on a pre-cast 4-12% Bis-Tris polyacrylamide gel (Life Technologies) under denaturing conditions and transferred to PVDF membrane. Antibodies against human influenza hemagglutinin (HA) and alpha-Tubulin (Sigma, T5168) were used to detect proteins. Blots were imaged using the LI-COR Odyssey Imaging System.

K. Cholera Toxin Uptake and Retrotranslocation Assay

A previously described assay (Pubmed ID: 18094046) was adapted. Briefly, aliquots of 2 million K562 cells expressing dCas9-KRAB and sgRNAs targeting genes of interest were resuspended in 3 ml Hank's Balanced Salt Solution (HBSS) and 10 nM CTx (Millipore, 227036) was added. Cells were incubated with the toxin for 90 min at 37° C. After 3 washes in HBSS, cells were lysed in HCN buffer (50 mM HEPES, pH 7.5, 150 mM NaCl, 2 mM CaCl2, and 10 mM N-ethyl maleimide [NEM], and protease inhibitors) containing 0.02% digitonin. After incubation on ice for 10 mM, lysates were subjected to centrifugation (16,000 g for 10 min at 4° C.). The supernatant was removed and represents the cytosolic fraction. The pellet was washed once in PBS and then resuspended in RIPA buffer (150 mM NaCl, 1% Triton X-100, 0.5% sodium deoxycholate, 0.1% SDS, 50 mM Tris-HCl pH 8.0, protease inhibitors). After incubation on ice for 10 min, the samples were subjected to centrifugation. (16,000 g for 10 min at 4° C.). The supernatant was removed and represents the membrane fraction. The cytosolic and membrane fractions were subjected to non-reducing SDS-PAGE and Western Blotting. CTx chains were detected using a polyclonal anti-CTx antibody (Abcam ab123129). As fractionation controls and for normalization of samples, the following antibodies were used: anti-PDI (Santa Cruz Biotechnology, sc-20132) for normalization of membrane fraction signal, and anti-Hsp90 (One World Lab ADI-SPA-846-D) for normalization of cytosolic fraction signal.

L. Machine Learning

Figure 15:
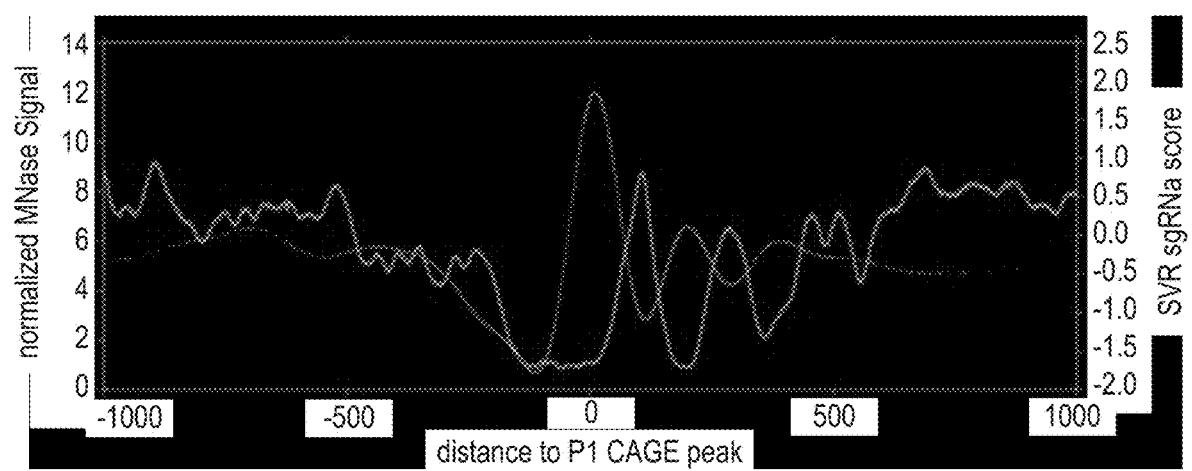
FIG. 15: Depicts sgRNA activity and micrococcal nuclease (MNase-seq) signal as a function of distance to the transcription start site (TSS) as indicated by FANTOM CAGE data. sgRNA activity (light line; arbitrary units) was generated by fitting a Support Vector Regressor to sgRNA phenotypes in genome-wide screens. MNase-seq signal (dark line) for K562 was obtained from the ENCODE project and was normalized and summed over 50 representative genes.

Defined sets of bona fide hit genes were identified for the CRISPRi growth and CTx-DTA sensitivity screens. For each of these genes, sgRNA phenotypes were normalized by dividing each by the phenotype of the strongest sgRNA. A variety of sgRNA features were then investigated for whether the feature was correlated with higher (or lower) sgRNA activity. To combine relevant features into a single quantitative score predictive of sgRNA activity, a forward stepwise logistic regression, in which an sgRNA with a normalized phenotype of 0.75 or greater was classified as active, was used. The final score was incorporated the following features positively correlated with sgRNA activity: shorter length of the sgRNA, fraction purines in the sgRNA, sgRNA targeting the region +25 bp to +100 bp relative to the TSS, absence of UUU homotrimers in the sgRNA, the base following the PAM in the genomic DNA is not a G. An alternative method for library design and/or sgRNA target identification incorporates micrococcal nuclease signal information. sgRNAs targeted to regions having low micrococcal nuclease signal are predicted to have a higher activity than sgRNAs targeted to regions having a high micrococcal nuclease signal. See, FIG. 15. An alternative method for predicting sgRNA activity that utilizes both machine learning and empirical activity data, and incorporates additional features positively correlated with sgRNA activity, is depicted in FIGS. 16A-16C.

Machine learning and empirical validation are utilized to predict the following highly active sgRNA binding region encoding sequences: SEQ ID NOs:26-205,305 are predicted to encode sgRNA binding regions that provide highly active CRISPRi targeting of human genomic loci; SEQ ID NOs:

205,306-410,595 are predicted to encode sgRNA binding regions that provide highly active CRISPRa targeting of human genomic loci; SEQ ID NOs:410,596-633,445 are predicted to encode sgRNA binding regions that provide highly active CRISPRi targeting of mouse genomic loci; SEQ ID NOs:633,446-857,995 are predicted to encode sgRNA binding regions that provide highly active CRISPRa targeting of mouse genomic loci. In some cases, sgRNAs predicted to be highly active in inhibiting or activating a target locus comprise binding regions comprising or consisting of the 19 nucleotides at the 3' end of any one of SEQ ID NOs:26-857,995. A library of such highly active sgRNAs, or a subset or combination thereof, can be constructed by or utilized in the methods described herein.

SEQUENCE LISTING (857995 sequences)

SEQ ID NO: 1 - DNA, 4977 bp, Artificial Sequence
  synthetic dCas9-p65AD fusion protein, dCas9 domain fused to p65AD
  misc_feature (1)..(4104): human codon optimized nuclease deficient small guide RNA (sgRNA)-mediated nuclease (dCas9) domain from Streptococcus pyogenes version 2
  misc_feature (4105)..(4977): human NfkappaB p65 subunit transcriptional activation domain (p65AD) + linker + 2 Simian virus 40 nuclear localization signal (SV40 NLS) sequences
atggacaagaagtattctatcggactggccatcgggactaatagcgtcgggtgggccgtgatcactgacgagtacaaggtgccctctaagaagttcaaggtgctcgggaacaccgaccggcattccatcaagaaaaatctgatcggagctctcctctttgattcaggggagaccgctgaagcaacccgcctcaagcggactgctagacggcggtacaccaggaggaagaaccggatttgttaccttcaagagatattctccaacgaaatggcaaaggtcgacgacagcttcttccataggctggaagaatcattcctcgtggaagaggataagaagcatgaacggcatcccatcttcggtaatatcgtcgacgaggtggcctatcacgagaaatacccaaccatctaccatcttcgcaaaaagctggtggactcaaccgacaaggcagacctccggcttatctacctggccctggcccacatgatcaagttcagaggccacttcctgatcgagggcgacctcaatcctgacaatagcgatgtggataaactgttcatccagctggtgcagacttacaaccagctctttgaagagaaccccatcaatgcaagcggagtcgatgccaaggccattctgtcagcccggctgtcaaagagccgcagacttgagaatcttatcgctcagctgccgggtgaaaagaaaaatggactgttcgggaacctgattgctctttcacttgggctgactcccaatttcaagtctaatttcgacctggcagaggatgccaagctgcaactgtccaaggacacctatgatgacgatctcgacaacctcctggcccagatcggtgaccaatacgccgaccttttccttgctgctaagaatctttctgacgccatcctgctgtctgacattctccgcgtgaacactgaaatcaccaaggcccctctttcagcttcaatgattaagcggtatgatgagcaccaccaggacctgaccctgcttaaggcactcgtccggcagcagcttccggagaagtacaaggaaatcttctttgaccagtcaaagaatggatacgccggctacatcgacggaggtgcctcccaagaggaattttataagtttatcaaacctatccttgagaagatggacggcaccgaagagctcctcgtgaaactgaatcgggaggatctgctgcggaagcagcgcactttcgacaatgggagcattccccaccagatccatcttggggagcttcacgccatccttcggcgccaagaggacttctacccctttcttaaggacaacagggagaagattgagaaaattctcactttccgcatcccctactacgtgggacccctcgccagaggaaatagccggtttgcttggatgaccagaaagtcagaagaaactatcactccctggaacttcgaagaggtggtggacaagggagccagcgctcagtcattcatcgaacggatgactaacttcgataagaacctccccaatgagaaggtcctgccgaaacattccctgctctacgagtactttaccgtgtacaacgagctgaccaaggtgaaatatgtcaccgaagggatgaggaagcccgcattcctgtcaggcgaacaaaagaaggcaattgtggaccttctgttcaagaccaatagaaaggtgaccgtgaagcagctgaaggaggactatttcaagaaaattgaatgcttcgactctgtggagattagcggggtcgaagatcggttcaacgcaagcctgggtacctaccatgatctgcttaagatcatcaaggacaaggattttctggacaatgaggagaacgaggacatccttgaggacattgtcctgactctcactctgttcgaggaccgggaaatgatcgaggagaggcttaagacctacgcccatctgttcgacgataaagtgatgaagcaacttaaacggagaagatataccggatggggacgccttagccgcaaactcatcaacggaatccgggacaaacagagcggaaagaccattcttgatttccttaagagcgacggattcgctaatcgcaacttcatgcaacttatccatgatgattccctgacctttaaggaggacatccagaaggcccaagtgtctggacaaggtgactcactgcacgagcatatcgcaaatctggctggttcacccgctattaagaagggtattctccagaccgtgaaagtcgtggacgagctggtcaaggtgatgggtcgccataaaccagagaacattgtcatcgagatggccagggaaaaccagactacccagaagggacagaagaacagcagggagcggatgaaaagaattgaggaagggattaaggagctcgggtcacagatccttaaagagcacccggtggaaaacacccagcttcagaatgagaagctctatctgtactaccttcaaaatggacgcgatatgtatgtggaccaagagcttgatatcaacaggctctcagactacgacgtggacgccatcgtccctcagagcttcctcaaagacgactcaattgacaataaggtgctgactcgctcagacaagaaccggggaaagtcagataacgtgccctcagaggaagtcgtgaaaaagatgaagaactattggcgccagcttctgaacgcaaagctgatcactcagcggaagttcgacaatctcactaaggctgagaggggcggactgagcgaactggacaaagcaggattcattaaacggcaacttgtggagactcggcagattactaaacatgtcgcccaaatccttgactcacgcatgaataccaagtacgacgaaaacgacaaacttatccgcgaggtgaaggtgattaccctgaagtccaagctggtcagcgatttcagaaaggactttcaattctacaaagtgcgggagatcaataactatcatcatgctcatgacgcatatctgaatgccgtggtgggaaccgccctgatcaagaagtacccaaagctggaaagcgagttcgtgtacggagactacaaggtctacgacgtgcgcaagatgattgccaaatctgagcaggagatcggaaaggccaccgcaaagtacttcttctacagcaacatcatgaatttcttcaagaccgaaatcacccttgcaaacggtgagatccggaagaggccgctcatcgagactaatggggagactggcgaaatcgtgtgggacaagggcagagatttcgctaccgtgcgcaaagtgctttctatgcctcaagtgaacatcgtgaagaaaaccgaggtgcaaaccggaggcttttctaaggaatcaatcctccccaagcgcaactccgacaagctcattgcaaggaagaaggattgggaccctaagaagtacggcggattcgattcaccaactgtggcttattctgtcctggtcgtggctaaggtggaaaaaggaaagtctaagaagctcaagagcgtgaaggaactgctgggtatcaccattatggagcgcagctccttcgagaagaacccaattgactttctcgaagccaaaggttacaaggaagtcaagaaggaccttatcatcaagctcccaaagtatagcctgttcgaactggagaatgggcggaagcggatgctcgcctccgctggcgaacttcagaagggtaatgagctggctctcccctccaagtacgtgaatttcctctaccttgcaagccattacgagaagctgaaggggagccccgaggacaacgagcaaaagcaactgtttgtggagcagcataagcattatctggacgagatcattgagcagatttccgagttttctaaacgcgtcattctcgctgatgccaacctcgataaagtccttagcgcatacaataagcacagagacaaaccaattcgggagcaggctgagaatatcatccacctgttcaccctcaccaatcttggtgcccctgccgcattcaagtacttcgacaccaccatcgaccggaaacgctatacctccaccaaagaagtgctggacgccaccctcatccaccagagcatcaccggactttacgaaactcggattgacctctcacagctcggaggggatgagggagctcccaagaaaaagcgcaaggtaggtagttccggatctccgaaaaagaaacgcaaagttggtagtcagtatctgcccgacacagatgatagacaccgaatcgaagagaaacgcaagcgaacgtatgaaaccttcaaatcgatcatgaagaaatcgcccttctcgggtccgaccgatcccaggcccccaccgagaaggattgcggtcccgtcccgctcgtcggccagcgtgccgaagcctgcgccgcagccctaccccttcacgtcgagcctgagcacaatcaattatgacgagttcccgacgatggtgttcccctcgggacaaatctcacaagcctcggcgctcgcaccagcgcctccccaagtccttccgcaagcgcctgccccagcgcctgcaccggcaatggtgtccgccctcgcacaggcccctgcgcccgtccccgtgctcgcgcctggaccgccccaggcggtcgctccaccggctccgaagccgacgcaggccggagagggaacactctccgaagcacttcttcaactccagtttgatgacgaggatcttggagcactccttggaaactcgacagaccctgcggtgtttaccgacctcgcgtcagtagataactccgaatttcagcagcttttgaaccagggtatcccggtcgcgccacatacaacggagcccatgttgatggaataccccgaagcaatcacgagacttgtgacgggagcgcagcggcctcccgatcccgcacccgcacctttgggggcacctggcctccctaacggacttttgagcggcgacgaggatttctcctccatcgccgatatggatttctcagccttgctgtcacagatttccagcggatct

SEQ ID NO: 2 - DNA, 4359 bp, Artificial Sequence
  synthetic dCAS9-VP64 fusion protein, dCas9 domain fused to VP64
  misc_feature (1)..(4104): human codon optimized nuclease deficient small guide RNA (sgRNA)-mediated nuclease (dCas9) domain from Streptococcus pyogenes version 2
  misc_feature (4105)..(4359): herpes simplex viral protein 16 (VP16) transactivational domain tetrameric repeat connected with glycine-serine linkers (VP64) + linker + 3 Simian virus 40 nuclear localization signal (SV40 NLS) sequences
atggacaagaagtattctatcggactggccatcgggactaatagcgtcgggtgggccgtgatcactgacgagtacaaggtgccctctaagaagttcaaggtgctcgggaacaccgaccggcattccatcaagaaaaatctgatcggagctctcctctttgattcaggggagaccgctgaagcaacccgcctcaagcggactgctagacggcggtacaccaggaggaagaaccggatttgttaccttcaagagatattctccaacgaaatggcaaaggtcgacgacagcttcttccataggctggaagaatcattcctcgtggaagaggataagaagcatgaacggcatcccatcttcggtaatatcgtcgacgaggtggcctatcacgagaaatacccaaccatctaccatcttcgcaaaaagctggtggactcaaccgacaaggcagacctccggcttatctacctggccctggcccacatgatcaagttcagaggccacttcctgatcgagggcgacctcaatcctgacaatagcgatgtggataaactgttcatccagctggtgcagacttacaaccagctctttgaagagaaccccatcaatgcaagcggagtcgatgccaaggccattctgtcagcccggctgtcaaagagccgcagacttgagaatcttatcgctcagctgccgggtgaaaagaaaaatggactgttcgggaacctgattgctctttcacttgggctgactcccaatttcaagtctaatttcgacctggcagaggatgccaagctgcaactgtccaaggacacctatgatgacgatctcgacaacctcctggcccagatcggtgaccaatacgccgaccttttccttgctgctaagaatctttctgacgccatcctgctgtctgacattctccgcgtgaacactgaaatcaccaaggcccctctttcagcttcaatgattaagcggtatgatgagcaccaccaggacctgaccctgcttaaggcactcgtccggcagcagcttccggagaagtacaaggaaatcttctttgaccagtcaaagaatggatacgccggctacatcgacggaggtgcctcccaagaggaattttataagtttatcaaacctatccttgagaagatggacggcaccgaagagctcctcgtgaaactgaatcgggaggatctgctgcggaagcagcgcactttcgacaatgggagcattccccaccagatccatcttggggagcttcacgccatccttcggcgccaagaggacttctacccctttcttaaggacaacagggagaagattgagaaaattctcactttccgcatcccctactacgtgggacccctcgccagaggaaatagccggtttgcttggatgaccagaaagtcagaagaaactatcactccctggaacttcgaagaggtggtggacaagggagccagcgctcagtcattcatcgaacggatgactaacttcgataagaacctccccaatgagaaggtcctgccgaaacattccctgctctacgagtactttaccgtgtacaacgagctgaccaaggtgaaatatgtcaccgaagggatgaggaagcccgcattcctgtcaggcgaacaaaagaaggcaattgtggaccttctgttcaagaccaatagaaaggtgaccgtgaagcagctgaaggaggactatttcaagaaaattgaatgcttcgactctgtggagattagcggggtcgaagatcggttcaacgcaagcctgggtacctaccatgatctgcttaagatcatcaaggacaaggattttctggacaatgaggagaacgaggacatccttgaggacattgtcctgactctcactctgttcgaggaccgggaaatgatcgaggagaggcttaagacctacgcccatctgttcgacgataaagtgatgaagcaacttaaacggagaagatataccggatggggacgccttagccgcaaactcatcaacggaatccgggacaaacagagcggaaagaccattcttgatttccttaagagcgacggattcgctaatcgcaacttcatgcaacttatccatgatgattccctgacctttaaggaggacatccagaaggcccaagtgtctggacaaggtgactcactgcacgagcatatcgcaaatctggctggttcacccgctattaagaagggtattctccagaccgtgaaagtcgtggacgagctggtcaaggtgatgggtcgccataaaccagagaacattgtcatcgagatggccagggaaaaccagactacccagaagggacagaagaacagcagggagcggatgaaaagaattgaggaagggattaaggagctcgggtcacagatccttaaagagcacccggtggaaaacacccagcttcagaatgagaagctctatctgtactaccttcaaaatggacgcgatatgtatgtggaccaagagcttgatatcaacaggctctcagactacgacgtggacgccatcgtccctcagagcttcctcaaagacgactcaattgacaataaggtgctgactcgctcagacaagaaccggggaaagtcagataacgtgccctcagaggaagtcgtgaaaaagatgaagaactattggcgccagcttctgaacgcaaagctgatcactcagcggaagttcgacaatctcactaaggctgagaggggcggactgagcgaactggacaaagcaggattcattaaacggcaacttgtggagactcggcagattactaaacatgtcgcccaaatccttgactcacgcatgaataccaagtacgacgaaaacgacaaacttatccgcgaggtgaaggtgattaccctgaagtccaagctggtcagcgatttcagaaaggactttcaattctacaaagtgcgggagatcaataactatcatcatgctcatgacgcatatctgaatgccgtggtgggaaccgccctgatcaagaagtacccaaagctggaaagcgagttcgtgtacggagactacaaggtctacgacgtgcgcaagatgattgccaaatctgagcaggagatcggaaaggccaccgcaaagtacttcttctacagcaacatcatgaatttcttcaagaccgaaatcacccttgcaaacggtgagatccggaagaggccgctcatcgagactaatggggagactggcgaaatcgtgtgggacaagggcagagatttcgctaccgtgcgcaaagtgctttctatgcctcaagtgaacatcgtgaagaaaaccgaggtgcaaaccggaggcttttctaaggaatcaatcctccccaagcgcaactccgacaagctcattgcaaggaagaaggattgggaccctaagaagtacggcggattcgattcaccaactgtggcttattctgtcctggtcgtggctaaggtggaaaaaggaaagtctaagaagctcaagagcgtgaaggaactgctgggtatcaccattatggagcgcagctccttcgagaagaacccaattgactttctcgaagccaaaggttacaaggaagtcaagaaggaccttatcatcaagctcccaaagtatagcctgttcgaactggagaatgggcggaagcggatgctcgcctccgctggcgaacttcagaagggtaatgagctggctctcccctccaagtacgtgaatttcctctaccttgcaagccattacgagaagctgaaggggagccccgaggacaacgagcaaaagcaactgtttgtggagcagcataagcattatctggacgagatcattgagcagatttccgagttttctaaacgcgtcattctcgctgatgccaacctcgataaagtccttagcgcatacaataagcacagagacaaaccaattcgggagcaggctgagaatatcatccacctgttcaccctcaccaatcttggtgcccctgccgcattcaagtacttcgacaccaccatcgaccggaaacgctatacctccaccaaagaagtgctggacgccaccctcatccaccagagcatcaccggactttacgaaactcggattgacctctcacagctcggaggggatgagggagctcccaagaaaaagcgcaaggtaggtagttccggatctccgaaaaagaaacgcaaagttggtagtgatgctttagacgattttgacttagatatgcttggttcagacgcgttagacgacttcgacctagacatgttaggctcagatgcattggacgacttcgatttagatatgttgggctccgatgccctagatgactttgatctagatatgctaggtagtcccaaaaagaagaggaaagtgggatct

SEQ ID NO: 3 - DNA, 4476 bp, Artificial Sequence
  synthetic dCas9-KRAB fusion protein, dCAS9 domain fused to KRAB repressor domain
  misc_feature (1)..(4104): human codon optimized nuclease deficient small guide RNA (sgRNA)-mediated nuclease (dCas9) domain from Streptococcus pyogenes version 2
  misc_feature (4105)..(4239): linker + 2 Simian virus 40 nuclear localization signal (SV40 NLS) sequences + human influenza hemagglutinin (HA) tag
  misc_feature (4240)..(4476): Krueppel associated box (KRAB) repressor domain + linker
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccggcggttccggcggagggtcgatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccc

SEQ ID NO: 4 - DNA, 4995 bp, Artificial Sequence
  synthetic dCas9-10xGCN4 fusion protein, dCAS9 domain fused to GCN4 epitope fusion domain
  misc_feature (1)..(4104): human codon optimized nuclease deficient small guide RNA (sgRNA)-mediated nuclease (dCas9) domain from Streptococcus pyogenes version 2
  misc_feature (4105)..(4275): linker + 2 Simian virus 40 nuclear localization signal (SV40 NLS) sequences + human influenza hemagglutinin (HA) tag
  misc_feature (4276)..(4995): 10xGCN4 transcriptional activator protein General Control Nonderepressible 4 (GCN4) epitope fusion domain
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccggcgccatcatacacgcggccgcaacaagcggtccggaagaacttttgagcaagaattatcatcttgagaacgaagtggctcgtcttaagaaaggttctggcagtggagaagaactgctttcaaagaattaccacctggaaaatgaggtagctagactgaaaaaggggagcggaagtggggaggagttgctgagcaaaaattatcatttggagaacgaagtagcacgactaaagaaagggtccggatcgggtgaggagttactctcgaaaaattatcatctcgaaaacgaagtggctcggctaaaaaagggcagtggttctggagaagagctattatctaaaaactaccacctcgaaaatgaggtggcacgcttaaaaaagggaagtggcagtggtgaagagctactatccaagaattatcatcttgagaacgaggtagcgcgtttgaagaagggttccggctcaggagaggaactgctctcgaagaactatcatcttgaaaatgaggtcgctcgattaaaaaagggatcgggcagtggtgaggaactactttcaaagaattaccacctcgaaaacgaagtagctcgattaaagaaaggttcagggtcgggtgaagaattactgagtaaaaattatcatctggaaaatgaggtagcgagactaaaaaaggggagtggttctggcgaggaattgctatcgaaaaattatcatcttgagaacgaagttgctaggctcaaaaagggctcaggctcaggc

SEQ ID NO: 5 - DNA, 858 bp, Artificial Sequence
  synthetic scFVGCN4, anti-GNC4 scFv domain, anti-transcriptional activator protein General Control Nonderepressible 4 (GCN4) epitope fusion domain monoclonal antibody single chain Fv
atgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagcttggatccaggtggaggtggaagcggt

SEQ ID NO: 6 - RNA, 183 nt, Artificial Sequence
  synthetic small guide RNA (sgRNA) with target specific binding region complementary to target genetic element
  modified_base (1)..(5): n = g, a, c or t
  misc_feature (1)..(100): n is a, c, g, or u
  modified_base (6)..(100): n = g, a, c or t, may be present or absent
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnguuuuagagcuagaaauagcaaguuaaaauaaggcuaguccguuaucaacuugaaaaaguggcaccgagucggugcuuuuuuu

SEQ ID NO: 7 - RNA, 183 nt, Artificial Sequence
  synthetic optimized small guide RNA (sgRNA) containing an A-U flip with target specific binding region complementary to target genetic element
  modified_base (1)..(5): n = g, a, c or t
  misc_feature (1)..(100): n is a, c, g, or u
  modified_base (6)..(100): n = g, a, c or t , may be present or absent
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnguuuaagagcuagaaauagcaaguuuaaauaaggcuaguccguuaucaacuugaaaaaguggcaccgagucggugcuuuuuuu

SEQ ID NO: 8 - RNA, 193 nt, Artificial Sequence
  synthetic small guide RNA (sgRNA) containing optimized 5' stem-loop structure with target specific binding region complementary to target genetic element
  modified_base (1)..(5): n = g, a, c or t
  misc_feature (1)..(100): n is a, c, g, or u
  modified_base (6)..(100): n = g, a, c, or t, may be present or absent
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnguuuuagagcuaugcuggaaacagcauagcaaguuaaaauaaggcuaguccguuaucaacuugaaaaaguggcaccgagucggugcuuuuuuu

SEQ ID NO: 9 - RNA, 193 nt, Artificial Sequence
  synthetic optimized small guide RNA (sgRNA) containing an A-U flip and elongated 5' stem-loop structure with target specific binding region complementary to target genetic element
  modified_base (1)..(5): n = g, a, c or t
  misc_feature (1)..(100): n is a, c, g, or u
  modified_base (6)..(100): n = g, a, c or t, may be present or absent
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnguuuaagagcuaugcuggaaacagcauagcaaguuuaaauaaggcuaguccguuaucaacuugaaaaaguggcaccgagucggugcuuuuuuu

SEQ ID NO: 10 - RNA, 193 nt, Artificial Sequence
  synthetic small guide RNA (sgRNA) containing unique endonuclease site, 1 bp bulge and elongated stem portion of 5' stem-loop structure with target specific binding region complementary to target genetic element
  modified_base (1)..(5): n = g, a, c or t
  misc_feature (1)..(100): n is a, c, g, or u
  modified_base (6)..(100): n = g, a, c or t, may be present or absent
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnguuuaagagcuaagcuggaaacagcauagcaaguuuaaauaaggcuaguccguuaucaacuugaaaaaguggcaccgagucggugcuuuuuuu

SEQ ID NO: 11 - RNA, 114 nt, Artificial Sequence
  synthetic small guide RNA (sgRNA) containing unique endonuclease site, 1 bp bulge and elongated stem portion of 5' stem-loop structure with minimal target specific binding region complementary to target genetic element
  modified_base (1)..(19): n = g, a, c or t
  misc_feature (1)..(21): n is a, c, g, or u
  modified_base (20)..(21): n = g, a, c or t, may be present or absent
nnnnnnnnnnnnnnnnnnnnnguuuaagagcuaagcuggaaacagcauagcaaguuuaaauaaggcuaguccguuaucaacuugaaaaaguggcaccgagucggugcuuuuuuu

SEQ ID NO: 12 - DNA, 4545 bp, Artificial Sequence
  synthetic dCas9-CSD fusion protein, dCas9 domain fused to chromoshadow repressor domain
  misc_feature (1)..(4104): human codon optimized nuclease deficient small guide RNA (sgRNA)-mediated nuclease (dCas9) domain from Streptococcus pyogenes version 2
  misc_feature (4105)..(4260): linker + 2 Simian virus 40 nuclear localization signal (SV40 NLS) sequences + human influenza hemagglutinin (HA) tag
  misc_feature (4261)..(4545): chromoshadow domain (CSD) + linker
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccggcggttccggcggagggtcgagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagc

SEQ ID NO: 13 - DNA, 1824 bp, Artificial Sequence
  synthetic scFVGCN4-sfGFP-VP64 fusion protein, anti-GCN4 affinity domain fused to VP64 domain, transcriptional modulator domain
  misc_feature (1)..(858): scFVGCN4, anti-GNC4 scFv domain, transcriptional activator protein General Control Nonderepressible 4 (GCN4) epitope fusion domain monoclonal antibody single chain Fv
  misc_feature (859)..(1569): superfolder Aequorea victoria green-fluorescent protein (GFP) (sfGFP)
  misc_feature (1570)..(1824): linker + 2 Simian virus 40 nuclear localization signal (SV40 NLS) sequences + herpes simplex viral protein 16 (VP16) transactivational domain tetrameric repeat connected with glycine-serine linkers (VP64)
atgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagcttggatccaggtggaggtggaagcggtagcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaaggtggaggtcggaccgaaggcagcggctcccccaagaaaaaacgcaaggtggaagatcctaagaaaaagcggaaagtgggcggttccggcggagggtcggatgctttagacgattttgacttagatatgcttggttcagacgcgttagacgacttcgacctagacatgttaggctcagatgcattggacgacttcgatttagatatgttgggctccgatgccctagatgactttgatctagatatgctaggtagt

SEQ ID NO: 14 - DNA, 5055 bp, Artificial Sequence
  synthetic dCas9-VP64-BFP fusion protein, dCas9 domain fused to chromoshadow repressor domain and blue fluorescent protein
  misc_feature (1)..(4104): human codon optimized nuclease deficient small guide RNA (sgRNA)-mediated nuclease (dCas9) domain from Streptococcus pyogenes version 2
  misc_feature (4105)..(4359): herpes simplex viral protein 16 (VP16) transactivational domain tetrameric repeat connected with glycine-serine linkers (VP64) + 3 Simian virus 40 nuclear localization signal (SV40 NLS) sequences
  misc_feature (4360)..(5055): recombinant blue fluorescent protein (BFP)
atggacaagaagtattctatcggactggccatcgggactaatagcgtcgggtgggccgtgatcactgacgagtacaaggtgccctctaagaagttcaaggtgctcgggaacaccgaccggcattccatcaagaaaaatctgatcggagctctcctctttgattcaggggagaccgctgaagcaacccgcctcaagcggactgctagacggcggtacaccaggaggaagaaccggatttgttaccttcaagagatattctccaacgaaatggcaaaggtcgacgacagcttcttccataggctggaagaatcattcctcgtggaagaggataagaagcatgaacggcatcccatcttcggtaatatcgtcgacgaggtggcctatcacgagaaatacccaaccatctaccatcttcgcaaaaagctggtggactcaaccgacaaggcagacctccggcttatctacctggccctggcccacatgatcaagttcagaggccacttcctgatcgagggcgacctcaatcctgacaatagcgatgtggataaactgttcatccagctggtgcagacttacaaccagctctttgaagagaaccccatcaatgcaagcggagtcgatgccaaggccattctgtcagcccggctgtcaaagagccgcagacttgagaatcttatcgctcagctgccgggtgaaaagaaaaatggactgttcgggaacctgattgctctttcacttgggctgactcccaatttcaagtctaatttcgacctggcagaggatgccaagctgcaactgtccaaggacacctatgatgacgatctcgacaacctcctggcccagatcggtgaccaatacgccgaccttttccttgctgctaagaatctttctgacgccatcctgctgtctgacattctccgcgtgaacactgaaatcaccaaggcccctctttcagcttcaatgattaagcggtatgatgagcaccaccaggacctgaccctgcttaaggcactcgtccggcagcagcttccggagaagtacaaggaaatcttctttgaccagtcaaagaatggatacgccggctacatcgacggaggtgcctcccaagaggaattttataagtttatcaaacctatccttgagaagatggacggcaccgaagagctcctcgtgaaactgaatcgggaggatctgctgcggaagcagcgcactttcgacaatgggagcattccccaccagatccatcttggggagcttcacgccatccttcggcgccaagaggacttctacccctttcttaaggacaacagggagaagattgagaaaattctcactttccgcatcccctactacgtgggacccctcgccagaggaaatagccggtttgcttggatgaccagaaagtcagaagaaactatcactccctggaacttcgaagaggtggtggacaagggagccagcgctcagtcattcatcgaacggatgactaacttcgataagaacctccccaatgagaaggtcctgccgaaacattccctgctctacgagtactttaccgtgtacaacgagctgaccaaggtgaaatatgtcaccgaagggatgaggaagcccgcattcctgtcaggcgaacaaaagaaggcaattgtggaccttctgttcaagaccaatagaaaggtgaccgtgaagcagctgaaggaggactatttcaagaaaattgaatgcttcgactctgtggagattagcggggtcgaagatcggttcaacgcaagcctgggtacctaccatgatctgcttaagatcatcaaggacaaggattttctggacaatgaggagaacgaggacatccttgaggacattgtcctgactctcactctgttcgaggaccgggaaatgatcgaggagaggcttaagacctacgcccatctgttcgacgataaagtgatgaagcaacttaaacggagaagatataccggatggggacgccttagccgcaaactcatcaacggaatccgggacaaacagagcggaaagaccattcttgatttccttaagagcgacggattcgctaatcgcaacttcatgcaacttatccatgatgattccctgacctttaaggaggacatccagaaggcccaagtgtctggacaaggtgactcactgcacgagcatatcgcaaatctggctggttcacccgctattaagaagggtattctccagaccgtgaaagtcgtggacgagctggtcaaggtgatgggtcgccataaaccagagaacattgtcatcgagatggccagggaaaaccagactacccagaagggacagaagaacagcagggagcggatgaaaagaattgaggaagggattaaggagctcgggtcacagatccttaaagagcacccggtggaaaacacccagcttcagaatgagaagctctatctgtactaccttcaaaatggacgcgatatgtatgtggaccaagagcttgatatcaacaggctctcagactacgacgtggacgccatcgtccctcagagcttcctcaaagacgactcaattgacaataaggtgctgactcgctcagacaagaaccggggaaagtcagataacgtgccctcagaggaagtcgtgaaaaagatgaagaactattggcgccagcttctgaacgcaaagctgatcactcagcggaagttcgacaatctcactaaggctgagaggggcggactgagcgaactggacaaagcaggattcattaaacggcaacttgtggagactcggcagattactaaacatgtcgcccaaatccttgactcacgcatgaataccaagtacgacgaaaacgacaaacttatccgcgaggtgaaggtgattaccctgaagtccaagctggtcagcgatttcagaaaggactttcaattctacaaagtgcgggagatcaataactatcatcatgctcatgacgcatatctgaatgccgtggtgggaaccgccctgatcaagaagtacccaaagctggaaagcgagttcgtgtacggagactacaaggtctacgacgtgcgcaagatgattgccaaatctgagcaggagatcggaaaggccaccgcaaagtacttcttctacagcaacatcatgaatttcttcaagaccgaaatcacccttgcaaacggtgagatccggaagaggccgctcatcgagactaatggggagactggcgaaatcgtgtgggacaagggcagagatttcgctaccgtgcgcaaagtgctttctatgcctcaagtgaacatcgtgaagaaaaccgaggtgcaaaccggaggcttttctaaggaatcaatcctccccaagcgcaactccgacaagctcattgcaaggaagaaggattgggaccctaagaagtacggcggattcgattcaccaactgtggcttattctgtcctggtcgtggctaaggtggaaaaaggaaagtctaagaagctcaagagcgtgaaggaactgctgggtatcaccattatggagcgcagctccttcgagaagaacccaattgactttctcgaagccaaaggttacaaggaagtcaagaaggaccttatcatcaagctcccaaagtatagcctgttcgaactggagaatgggcggaagcggatgctcgcctccgctggcgaacttcagaagggtaatgagctggctctcccctccaagtacgtgaatttcctctaccttgcaagccattacgagaagctgaaggggagccccgaggacaacgagcaaaagcaactgtttgtggagcagcataagcattatctggacgagatcattgagcagatttccgagttttctaaacgcgtcattctcgctgatgccaacctcgataaagtccttagcgcatacaataagcacagagacaaaccaattcgggagcaggctgagaatatcatccacctgttcaccctcaccaatcttggtgcccctgccgcattcaagtacttcgacaccaccatcgaccggaaacgctatacctccaccaaagaagtgctggacgccaccctcatccaccagagcatcaccggactttacgaaactcggattgacctctcacagctcggaggggatgagggagctcccaagaaaaagcgcaaggtaggtagttccggatctccgaaaaagaaacgcaaagttggtagtgatgctttagacgattttgacttagatatgcttggttcagacgcgttagacgacttcgacctagacatgttaggctcagatgcattggacgacttcgatttagatatgttgggctccgatgccctagatgactttgatctagatatgctaggtagtcccaaaaagaagaggaaagtgggatctagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaat

SEQ ID NO: 15 - DNA, 5673 bp, Artificial Sequence
  synthetic dCas9-p65AD-BFP fusion protein
  misc_feature (1)..(4104): human codon optimized nuclease deficient small guide RNA (sgRNA)-mediated nuclease (dCas9) domain from Streptococcus pyogenes version 2
  misc_feature (4105)..(4977): human NfkappaB p65 subunit transcriptional activation domain (p65AD) + linker + 2 Simian virus 40 nuclear localization signal (SV40 NLS) sequences
  misc_feature (4978)..(5673): recombinant blue fluorescent protein (BFP)
atggacaagaagtattctatcggactggccatcgggactaatagcgtcgggtgggccgtgatcactgacgagtacaaggtgccctctaagaagttcaaggtgctcgggaacaccgaccggcattccatcaagaaaaatctgatcggagctctcctctttgattcaggggagaccgctgaagcaacccgcctcaagcggactgctagacggcggtacaccaggaggaagaaccggatttgttaccttcaagagatattctccaacgaaatggcaaaggtcgacgacagcttcttccataggctggaagaatcattcctcgtggaagaggataagaagcatgaacggcatcccatcttcggtaatatcgtcgacgaggtggcctatcacgagaaatacccaaccatctaccatcttcgcaaaaagctggtggactcaaccgacaaggcagacctccggcttatctacctggccctggcccacatgatcaagttcagaggccacttcctgatcgagggcgacctcaatcctgacaatagcgatgtggataaactgttcatccagctggtgcagacttacaaccagctctttgaagagaaccccatcaatgcaagcggagtcgatgccaaggccattctgtcagcccggctgtcaaagagccgcagacttgagaatcttatcgctcagctgccgggtgaaaagaaaaatggactgttcgggaacctgattgctctttcacttgggctgactcccaatttcaagtctaatttcgacctggcagaggatgccaagctgcaactgtccaaggacacctatgatgacgatctcgacaacctcctggcccagatcggtgaccaatacgccgaccttttccttgctgctaagaatctttctgacgccatcctgctgtctgacattctccgcgtgaacactgaaatcaccaaggcccctctttcagcttcaatgattaagcggtatgatgagcaccaccaggacctgaccctgcttaaggcactcgtccggcagcagcttccggagaagtacaaggaaatcttctttgaccagtcaaagaatggatacgccggctacatcgacggaggtgcctcccaagaggaattttataagtttatcaaacctatccttgagaagatggacggcaccgaagagctcctcgtgaaactgaatcgggaggatctgctgcggaagcagcgcactttcgacaatgggagcattccccaccagatccatcttggggagcttcacgccatccttcggcgccaagaggacttctacccctttcttaaggacaacagggagaagattgagaaaattctcactttccgcatcccctactacgtgggacccctcgccagaggaaatagccggtttgcttggatgaccagaaagtcagaagaaactatcactccctggaacttcgaagaggtggtggacaagggagccagcgctcagtcattcatcgaacggatgactaacttcgataagaacctccccaatgagaaggtcctgccgaaacattccctgctctacgagtactttaccgtgtacaacgagctgaccaaggtgaaatatgtcaccgaagggatgaggaagcccgcattcctgtcaggcgaacaaaagaaggcaattgtggaccttctgttcaagaccaatagaaaggtgaccgtgaagcagctgaaggaggactatttcaagaaaattgaatgcttcgactctgtggagattagcggggtcgaagatcggttcaacgcaagcctgggtacctaccatgatctgcttaagatcatcaaggacaaggattttctggacaatgaggagaacgaggacatccttgaggacattgtcctgactctcactctgttcgaggaccgggaaatgatcgaggagaggcttaagacctacgcccatctgttcgacgataaagtgatgaagcaacttaaacggagaagatataccggatggggacgccttagccgcaaactcatcaacggaatccgggacaaacagagcggaaagaccattcttgatttccttaagagcgacggattcgctaatcgcaacttcatgcaacttatccatgatgattccctgacctttaaggaggacatccagaaggcccaagtgtctggacaaggtgactcactgcacgagcatatcgcaaatctggctggttcacccgctattaagaagggtattctccagaccgtgaaagtcgtggacgagctggtcaaggtgatgggtcgccataaaccagagaacattgtcatcgagatggccagggaaaaccagactacccagaagggacagaagaacagcagggagcggatgaaaagaattgaggaagggattaaggagctcgggtcacagatccttaaagagcacccggtggaaaacacccagcttcagaatgagaagctctatctgtactaccttcaaaatggacgcgatatgtatgtggaccaagagcttgatatcaacaggctctcagactacgacgtggacgccatcgtccctcagagcttcctcaaagacgactcaattgacaataaggtgctgactcgctcagacaagaaccggggaaagtcagataacgtgccctcagaggaagtcgtgaaaaagatgaagaactattggcgccagcttctgaacgcaaagctgatcactcagcggaagttcgacaatctcactaaggctgagaggggcggactgagcgaactggacaaagcaggattcattaaacggcaacttgtggagactcggcagattactaaacatgtcgcccaaatccttgactcacgcatgaataccaagtacgacgaaaacgacaaacttatccgcgaggtgaaggtgattaccctgaagtccaagctggtcagcgatttcagaaaggactttcaattctacaaagtgcgggagatcaataactatcatcatgctcatgacgcatatctgaatgccgtggtgggaaccgccctgatcaagaagtacccaaagctggaaagcgagttcgtgtacggagactacaaggtctacgacgtgcgcaagatgattgccaaatctgagcaggagatcggaaaggccaccgcaaagtacttcttctacagcaacatcatgaatttcttcaagaccgaaatcacccttgcaaacggtgagatccggaagaggccgctcatcgagactaatggggagactggcgaaatcgtgtgggacaagggcagagatttcgctaccgtgcgcaaagtgctttctatgcctcaagtgaacatcgtgaagaaaaccgaggtgcaaaccggaggcttttctaaggaatcaatcctccccaagcgcaactccgacaagctcattgcaaggaagaaggattgggaccctaagaagtacggcggattcgattcaccaactgtggcttattctgtcctggtcgtggctaaggtggaaaaaggaaagtctaagaagctcaagagcgtgaaggaactgctgggtatcaccattatggagcgcagctccttcgagaagaacccaattgactttctcgaagccaaaggttacaaggaagtcaagaaggaccttatcatcaagctcccaaagtatagcctgttcgaactggagaatgggcggaagcggatgctcgcctccgctggcgaacttcagaagggtaatgagctggctctcccctccaagtacgtgaatttcctctaccttgcaagccattacgagaagctgaaggggagccccgaggacaacgagcaaaagcaactgtttgtggagcagcataagcattatctggacgagatcattgagcagatttccgagttttctaaacgcgtcattctcgctgatgccaacctcgataaagtccttagcgcatacaataagcacagagacaaaccaattcgggagcaggctgagaatatcatccacctgttcaccctcaccaatcttggtgcccctgccgcattcaagtacttcgacaccaccatcgaccggaaacgctatacctccaccaaagaagtgctggacgccaccctcatccaccagagcatcaccggactttacgaaactcggattgacctctcacagctcggaggggatgagggagctcccaagaaaaagcgcaaggtaggtagttccggatctccgaaaaagaaacgcaaagttggtagtcagtatctgcccgacacagatgatagacaccgaatcgaagagaaacgcaagcgaacgtatgaaaccttcaaatcgatcatgaagaaatcgcccttctcgggtccgaccgatcccaggcccccaccgagaaggattgcggtcccgtcccgctcgtcggccagcgtgccgaagcctgcgccgcagccctaccccttcacgtcgagcctgagcacaatcaattatgacgagttcccgacgatggtgttcccctcgggacaaatctcacaagcctcggcgctcgcaccagcgcctccccaagtccttccgcaagcgcctgccccagcgcctgcaccggcaatggtgtccgccctcgcacaggcccctgcgcccgtccccgtgctcgcgcctggaccgccccaggcggtcgctccaccggctccgaagccgacgcaggccggagagggaacactctccgaagcacttcttcaactccagtttgatgacgaggatcttggagcactccttggaaactcgacagaccctgcggtgtttaccgacctcgcgtcagtagataactccgaatttcagcagcttttgaaccagggtatcccggtcgcgccacatacaacggagcccatgttgatggaataccccgaagcaatcacgagacttgtgacgggagcgcagcggcctcccgatcccgcacccgcacctttgggggcacctggcctccctaacggacttttgagcggcgacgaggatttctcctccatcgccgatatggatttctcagccttgctgtcacagatttccagcggatctagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaat

SEQ ID NO: 16 - DNA, 4935 bp, Artificial Sequence
  synthetic dCas9-BFP fusion protein
  misc_feature (1)..(4104): human codon optimized nuclease deficient small guide RNA (sgRNA)-mediated nuclease (dCas9) domain from Streptococcus pyogenes version 2
  misc_feature (4105)..(4239): linker + 2 Simian virus 40 nuclear localization signal (SV40 NLS) sequences + human influenza hemagglutinin (HA) tag
  misc_feature (4240)..(4935): recombinant blue fluorescent protein (BFP)
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaat

SEQ ID NO: 17 - DNA, 5007 bp, Artificial Sequence
  synthetic dCas9-P2A-mCherry fusion protein
  misc_feature (1)..(4104): human codon optimized nuclease deficient small guide RNA (sgRNA)-mediated nuclease (dCas9) domain from Streptococcus pyogenes version 2
  misc_feature (4105)..(4296): linker + 2 Simian virus 40 nuclear localization signal (SV40 NLS) sequences + human influenza hemagglutinin (HA) tag + Zea mays 60S acidic ribosomal protein P2A (RPP2A, RPP2)
  misc_feature (4297)..(5007): mCherry monomeric red fluorescent protein derived from Discosoma sp. red fluorescent protein (RFP)
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccgctactaacttcagcctgctgaagcaggctggagacgtggaggagaaccctggacctatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggcggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 18 - DNA, 5172 bp, Artificial Sequence
  synthetic dCas9-BFP-KRAB fusion protein
  misc_feature (1)..(4104): human codon optimized nuclease deficient small guide RNA (sgRNA)-mediated nuclease (dCas9) domain from Streptococcus pyogenes version 2
  misc_feature (4105)..(4239): linker + 2 Simian virus 40 nuclear localization signal (SV40 NLS) sequences + human influenza hemagglutinin (HA) tag
  misc_feature (4240)..(4935): recombinant blue fluorescent protein (BFP)
  misc_feature (4936)..(5172): Krueppel associated box (KRAB) repressor domain + linker
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccagcgagctgattaaggagaacatgcacatgaagctgtacatggagggcaccgtggacaaccatcacttcaagtgcacatccgagggcgaaggcaagccctacgagggcacccagaccatgagaatcaaggtggtcgagggcggccctctccccttcgccttcgacatcctggctactagcttcctctacggcagcaagaccttcatcaaccacacccagggcatccccgacttcttcaagcagtccttccctgagggcttcacatgggagagagtcaccacatacgaagacgggggcgtgctgaccgctacccaggacaccagcctccaggacggctgcctcatctacaacgtcaagatcagaggggtgaacttcacatccaacggccctgtgatgcagaagaaaacactcggctgggaggccttcaccgagacgctgtaccccgctgacggcggcctggaaggcagaaacgacatggccctgaagctcgtgggcgggagccatctgatcgcaaacatcaagaccacatatagatccaagaaacccgctaagaacctcaagatgcctggcgtctactatgtggactacagactggaaagaatcaaggaggccaacaacgagacctacgtcgagcagcacgaggtggcagtggccagatactgcgacctccctagcaaactggggcacaagcttaatggcggtggcggagggatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctagtaa

SEQ ID NO: 19 - DNA, 5253 bp, Artificial Sequence
  synthetic dCas9-KRAB-P2A-mCherry fusion protein
  misc_feature (1)..(4104): human codon optimized nuclease deficient small guide RNA (sgRNA)-mediated nuclease (dCas9) domain from Streptococcus pyogenes version 2
  misc_feature (4105)..(4239): linker + 2 Simian virus 40 nuclear localization signal (SV40 NLS) sequences + human influenza hemagglutinin (HA) tag
  misc_feature (4240)..(4476): Krueppel associated box (KRAB) repressor domain + linker
  misc_feature (4477)..(5253): Zea mays 60S acidic ribosomal protein P2A (RPP2A, RPP2) + mCherry monomeric red fluorescent protein derived from Discosoma sp. red fluorescent protein (RFP)
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccggcggttccggcggagggtcgatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggaagcggagctactaacttcagcctgctgaagcaggctggagacgtggaggagaaccctggacctatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 20 - DNA, 5244 bp, Artificial Sequence
  synthetic KRAB-dCas9-P2A-mCherry fusion protein
  misc_feature (1)..(237): Krueppel associated box (KRAB) repressor domain + linker
  misc_feature (238)..(4341): human codon optimized nuclease deficient small guide RNA (sgRNA)-mediated nuclease (dCas9) domain from Streptococcus pyogenes version 2
  misc_feature (4342)..(4476): linker + 2 Simian virus 40 nuclear localization signal (SV40 NLS) sequences
  misc_feature (4477)..(5244): Zea mays 60S acidic ribosomal protein P2A (RPP2A, RPP2) + mCherry monomeric red fluorescent protein derived from Discosoma sp. red fluorescent protein (RFP)
atggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggcggttccggcggagggtcgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccgctactaacttcagcctgctgaagcaggctggagacgtggaggagaaccctggacctatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 21 - DNA, 5313 bp, Artificial Sequence
  synthetic dCas9-CSD-P2A-mCherry fusion protein
  misc_feature (1)..(4104): human codon optimized nuclease deficient small guide RNA (sgRNA)-mediated nuclease (dCas9) domain from Streptococcus pyogenes version 2
  misc_feature (4105)..(4260): linker + 2 Simian virus 40 nuclear localization signal (SV40 NLS) sequences + human influenza hemagglutinin (HA) tag
  misc_feature (4261)..(4545): chromoshadow domain (CSD) + linker
  misc_feature (4546)..(5313): Zea mays 60S acidic ribosomal protein P2A (RPP2A, RPP2) + mCherry monomeric red fluorescent protein derived from Discosoma sp. red fluorescent protein (RFP)
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccggcggttccggcggagggtcgagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagcgctactaacttcagcctgctgaagcaggctggagacgtggaggagaaccctggacctatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 22 - DNA, 5316 bp, Artificial Sequence
  synthetic CSD-dCas9-P2A-mCherry fusion protein
  misc_feature (1)..(309): chromoshadow domain (CSD) + linker
  misc_feature (310)..(4413): human codon optimized nuclease deficient small guide RNA (sgRNA)-mediated nuclease (dCas9) domain from Streptococcus pyogenes version 2
  misc_feature (4414)..(4548): linker + 2 Simian virus 40 nuclear localization signal (SV40 NLS) sequences + human influenza hemagglutinin (HA) tag
  misc_feature (4549)..(5316): Zea mays 60S acidic ribosomal protein P2A (RPP2A, RPP2) + mCherry monomeric red fluorescent protein derived from Discosoma sp. red fluorescent protein (RFP)
atgagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagcggcggttccggcggagggtcgatggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccgctactaacttcagcctgctgaagcaggctggagacgtggaggagaaccctggacctatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 23 - DNA, 5781 bp, Artificial Sequence
  synthetic dCas9-10xGCN4-P2A-mCherry fusion protein
  misc_feature (1)..(4104): human codon optimized nuclease deficient small guide RNA (sgRNA)-mediated nuclease (dCas9) domain from Streptococcus pyogenes version 2
  misc_feature (4105)..(4275): linker + 2 Simian virus 40 nuclear localization signal (SV40 NLS) sequences + human influenza hemagglutinin (HA) tag
  misc_feature (4276)..(4995): 10xGCN4 transcriptional activator protein General Control Nonderepressible 4 epitope fusion domain
  misc_feature (4996)..(5781): Zea mays 60S acidic ribosomal protein P2A (RPP2A, RPP2) + mCherry monomeric red fluorescent protein derived from Discosoma sp. red fluorescent protein (RFP)
atggacaagaagtacagcatcggcctggccatcggcaccaactctgtgggctgggccgtgatcaccgacgagtacaaggtgcccagcaagaaattcaaggtgctgggcaacaccgaccggcacagcatcaagaagaacctgatcggcgccctgctgttcgacagcggagaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacatcgatggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgccagcgcccagagcttcatcgagcggatgaccaacttcgataagaacctgcccaacgagaaggtgctgcccaagcacagcctgctgtacgagtacttcaccgtgtacaacgagctgaccaaagtgaaatacgtgaccgagggaatgagaaagcccgccttcctgagcggcgagcagaaaaaagccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgaaatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgctatcgtgcctcagagctttctgaaggacgactccatcgataacaaagtgctgactcggagcgacaagaaccggggcaagagcgacaacgtgccctccgaagaggtcgtgaagaagatgaagaactactggcgccagctgctgaatgccaagctgattacccagaggaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaacgacaaactgatccgggaagtgaaagtgatcaccctgaagtccaagctggtgtccgatttccggaaggatttccagttttacaaagtgcgcgagatcaacaactaccaccacgcccacgacgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaacaggcgagatcgtgtgggataagggccgggactttgccaccgtgcggaaagtgctgtctatgccccaagtgaatatcgtgaaaaagaccgaggtgcagacaggcggcttcagcaaagagtctatcctgcccaagaggaacagcgacaagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaaacactacctggacgagatcatcgagcagatcagcgagttctccaagagagtgatcctggccgacgctaatctggacaaggtgctgagcgcctacaacaagcacagagacaagcctatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgacgcctatccctatgacgtgcccgattatgccagcctgggcagcggctcccccaagaaaaaacgcaaggtggaagatcctaagaaaaagcggaaagtggacggcattggtagtgggagcaacggcagcagcggatccggcgccatcatacacgcggccgcaacaagcggtccggaagaacttttgagcaagaattatcatcttgagaacgaagtggctcgtcttaagaaaggttctggcagtggagaagaactgctttcaaagaattaccacctggaaaatgaggtagctagactgaaaaaggggagcggaagtggggaggagttgctgagcaaaaattatcatttggagaacgaagtagcacgactaaagaaagggtccggatcgggtgaggagttactctcgaaaaattatcatctcgaaaacgaagtggctcggctaaaaaagggcagtggttctggagaagagctattatctaaaaactaccacctcgaaaatgaggtggcacgcttaaaaaagggaagtggcagtggtgaagagctactatccaagaattatcatcttgagaacgaggtagcgcgtttgaagaagggttccggctcaggagaggaactgctctcgaagaactatcatcttgaaaatgaggtcgctcgattaaaaaagggatcgggcagtggtgaggaactactttcaaagaattaccacctcgaaaacgaagtagctcgattaaagaaaggttcagggtcgggtgaagaattactgagtaaaaattatcatctggaaaatgaggtagcgagactaaaaaaggggagtggttctggcgaggaattgctatcgaaaaattatcatcttgagaacgaagttgctaggctcaaaaagggctcaggctcaggcaaaggtccgggaagcggagctactaacttcagcctgctgaagcaggctggagacgtggaggagaaccctggacctatggtgagcaagggcgaggaggataacatggccatcatcaaggagttcatgcgcttcaaggtgcacatggagggctccgtgaacggccacgagttcgagatcgagggcgagggcgagggccgcccctacgagggcacccagaccgccaagctgaaggtgaccaagggtggccccctgcccttcgcctgggacatcctgtcccctcagttcatgtacggctccaaggcctacgtgaagcaccccgccgacatccccgactacttgaagctgtccttccccgagggcttcaagtgggagcgcgtgatgaacttcgaggacggcggcgtggtgaccgtgacccaggactcctccctgcaggacggcgagttcatctacaaggtgaagctgcgcggcaccaacttcccctccgacggccccgtaatgcagaagaagaccatgggctgggaggcctcctccgagcggatgtaccccgaggacggcgccctgaagggcgagatcaagcagaggctgaagctgaaggacggcggccactacgacgctgaggtcaagaccacctacaaggccaagaagcccgtgcagctgcccggcgcctacaacgtcaacatcaagttggacatcacctcccacaacgaggactacaccatcgtggaacagtacgaacgcgccgagggccgccactccaccggcggcatggacgagctgtacaagtaa

SEQ ID NO: 24 - DNA, 2070 bp, Artificial Sequence
  synthetic scFVGCN4-sfGFP-GB1-KRAB fusion protein
  misc_feature (1)..(858): scFVGCN4, anti-GNC4 scFv domain, transcriptional activator protein General Control Nonderepressible 4 (GCN4) epitope fusion domain monoclonal antibody single chain Fv
  misc_feature (859)..(1569): superfolder Aequorea victoria green-fluorescent protein (GFP) (sfGFP)
  misc_feature (1570)..(1830): Streptococcal protein G B1 domain
  misc_feature (1831)..(2070): Krueppel associated box (KRAB) repressor domain + linker
atgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagcttggatccaggtggaggtggaagcggtagcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaaggtggaggtcggaccgaagagtacaagcttatcctgaacggtaaaaccctgaaaggtgaaaccaccaccgaagctgttgacgctgctaccgcggaaaaagttttcaaacagtacgctaacgacaacggtgttgacggtgaatggacctacgacgacgctaccaaaaccttcacggtaaccgaaggtggaggtcggaccgaaggcagcggctcccccaagaaaaaacgcaaggtggaagatcctaagaaaaagcggaaagtgggcggttccggcggagggtcgatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctaa

SEQ ID NO: 25 - DNA, 2139 bp, Artificial Sequence
  synthetic scFVGCN4-sfGFP-GB1-CSD fusion protein
  misc_feature (1)..(858): scFVGCN4, anti-GNC4 scFv domain, transcriptional activator protein General Control Nonderepressible 4 (GCN4) epitope fusion domain monoclonal antibody single chain Fv
  misc_feature (859)..(1569): superfolder Aequorea victoria green-fluorescent protein (GFP) (sfGFP)
  misc_feature (1570)..(1830): Streptococcal protein G B1 domain
  misc_feature (1831)..(2139): chromoshadow domain (CSD) + linker
atgggccccgacatcgtgatgacccagagccccagcagcctgagcgccagcgtgggcgaccgcgtgaccatcacctgccgcagcagcaccggcgccgtgaccaccagcaactacgccagctgggtgcaggagaagcccggcaagctgttcaagggcctgatcggcggcaccaacaaccgcgcccccggcgtgcccagccgcttcagcggcagcctgatcggcgacaaggccaccctgaccatcagcagcctgcagcccgaggacttcgccacctacttctgcgccctgtggtacagcaaccactgggtgttcggccagggcaccaaggtggagctgaagcgcggcggcggcggcagcggcggcggcggcagcggcggcggcggcagcagcggcggcggcagcgaggtgaagctgctggagagcggcggcggcctggtgcagcccggcggcagcctgaagctgagctgcgccgtgagcggcttcagcctgaccgactacggcgtgaactgggtgcgccaggcccccggccgcggcctggagtggatcggcgtgatctggggcgacggcatcaccgactacaacagcgccctgaaggaccgcttcatcatcagcaaggacaacggcaagaacaccgtgtacctgcagatgagcaaggtgcgcagcgacgacaccgccctgtactactgcgtgaccggcctgttcgactactggggccagggcaccctggtgaccgtgagcagctacccatacgatgttccagattacgctggtggaggcggaggttctgggggaggaggtagtggcggtggtggttcaggaggcggcggaagcttggatccaggtggaggtggaagcggtagcaaaggagaagaacttttcactggagttgtcccaattcttgttgaattagatggtgatgttaatgggcacaaattttctgtccgtggagagggtgaaggtgatgctacaaacggaaaactcacccttaaatttatttgcactactggaaaactacctgttccgtggccaacacttgtcactactctgacctatggtgttcaatgcttttcccgttatccggatcacatgaaacggcatgactttttcaagagtgccatgcccgaaggttatgtacaggaacgcactatatctttcaaagatgacgggacctacaagacgcgtgctgaagtcaagtttgaaggtgatacccttgttaatcgtatcgagttaaagggtattgattttaaagaagatggaaacattcttggacacaaactcgagtacaactttaactcacacaatgtatacatcacggcagacaaacaaaagaatggaatcaaagctaacttcaaaattcgccacaacgttgaagatggttccgttcaactagcagaccattatcaacaaaatactccaattggcgatggccctgtccttttaccagacaaccattacctgtcgacacaatctgtcctttcgaaagatcccaacgaaaagcgtgaccacatggtccttcttgagtttgtaactgctgctgggattacacatggcatggatgagctctacaaaggtggaggtcggaccgaagagtacaagcttatcctgaacggtaaaaccctgaaaggtgaaaccaccaccgaagctgttgacgctgctaccgcggaaaaagttttcaaacagtacgctaacgacaacggtgttgacggtgaatggacctacgacgacgctaccaaaaccttcacggtaaccgaaggtggaggtcggaccgaaggcagcggctcccccaagaaaaaacgcaaggtggaagatcctaagaaaaagcggaaagtgggcggttccggcggagggtcgagtgccgatgacatcaaatctaaaaaaaagagagagcagagcaatgatatcgctcggggctttgagagaggactggaaccagaaaagatcattggggcaacagattcctgtggtgatttaatgttcctaatgaaatggaaagacacagatgaagctgacctggttcttgcaaaagaagctaatgtgaaatgtccacaaattgtgatagcattttatgaagagagactgacatggcatgcatatcctgaggatgcggaaaacaaagagaaagaaacagcaaagagctaa

SEQ ID NO: 26 - DNA, 20 bp, human
ggagacccagcgctaaccag

SEQ ID NO: 27 - DNA, 20 bp, human
ggggcacccaggagcggtag

SEQ ID NO: 28 - DNA, 20 bp, human
gctccgggcgacgtggagtg

SEQ ID NO: 29 - DNA, 20 bp, human
gaaccaggggtgcccaaggg

SEQ ID NO: 30 - DNA, 20 bp, human
ggcgaggaaccgcccagcaa

SEQ ID NO: 31 - DNA, 20 bp, human
ggcagcgcaggacggcatct

SEQ ID NO: 32 - DNA, 20 bp, human
gagcagctcgaaggtgacgt

SEQ ID NO: 33 - DNA, 20 bp, human
gtccacgtcgcccggagctg

SEQ ID NO: 34 - DNA, 20 bp, human
gctgcagggcctttgctggg

SEQ ID NO: 35 - DNA, 20 bp, human
gccagcacgccggcaactac

SEQ ID NO: 36 - DNA, 20 bp, human
gccggtgcagtgagtgtctg

SEQ ID NO: 37 - DNA, 20 bp, human
gtgctgacgggtgacaccca

SEQ ID NO: 38 - DNA, 20 bp, human
gggacaagcccgagcggcag

SEQ ID NO: 39 - DNA, 20 bp, human
gtcctgtggacaagcccgag

SEQ ID NO: 40 - DNA, 20 bp, human
gatgatggtcgcgctcactc

SEQ ID NO: 41 - DNA, 20 bp, human
gtgcggagacagcccccgta

SEQ ID NO: 42 - DNA, 20 bp, human
gcaggtgagtcaaggtgcac

SEQ ID NO: 43 - DNA, 20 bp, human
gcttgatggcaggtgagtca

SEQ ID NO: 44 - DNA, 20 bp, human
ggggaacaggagccttacgg

SEQ ID NO: 45 - DNA, 20 bp, human
gtcaaggtgcacaggctcct

SEQ ID NO: 46 - DNA, 20 bp, human
gagagatccccacccggaaa

SEQ ID NO: 47 - DNA, 20 bp, human
ggggatctctgaaattactc

SEQ ID NO: 48 - DNA, 20 bp, human
ggagtgcctgtcccaatcct

SEQ ID NO: 49 - DNA, 20 bp, human
gaccacggagggttcaagag

SEQ ID NO: 50 - DNA, 20 bp, human
gttctcagggtcctaggatt

SEQ ID NO: 51 - DNA, 20 bp, human
ggttgaattcgccataatca

SEQ ID NO: 52 - DNA, 20 bp, human
gtagctctaaccagacagca

SEQ ID NO: 53 - DNA, 20 bp, human
gtaggctcgataacagaaga

SEQ ID NO: 54 - DNA, 20 bp, human
gaggaaaccttttccgggtg

SEQ ID NO: 55 - DNA, 20 bp, human
gtctgtagacttaccacgga

SEQ ID NO: 56 - DNA, 20 bp, human
gagatggattgtagggagta

SEQ ID NO: 57 - DNA, 20 bp, human
gttgggaccagatggattgt

SEQ ID NO: 58 - DNA, 20 bp, human
gcagagactgaggcgtctgt

SEQ ID NO: 59 - DNA, 20 bp, human
gaagaagatgacagtatcat

SEQ ID NO: 60 - DNA, 20 bp, human
gaatatgcaaagccttccta

SEQ ID NO: 61 - DNA, 20 bp, human
gaaatggacccttgagaaag

SEQ ID NO: 62 - DNA, 20 bp, human
ggcataaagcccagttgctt

SEQ ID NO: 63 - DNA, 20 bp, human
gaagaaccagacttggatga

SEQ ID NO: 64 - DNA, 20 bp, human
ggctctctgtgtggaactca

SEQ ID NO: 65 - DNA, 20 bp, human
ggcaataaatgaaggactct

SEQ ID NO: 66 - DNA, 20 bp, human
gctcggtgagggcctcctga

SEQ ID NO: 67 - DNA, 20 bp, human
gcagatttttccagggtcag

SEQ ID NO: 68 - DNA, 20 bp, human
gaaaatgaggtgcataagga

SEQ ID NO: 69 - DNA, 20 bp, human
gaggcatgtgtgctcggtga

SEQ ID NO: 70 - DNA, 20 bp, human
gtctgcaatggctggtgata

SEQ ID NO: 71 - DNA, 20 bp, human
ggggaggctgacgcatgaag

SEQ ID NO: 72 - DNA, 20 bp, human
ggaggtgcataaggaaggca

SEQ ID NO: 73 - DNA, 20 bp, human
ggagatggggagatcaactt

SEQ ID NO: 74 - DNA, 20 bp, human
gagcctccctctctgggtaa

SEQ ID NO: 75 - DNA, 20 bp, human
gatcctttacccagagaggg

SEQ ID NO: 76 - DNA, 20 bp, human
gcagccattaggtcttaagg

SEQ ID NO: 77 - DNA, 20 bp, human
ggggggacaatggtatggag

SEQ ID NO: 78 - DNA, 20 bp, human
gctcaggtgaggggggacaa

SEQ ID NO: 79 - DNA, 20 bp, human
gcccatatggctctcaagga

SEQ ID NO: 80 - DNA, 20 bp, human
gggctctcaaggagggactc

SEQ ID NO: 81 - DNA, 20 bp, human
ggtgcccccttaagacctaa

SEQ ID NO: 82 - DNA, 20 bp, human
gtggagaggaagaaagcttg

SEQ ID NO: 83 - DNA, 20 bp, human
gccctgctccccactctcgt

SEQ ID NO: 84 - DNA, 20 bp, human
gccggaaagcagagacccgg

SEQ ID NO: 85 - DNA, 20 bp, human
gtccgtgtgcatggacaccg

SEQ ID NO: 86 - DNA, 20 bp, human
ggtacctctagctccagcgg

SEQ ID NO: 87 - DNA, 20 bp, human
gctggagctagaggtacgag

SEQ ID NO: 88 - DNA, 20 bp, human
gggctctgcccggccaccgt

SEQ ID NO: 89 - DNA, 20 bp, human
ggaggagcgcgactcaccca

SEQ ID NO: 90 - DNA, 20 bp, human
ggagcgcgactcacccacgg

SEQ ID NO: 91 - DNA, 20 bp, human
ggcagagcctgcctcgaacc

SEQ ID NO: 92 - DNA, 20 bp, human
gccagccccgggacccaacc

SEQ ID NO: 93 - DNA, 20 bp, human
gctctagctccagcggcggc

SEQ ID NO: 94 - DNA, 20 bp, human
gccaggcttcccccggacgg

SEQ ID NO: 95 - DNA, 20 bp, human
ggaacaggtggcccgggcta

SEQ ID NO: 96 - DNA, 20 bp, human
ggcatttgcagctagaagtt

SEQ ID NO: 97 - DNA, 20 bp, human
ggaacacagatctcacgtct

SEQ ID NO: 98 - DNA, 20 bp, human
gttcagagcctggactttgg

SEQ ID NO: 99 - DNA, 20 bp, human
gacagatctcacgtcttggc

SEQ ID NO: 100 - DNA, 20 bp, human
gcttgctaatcgtgtgatct

SEQ ID NO: 101 - DNA, 20 bp, human
gtggttagagctaacatttt

SEQ ID NO: 102 - DNA, 20 bp, human
gaagaggcaaaagtatctct

SEQ ID NO: 103 - DNA, 20 bp, human
gtcattgtcactgacatcat

SEQ ID NO: 104 - DNA, 20 bp, human
gaggaaagcactgcaggtaa

SEQ ID NO: 105 - DNA, 20 bp, human
gatgtcagtgacaatgacaa

SEQ ID NO: 106 - DNA, 20 bp, human
gaggacgagtacgcggtccc

SEQ ID NO: 107 - DNA, 20 bp, human
gcctcgccgtttgtcccttg

SEQ ID NO: 108 - DNA, 20 bp, human
gacggcgaggcggaactcaa

SEQ ID NO: 109 - DNA, 20 bp, human
gccccggcaggaggctagaa

SEQ ID NO: 110 - DNA, 20 bp, human
ggggtaccgcaagggacaaa

SEQ ID NO: 111 - DNA, 20 bp, human
ggtcacagagtctggcggag

SEQ ID NO: 112 - DNA, 20 bp, human
gtgggattggagtataacgg

SEQ ID NO: 113 - DNA, 20 bp, human
ggctagattcgtatgcggac

SEQ ID NO: 114 - DNA, 20 bp, human
gcccgggctagattcgtatg

SEQ ID NO: 115 - DNA, 20 bp, human
gatgcggacgggtaccgcaa

SEQ ID NO: 116 - DNA, 20 bp, human
gcggcggcggcggggaacaa

SEQ ID NO: 117 - DNA, 20 bp, human
gcccggtcgggaggagatcc

SEQ ID NO: 118 - DNA, 20 bp, human
gtggcgggctgggtcagcga

SEQ ID NO: 119 - DNA, 20 bp, human
gctgggaccggaggaagcga

SEQ ID NO: 120 - DNA, 20 bp, human
gcgggctgggtcagcgacgg

SEQ ID NO: 121 - DNA, 20 bp, human
gctggagtgccaggtgatgt

SEQ ID NO: 122 - DNA, 20 bp, human
gaggcctccccgccatcaag

SEQ ID NO: 123 - DNA, 20 bp, human
gggctggaggagccacttga

SEQ ID NO: 124 - DNA, 20 bp, human
ggatgttccccaagactggg

SEQ ID NO: 125 - DNA, 20 bp, human
gcggggaacaagggactgaa

SEQ ID NO: 126 - DNA, 20 bp, human
ggaagcgggacgttcaccat

SEQ ID NO: 127 - DNA, 20 bp, human
gctattcaggcatatcatgt

SEQ ID NO: 128 - DNA, 20 bp, human
ggtttctagagaccaagaag

SEQ ID NO: 129 - DNA, 20 bp, human
gcctcaacgttatctgggag

SEQ ID NO: 130 - DNA, 20 bp, human
gcctaagataagaatttcaa

SEQ ID NO: 131 - DNA, 20 bp, human
gaattctctgggtcaaatgg

SEQ ID NO: 132 - DNA, 20 bp, human
gagcaaggagtcatttgaat

SEQ ID NO: 133 - DNA, 20 bp, human
ggctgtaccttctgattgtg

SEQ ID NO: 134 - DNA, 20 bp, human
gagctttaatatcacgatag

SEQ ID NO: 135 - DNA, 20 bp, human
ggaaattcttatcttaggta

SEQ ID NO: 136 - DNA, 20 bp, human
ggtagagcaattgtagactt

SEQ ID NO: 137 - DNA, 20 bp, human
gactgttactcacagatata

SEQ ID NO: 138 - DNA, 20 bp, human
gtggaaaaagggatattatg

SEQ ID NO: 139 - DNA, 20 bp, human
ggttttagcgatggcatcca

SEQ ID NO: 140 - DNA, 20 bp, human
ggctaaaacttgtacattta

SEQ ID NO: 141 - DNA, 20 bp, human
gagctttcttcaatgttgtc

SEQ ID NO: 142 - DNA, 20 bp, human
gatgacttattgactaaaaa

SEQ ID NO: 143 - DNA, 20 bp, human
gagcaatggttctttcaaaa

SEQ ID NO: 144 - DNA, 20 bp, human
gagctggaaaataatggcct

SEQ ID NO: 145 - DNA, 20 bp, human
gaatgtacaagttttagcga

SEQ ID NO: 146 - DNA, 20 bp, human
ggagaggaagctgtgcgcag

SEQ ID NO: 147 - DNA, 20 bp, human
gggctgagaaccacctaata

SEQ ID NO: 148 - DNA, 20 bp, human
gacccctagtgagaacactc

SEQ ID NO: 149 - DNA, 20 bp, human
ggtggaaaccatttaggaca

SEQ ID NO: 150 - DNA, 20 bp, human
gcagctggaagatgcaatgg

SEQ ID NO: 151 - DNA, 20 bp, human
gccttaatggtcagctggag

SEQ ID NO: 152 - DNA, 20 bp, human
ggcctgagtgttctcactag

SEQ ID NO: 153 - DNA, 20 bp, human
gctctgaaccatgtcctaaa

SEQ ID NO: 154 - DNA, 20 bp, human
ggtgcataatccctattagg

SEQ ID NO: 155 - DNA, 20 bp, human
gtgcgcagtggaaaccattt

SEQ ID NO: 156 - DNA, 20 bp, human
gcaagagtagcactagccag

SEQ ID NO: 157 - DNA, 20 bp, human
gagacccccaggaaaaagat

SEQ ID NO: 158 - DNA, 20 bp, human
gcaccaaagtgaccaggtag

SEQ ID NO: 159 - DNA, 20 bp, human
gaggccacgtcgtaacctgg

SEQ ID NO: 160 - DNA, 20 bp, human
gaaggtagcagggatatccg

SEQ ID NO: 161 - DNA, 20 bp, human
gaagcccccaggttacgacg

SEQ ID NO: 162 - DNA, 20 bp, human
gaggggacagccatgttcct

SEQ ID NO: 163 - DNA, 20 bp, human
gatgtgaagaggacctggct

SEQ ID NO: 164 - DNA, 20 bp, human
gcaatgcaggaatctcaact

SEQ ID NO: 165 - DNA, 20 bp, human
gtaaactcaccaaagtgacc

SEQ ID NO: 166 - DNA, 20 bp, human
gtcccgaggattaggatcac

SEQ ID NO: 167 - DNA, 20 bp, human
gcggcccagaggctagccca

SEQ ID NO: 168 - DNA, 20 bp, human
gcggtggcgttgccagagtg

SEQ ID NO: 169 - DNA, 20 bp, human
gtagcaggcaggacttgacg

SEQ ID NO: 170 - DNA, 20 bp, human
ggctgggaatcaccgcaacc

SEQ ID NO: 171 - DNA, 20 bp, human
gcgcaacccggcgtccgcgt

SEQ ID NO: 172 - DNA, 20 bp, human
gagcccaggggctgaccgag

SEQ ID NO: 173 - DNA, 20 bp, human
ggcgcctaggccggccaacg

SEQ ID NO: 174 - DNA, 20 bp, human
gcggcgaggtcaagagtcat

SEQ ID NO: 175 - DNA, 20 bp, human
gtccagccggggagtttcgg

SEQ ID NO: 176 - DNA, 20 bp, human
gtcacgcacggcgaagtaca

SEQ ID NO: 177 - DNA, 20 bp, human
gcggtcacgcggcaggttag

SEQ ID NO: 178 - DNA, 20 bp, human
gcgcggccgcttcccaacta

SEQ ID NO: 179 - DNA, 20 bp, human
gccggtccgcgctgacagag

SEQ ID NO: 180 - DNA, 20 bp, human
ggcgcggccatgacgcgggg

SEQ ID NO: 181 - DNA, 20 bp, human
gccccgagcggccccgacag

SEQ ID NO: 182 - DNA, 20 bp, human
gccgcttcccaactagggcg

SEQ ID NO: 183 - DNA, 20 bp, human
gccgtgcgtgacgcgagcaa

SEQ ID NO: 184 - DNA, 20 bp, human
ggcccgcgggcgtccagcac

SEQ ID NO: 185 - DNA, 20 bp, human
gcatgacgcggggcggccga

SEQ ID NO: 186 - DNA, 20 bp, human
gctcgcgagccggttccgtc

SEQ ID NO: 187 - DNA, 20 bp, human
gtggtctcctgagaagacgg

SEQ ID NO: 188 - DNA, 20 bp, human
gcggctcgcgagcgcagcta

SEQ ID NO: 189 - DNA, 20 bp, human
gcagctggtgactaacgcac

SEQ ID NO: 190 - DNA, 20 bp, human
gacgccgaagaaggccgagt

SEQ ID NO: 191 - DNA, 20 bp, human
ggctaggttacaggagtgta

SEQ ID NO: 192 - DNA, 20 bp, human
ggcacgagattaagagatag

SEQ ID NO: 193 - DNA, 20 bp, human
gagcggctgcctgacggaac

SEQ ID NO: 194 - DNA, 20 bp, human
gactgggcgcctccactgac

SEQ ID NO: 195 - DNA, 20 bp, human
ggccttcaggttcatctcaa

SEQ ID NO: 196 - DNA, 20 bp, human
gggcctgcgacgcagagaag

SEQ ID NO: 197 - DNA, 20 bp, human
gctgcgacgcagagaagagg

SEQ ID NO: 198 - DNA, 20 bp, human
gcccggcgagaaaaaccgtg

SEQ ID NO: 199 - DNA, 20 bp, human
gccccacggccggattcggg

SEQ ID NO: 200 - DNA, 20 bp, human
gccgccgagccgtctcaagt

SEQ ID NO: 201 - DNA, 20 bp, human
gcagccccgcgacattgtca

SEQ ID NO: 202 - DNA, 20 bp, human
gggcggccgtgacaatgtcg

SEQ ID NO: 203 - DNA, 20 bp, human
ggctgagggaggatgcctat

SEQ ID NO: 204 - DNA, 20 bp, human
gcggcagcgccgaccctccc

SEQ ID NO: 205 - DNA, 20 bp, human
ggcacccacttgagacggct

SEQ ID NO: 206 - DNA, 20 bp, human
ggcgctgggagcgtaagtgc

SEQ ID NO: 207 - DNA, 20 bp, human
gtgcagggcgtattcccgga

SEQ ID NO: 208 - DNA, 20 bp, human
gcagcccagcccctaattaa

SEQ ID NO: 209 - DNA, 20 bp, human
gcagatcccgaagcagcgct

SEQ ID NO: 210 - DNA, 20 bp, human
ggagaccaggctctgctagg

SEQ ID NO: 211 - DNA, 20 bp, human
ggtattcccggagggcagtt

SEQ ID NO: 212 - DNA, 20 bp, human
gtagggggccatggtgtgag

SEQ ID NO: 213 - DNA, 20 bp, human
ggaggtgtgcccttaattag

SEQ ID NO: 214 - DNA, 20 bp, human
ggggctgggactccattgag

SEQ ID NO: 215 - DNA, 20 bp, human
ggggaccagaatcggagtgt

SEQ ID NO: 216 - DNA, 20 bp, human
ggctgactctgggaggcgtt

SEQ ID NO: 217 - DNA, 20 bp, human
gggagggccaaggggatgat

SEQ ID NO: 218 - DNA, 20 bp, human
ggtcgcgcagagctgactct

SEQ ID NO: 219 - DNA, 20 bp, human
gggcgcgcgggacacaggac

SEQ ID NO: 220 - DNA, 20 bp, human
ggacacaggacgggaggcca

SEQ ID NO: 221 - DNA, 20 bp, human
ggccagagaccgtgcggtaa

SEQ ID NO: 222 - DNA, 20 bp, human
ggcgcgggacacaggacggg

SEQ ID NO: 223 - DNA, 20 bp, human
gcggctggccagagaccgtg

SEQ ID NO: 224 - DNA, 20 bp, human
gcgggaggcggtaagaggta

SEQ ID NO: 225 - DNA, 20 bp, human
ggagaccgtgcggtaaggga

SEQ ID NO: 226 - DNA, 20 bp, human
ggccatctggatagaagtag

SEQ ID NO: 227 - DNA, 20 bp, human
gtagaagtagaggctcccta

SEQ ID NO: 228 - DNA, 20 bp, human
gggaggttagagggagccgg

SEQ ID NO: 229 - DNA, 20 bp, human
gggggcctgtccgcaggcac

SEQ ID NO: 230 - DNA, 20 bp, human
gacgggaaccagtaaaatcc

SEQ ID NO: 231 - DNA, 20 bp, human
gatccagatggcctcagact

SEQ ID NO: 232 - DNA, 20 bp, human
gcagtaaaatccgggactcc

SEQ ID NO: 233 - DNA, 20 bp, human
gacctacctggactgtggag

SEQ ID NO: 234 - DNA, 20 bp, human
ggctttgtggagggaacact

SEQ ID NO: 235 - DNA, 20 bp, human
ggcaggcaaggagagtgcat

SEQ ID NO: 236 - DNA, 20 bp, human
gaccggaacgtggggcgagg

SEQ ID NO: 237 - DNA, 20 bp, human
gtccgctgtaccggaacgtg

SEQ ID NO: 238 - DNA, 20 bp, human
ggactctgagccgagaagag

SEQ ID NO: 239 - DNA, 20 bp, human
gcggtacagcggaaacgcac

SEQ ID NO: 240 - DNA, 20 bp, human
gggaagtcacgcagagagta

SEQ ID NO: 241 - DNA, 20 bp, human
ggagacctgacctagcccca

SEQ ID NO: 242 - DNA, 20 bp, human
gtggggcgaggcggtgagtg

SEQ ID NO: 243 - DNA, 20 bp, human
gtctgagccgagaagagggg

SEQ ID NO: 244 - DNA, 20 bp, human
gaccgcctcgccccacgttc

SEQ ID NO: 245 - DNA, 20 bp, human
ggccaggtcgagtgcaatca

SEQ ID NO: 246 - DNA, 20 bp, human
gaagtccccggggcccatcg

SEQ ID NO: 247 - DNA, 20 bp, human
gctgcagcggcggaagtccc

SEQ ID NO: 248 - DNA, 20 bp, human
ggccccccaaggcgtcgggt

SEQ ID NO: 249 - DNA, 20 bp, human
gaggcgtcgggtgggctacg

SEQ ID NO: 250 - DNA, 20 bp, human
ggtctccgcgatgggccccg

SEQ ID NO: 251 - DNA, 20 bp, human
gagacctgaggggcccccca

SEQ ID NO: 252 - DNA, 20 bp, human
ggctggaggacctcagacga

SEQ ID NO: 253 - DNA, 20 bp, human
gacgcgcgccttccagtggg

SEQ ID NO: 254 - DNA, 20 bp, human
gtcgaggcgcgtgcaggagg

SEQ ID NO: 255 - DNA, 20 bp, human
gcgccgtgtccagacctgag

SEQ ID NO: 256 - DNA, 20 bp, human
gcccttggcgggggactctg

SEQ ID NO: 257 - DNA, 20 bp, human
gcggcgaccctaggagaggt

SEQ ID NO: 258 - DNA, 20 bp, human
ggggacggcgaccctaggag

SEQ ID NO: 259 - DNA, 20 bp, human
gtgcagcgggcccttggcgg

SEQ ID NO: 260 - DNA, 20 bp, human
gagggcggcctacctctcct

SEQ ID NO: 261 - DNA, 20 bp, human
gccgccctcggagagctctg

SEQ ID NO: 262 - DNA, 20 bp, human
ggcaccgcagagctctccga

SEQ ID NO: 263 - DNA, 20 bp, human
gtctgcgggaataggtgcag

SEQ ID NO: 264 - DNA, 20 bp, human
gggtctcggtgcgcctggac

SEQ ID NO: 265 - DNA, 20 bp, human
gaataggtgcagcgggccct

SEQ ID NO: 266 - DNA, 20 bp, human
ggctacgatggcagcgtcag

SEQ ID NO: 267 - DNA, 20 bp, human
gtcactgcccggagctacga

SEQ ID NO: 268 - DNA, 20 bp, human
ggctgcggcgggccattcga

SEQ ID NO: 269 - DNA, 20 bp, human
gagtggcagctgcagcccgg

SEQ ID NO: 270 - DNA, 20 bp, human
gggtacggcgctcagagtat

SEQ ID NO: 271 - DNA, 20 bp, human
gggcgctcagagtataggga

SEQ ID NO: 272 - DNA, 20 bp, human
gcatgcgggcgaccttcgaa

SEQ ID NO: 273 - DNA, 20 bp, human
gtggttgggtaaagtgatgg

SEQ ID NO: 274 - DNA, 20 bp, human
gccgcggggccgcacggaag

SEQ ID NO: 275 - DNA, 20 bp, human
gtggctgaggccccgccatg

SEQ ID NO: 276 - DNA, 20 bp, human
gccgtgacgccgtacctctc

SEQ ID NO: 277 - DNA, 20 bp, human
gcagttatgcccgagaggta

SEQ ID NO: 278 - DNA, 20 bp, human
ggcgggacagcaggagacca

SEQ ID NO: 279 - DNA, 20 bp, human
gcgtgacagttatgcccgag

SEQ ID NO: 280 - DNA, 20 bp, human
gcgcggagctgcagactgaa

SEQ ID NO: 281 - DNA, 20 bp, human
gaccagaacgccatacctgc

SEQ ID NO: 282 - DNA, 20 bp, human
gagagaagcctgggagcgaa

SEQ ID NO: 283 - DNA, 20 bp, human
gcattatggctgagaaaaaa

SEQ ID NO: 284 - DNA, 20 bp, human
gggaagagggcgccacgtgt

SEQ ID NO: 285 - DNA, 20 bp, human
gcgcacgcgcagagaagcct

SEQ ID NO: 286 - DNA, 20 bp, human
gagcgggagccgcaatggca

SEQ ID NO: 287 - DNA, 20 bp, human
gcattgcggctcccgctcca

SEQ ID NO: 288 - DNA, 20 bp, human
gtccagggaaaagggccagg

SEQ ID NO: 289 - DNA, 20 bp, human
gttgaggtgtggcttcatag

SEQ ID NO: 290 - DNA, 20 bp, human
gtctaaatgccaccctggag

SEQ ID NO: 291 - DNA, 20 bp, human
gctgtcgtaccacaaggtcc

SEQ ID NO: 292 - DNA, 20 bp, human
gggtgtggcttcataggggt

SEQ ID NO: 293 - DNA, 20 bp, human
gttggagcagggaatctcca

SEQ ID NO: 294 - DNA, 20 bp, human
gctgaagagaagttgaggtg

SEQ ID NO: 295 - DNA, 20 bp, human
gctggagcgcccagaagact

SEQ ID NO: 296 - DNA, 20 bp, human
gtttcccggatagctcgtcg

SEQ ID NO: 297 - DNA, 20 bp, human
gtatccgcgacgagctatcc

SEQ ID NO: 298 - DNA, 20 bp, human
gtcttcgaaaccactctagg

SEQ ID NO: 299 - DNA, 20 bp, human
gggagtgtacacacaggtca

SEQ ID NO: 300 - DNA, 20 bp, human
ggacgcaggagtgtacacac

SEQ ID NO: 301 - DNA, 20 bp, human
ggacgcggaagatttacgta

SEQ ID NO: 302 - DNA, 20 bp, human
gtacgtatggtgcctcgctc

SEQ ID NO: 303 - DNA, 20 bp, human
ggtaaagctatcccagagcg

SEQ ID NO: 304 - DNA, 20 bp, human
gagacttgctaagtgagtcg

SEQ ID NO: 305 - DNA, 20 bp, human
gatcgcattcggccctttcc

SEQ ID NO: 306 - DNA, 20 bp, human
ggccatcaggcccgagatag

SEQ ID NO: 307 - DNA, 20 bp, human
gcggacctcgccgctatctc

SEQ ID NO: 308 - DNA, 20 bp, human
gggcaccaagcagaaccgtt

SEQ ID NO: 309 - DNA, 20 bp, human
ggccatcgcggcctccaagg

SEQ ID NO: 310 - DNA, 20 bp, human
gacggacgccgggaagaagg

SEQ ID NO: 311 - DNA, 20 bp, human
ggcctccaaggcggttacaa

SEQ ID NO: 312 - DNA, 20 bp, human
gcaggcccgagatagcggcg

SEQ ID NO: 313 - DNA, 20 bp, human
gagcgcacgccctccatgga

SEQ ID NO: 314 - DNA, 20 bp, human
ggccggcgctgcggagttgt

SEQ ID NO: 315 - DNA, 20 bp, human
gacagccatcgcggcctcca

SEQ ID NO: 316 - DNA, 20 bp, human
gcgactcggaagattcgagg

SEQ ID NO: 317 - DNA, 20 bp, human
gtggaaggccgggaagtagg

SEQ ID NO: 318 - DNA, 20 bp, human
gacaagtcggcgccccagag

SEQ ID NO: 319 - DNA, 20 bp, human
gcctccctgcgaggaatgga

SEQ ID NO: 320 - DNA, 20 bp, human
gatcttccgagtcgctgcag

SEQ ID NO: 321 - DNA, 20 bp, human
gcagcgactcggaagattcg

SEQ ID NO: 322 - DNA, 20 bp, human
gtcgcggcgccgggacccga

SEQ ID NO: 323 - DNA, 20 bp, human
gtagaagaaactgggatgga

SEQ ID NO: 324 - DNA, 20 bp, human
gcggcgccccagagcggacg

SEQ ID NO: 325 - DNA, 20 bp, human
gcctcacctcgtccgctctg

SEQ ID NO: 326 - DNA, 20 bp, human
gagtggccggtccagagctg

SEQ ID NO: 327 - DNA, 20 bp, human
gggaatcggatcaaggcgag

SEQ ID NO: 328 - DNA, 20 bp, human
gggatcaaggcgagaggatc

SEQ ID NO: 329 - DNA, 20 bp, human
ggagtcggggaatcggatca

SEQ ID NO: 330 - DNA, 20 bp, human
ggcctccgcgcggtctctgg

SEQ ID NO: 331 - DNA, 20 bp, human
ggatgggcggaacagatcga

SEQ ID NO: 332 - DNA, 20 bp, human
gaaggcgagaggatccggca

SEQ ID NO: 333 - DNA, 20 bp, human
ggcggtctctggcggagtcg

SEQ ID NO: 334 - DNA, 20 bp, human
gaaatgtgcggcccaacccc

SEQ ID NO: 335 - DNA, 20 bp, human
ggaggccgggaccaccctcg

SEQ ID NO: 336 - DNA, 20 bp, human
ggcggccccagatctcggag

SEQ ID NO: 337 - DNA, 20 bp, human
gaagcagccggaccccctgg

SEQ ID NO: 338 - DNA, 20 bp, human
gcgcagagcccgcaccggtg

SEQ ID NO: 339 - DNA, 20 bp, human
gcagaagcagccggaccccc

SEQ ID NO: 340 - DNA, 20 bp, human
gggcctgcccctccgagatc

SEQ ID NO: 341 - DNA, 20 bp, human
gggggcggcggcgacagacg

SEQ ID NO: 342 - DNA, 20 bp, human
ggagccgccgcatcacccag

SEQ ID NO: 343 - DNA, 20 bp, human
gcctgggccccagcacaaac

SEQ ID NO: 344 - DNA, 20 bp, human
ggagcccgcaccggtggggg

SEQ ID NO: 345 - DNA, 20 bp, human
gtcacgtccgcagcggaggg

SEQ ID NO: 346 - DNA, 20 bp, human
gcccgcaagtcggaacccgg

SEQ ID NO: 347 - DNA, 20 bp, human
gccagcgctgccggaactcg

SEQ ID NO: 348 - DNA, 20 bp, human
gggatgcgcgccccgagttc

SEQ ID NO: 349 - DNA, 20 bp, human
gccgcgtcttgggaagatga

SEQ ID NO: 350 - DNA, 20 bp, human
ggggcgcgcatcccgcaagt

SEQ ID NO: 351 - DNA, 20 bp, human
gagtctcccaagaggtgagg

SEQ ID NO: 352 - DNA, 20 bp, human
gaggccccgtctccgatctg

SEQ ID NO: 353 - DNA, 20 bp, human
gcatcccgcaagtcggaacc

SEQ ID NO: 354 - DNA, 20 bp, human
gctgcgggatccgatccgcc

SEQ ID NO: 355 - DNA, 20 bp, human
gggagtccggcgagtcgctg

SEQ ID NO: 356 - DNA, 20 bp, human
ggatgcactcagctggtacc

SEQ ID NO: 357 - DNA, 20 bp, human
ggtacccggcaagtgcgcaa

SEQ ID NO: 358 - DNA, 20 bp, human
gcggcaagtgcgcaagggag

SEQ ID NO: 359 - DNA, 20 bp, human
gcctggtagtcggagtcctg

SEQ ID NO: 360 - DNA, 20 bp, human
gcttggaagcagagcaggtt

SEQ ID NO: 361 - DNA, 20 bp, human
ggcgcaagggagagggacgg

SEQ ID NO: 362 - DNA, 20 bp, human
gaacaggcactgacagacac

SEQ ID NO: 363 - DNA, 20 bp, human
gactcacggtgcctggtagt

SEQ ID NO: 364 - DNA, 20 bp, human
gtggctgggttcatcctaag

SEQ ID NO: 365 - DNA, 20 bp, human
gcatcctaagaggtgccgtt

SEQ ID NO: 366 - DNA, 20 bp, human
gcagcccgggagagaagggt

SEQ ID NO: 367 - DNA, 20 bp, human
ggccgcagcccgggagagaa

SEQ ID NO: 368 - DNA, 20 bp, human
ggcagcagcgcagagtcctg

SEQ ID NO: 369 - DNA, 20 bp, human
gctccccggtctccaccgtc

SEQ ID NO: 370 - DNA, 20 bp, human
gcgggagagaagggtcggct

SEQ ID NO: 371 - DNA, 20 bp, human
gttgcgagcgagagtgagtg

SEQ ID NO: 372 - DNA, 20 bp, human
gtgcccgacggtggagaccg

SEQ ID NO: 373 - DNA, 20 bp, human
gtaacgcccaagtaagtcac

SEQ ID NO: 374 - DNA, 20 bp, human
gccctgagaaccggctctgt

SEQ ID NO: 375 - DNA, 20 bp, human
gcgcagtaccccgggctcag

SEQ ID NO: 376 - DNA, 20 bp, human
gtctgaagagtaactggaca

SEQ ID NO: 377 - DNA, 20 bp, human
gtcaaggactcctctacaaa

SEQ ID NO: 378 - DNA, 20 bp, human
gaagaggcaaccatttgtag

SEQ ID NO: 379 - DNA, 20 bp, human
gttgaagcacttggatccac

SEQ ID NO: 380 - DNA, 20 bp, human
gaaccatacaaattctcaaa

SEQ ID NO: 381 - DNA, 20 bp, human
gatcaaaacagttttaaaag

SEQ ID NO: 382 - DNA, 20 bp, human
gagagagtgtaatgaattgt

SEQ ID NO: 383 - DNA, 20 bp, human
gaaactgttttgattcagct

SEQ ID NO: 384 - DNA, 20 bp, human
ggaaagatggctagattcag

SEQ ID NO: 385 - DNA, 20 bp, human
gtggacaaggagaaaaacat

SEQ ID NO: 386 - DNA, 20 bp, human
gcatggagagtaggaggtgt

SEQ ID NO: 387 - DNA, 20 bp, human
gtaatttcatggagagtagg

SEQ ID NO: 388 - DNA, 20 bp, human
gtgttctctaaggtgtggat

SEQ ID NO: 389 - DNA, 20 bp, human
gatctgaagctgatgaaaca

SEQ ID NO: 390 - DNA, 20 bp, human
gacatacagcaagttggacg

SEQ ID NO: 391 - DNA, 20 bp, human
ggatcctggtctggaaaaat

SEQ ID NO: 392 - DNA, 20 bp, human
gaattaatttcatggagagt

SEQ ID NO: 393 - DNA, 20 bp, human
gaaattggctaggtgtaaaa

SEQ ID NO: 394 - DNA, 20 bp, human
gggataggcaattaatttca

SEQ ID NO: 395 - DNA, 20 bp, human
gcacggcatagcttccttga

SEQ ID NO: 396 - DNA, 20 bp, human
gccacagcagggctttgaac

SEQ ID NO: 397 - DNA, 20 bp, human
gggaaccctatggaaaacca

SEQ ID NO: 398 - DNA, 20 bp, human
gaccaaggcaagcactcacc

SEQ ID NO: 399 - DNA, 20 bp, human
gagggctttgaactggcacc

SEQ ID NO: 400 - DNA, 20 bp, human
gcagcaggcatggggcatgc

SEQ ID NO: 401 - DNA, 20 bp, human
ggaggtctggagcaagatca

SEQ ID NO: 402 - DNA, 20 bp, human
gagacctcactggaacccta

SEQ ID NO: 403 - DNA, 20 bp, human
gaatgaccaggatgaaatca

SEQ ID NO: 404 - DNA, 20 bp, human
ggaattggctctgcagactc

SEQ ID NO: 405 - DNA, 20 bp, human
gaactgaacagtgaattctc

SEQ ID NO: 406 - DNA, 20 bp, human
ggcggtgctcggctgagtca

SEQ ID NO: 407 - DNA, 20 bp, human
gccgcgcgggcgatgcccag

SEQ ID NO: 408 - DNA, 20 bp, human
gtggtgcaggaagcccatgg

SEQ ID NO: 409 - DNA, 20 bp, human
gcaggactctggctcgaggg

SEQ ID NO: 410 - DNA, 20 bp, human
gcaagcggcgctcaggactc

SEQ ID NO: 411 - DNA, 20 bp, human
gccgagcaccgcgatgtcag

SEQ ID NO: 412 - DNA, 20 bp, human
gcccgcgtccgctgacatcg

SEQ ID NO: 413 - DNA, 20 bp, human
gcccagcgagcgcgctgcag

SEQ ID NO: 414 - DNA, 20 bp, human
ggaccgagccacctccccgg

SEQ ID NO: 415 - DNA, 20 bp, human
ggctcaggactctggctcga

SEQ ID NO: 416 - DNA, 20 bp, human
ggggaggggaccccgcgaga

SEQ ID NO: 417 - DNA, 20 bp, human
gctgcgtggccgccctggag

SEQ ID NO: 418 - DNA, 20 bp, human
gacacgcccaaggctcggat

SEQ ID NO: 419 - DNA, 20 bp, human
gggtgccgctccctcagcgt

SEQ ID NO: 420 - DNA, 20 bp, human
ggcagtgcgggacacgccca

SEQ ID NO: 421 - DNA, 20 bp, human
gtccagcctcgcagtggcgg

SEQ ID NO: 422 - DNA, 20 bp, human
gccgctgcgtccgccagtag

SEQ ID NO: 423 - DNA, 20 bp, human
ggcctgcaacccgctactgg

SEQ ID NO: 424 - DNA, 20 bp, human
gcgctccagcctcgcagtgg

SEQ ID NO: 425 - DNA, 20 bp, human
gcgagctggccggcgagggt

SEQ ID NO: 426 - DNA, 20 bp, human
gagagagcggtagactggac

SEQ ID NO: 427 - DNA, 20 bp, human
ggaggcccctcagacagcaa

SEQ ID NO: 428 - DNA, 20 bp, human
ggcgtggatgccctagagag

SEQ ID NO: 429 - DNA, 20 bp, human
ggagccagaggcgctcttaa

SEQ ID NO: 430 - DNA, 20 bp, human
gcaggcaggtgtaaaacggg

SEQ ID NO: 431 - DNA, 20 bp, human
ggggcaggcaatggattgac

SEQ ID NO: 432 - DNA, 20 bp, human
ggaccacacgaagaccagat

SEQ ID NO: 433 - DNA, 20 bp, human
ggcctcagctctgaccaatc

SEQ ID NO: 434 - DNA, 20 bp, human
gatggattgacaggcacggt

SEQ ID NO: 435 - DNA, 20 bp, human
gaggagaaggacacagcgtc

SEQ ID NO: 436 - DNA, 20 bp, human
gaacgacagcgtccaggcaa

SEQ ID NO: 437 - DNA, 20 bp, human
gcggccggacccggtcccag

SEQ ID NO: 438 - DNA, 20 bp, human
gcccgagccgcagagctgtc

SEQ ID NO: 439 - DNA, 20 bp, human
ggcagtgtcccgaagtccca

SEQ ID NO: 440 - DNA, 20 bp, human
gccagctgggatctgtgcga

SEQ ID NO: 441 - DNA, 20 bp, human
gggctccgcgaggctcccct

SEQ ID NO: 442 - DNA, 20 bp, human
gctctgcggctcgggccctg

SEQ ID NO: 443 - DNA, 20 bp, human
gcaacagactgagcgcgtcc

SEQ ID NO: 444 - DNA, 20 bp, human
gcagtgcgggtgacccagct

SEQ ID NO: 445 - DNA, 20 bp, human
ggggtggaacgacagcgtcc

SEQ ID NO: 446 - DNA, 20 bp, human
gcaggctgtgtaagagctgc

SEQ ID NO: 447 - DNA, 20 bp, human
gtgtgctgtgccaaatatgt

SEQ ID NO: 448 - DNA, 20 bp, human
gcagtgtccacccacatatt

SEQ ID NO: 449 - DNA, 20 bp, human
gcatcatgtacagcttggtc

SEQ ID NO: 450 - DNA, 20 bp, human
gacaccccttttcagaaacc

SEQ ID NO: 451 - DNA, 20 bp, human
gcaatctacacaataaaaag

SEQ ID NO: 452 - DNA, 20 bp, human
gaccagttctctgtttgtct

SEQ ID NO: 453 - DNA, 20 bp, human
gtttgcttctgtgctagctg

SEQ ID NO: 454 - DNA, 20 bp, human
gctacacaataaaaagtggt

SEQ ID NO: 455 - DNA, 20 bp, human
gaagttcatcatgtacagct

SEQ ID NO: 456 - DNA, 20 bp, human
ggcgcacttggcttaagggg

SEQ ID NO: 457 - DNA, 20 bp, human
gctggaaggtgagaaggact

SEQ ID NO: 458 - DNA, 20 bp, human
ggaatctgacgctgacagag

SEQ ID NO: 459 - DNA, 20 bp, human
ggacccagacccttacgcca

SEQ ID NO: 460 - DNA, 20 bp, human
gggagtgcaggagttctaac

SEQ ID NO: 461 - DNA, 20 bp, human
gagcgggacttaggatctgg

SEQ ID NO: 462 - DNA, 20 bp, human
gaggtgagaaggactcggag

SEQ ID NO: 463 - DNA, 20 bp, human
gggaaagaaccctggcgtaa

SEQ ID NO: 464 - DNA, 20 bp, human
gaggtgaccaggccggaact

SEQ ID NO: 465 - DNA, 20 bp, human
gaggggcaggaagttgctaa

SEQ ID NO: 466 - DNA, 20 bp, human
gagaggtcaggacaacggtc

SEQ ID NO: 467 - DNA, 20 bp, human
gcggtcgggctgaagacgtg

SEQ ID NO: 468 - DNA, 20 bp, human
gtgtgagaccagggccgggt

SEQ ID NO: 469 - DNA, 20 bp, human
gtcaccaggccgccaataca

SEQ ID NO: 470 - DNA, 20 bp, human
ggggctgaagacgtgcggtg

SEQ ID NO: 471 - DNA, 20 bp, human
gggctccctgacatgcacgg

SEQ ID NO: 472 - DNA, 20 bp, human
ggacctgggggagaataggt

SEQ ID NO: 473 - DNA, 20 bp, human
ggaatcccccgtgcatgtca

SEQ ID NO: 474 - DNA, 20 bp, human
gcggccctggtctcacactg

SEQ ID NO: 475 - DNA, 20 bp, human
gagaaggccatggtgagact

SEQ ID NO: 476 - DNA, 20 bp, human
gttctaaacaaggagctcag

SEQ ID NO: 477 - DNA, 20 bp, human
gttgattgcacaataatgta

SEQ ID NO: 478 - DNA, 20 bp, human
ggtgaagactgctttcagag

SEQ ID NO: 479 - DNA, 20 bp, human
gaagactgctttcagagtgg

SEQ ID NO: 480 - DNA, 20 bp, human
ggaacttacttctgggaaaa

SEQ ID NO: 481 - DNA, 20 bp, human
gatacagtgaacttacttct

SEQ ID NO: 482 - DNA, 20 bp, human
gagttattcatattttctcc

SEQ ID NO: 483 - DNA, 20 bp, human
gactttaaagattttatatc

SEQ ID NO: 484 - DNA, 20 bp, human
gacaataatgtagggcattt

SEQ ID NO: 485 - DNA, 20 bp, human
gatggaagcaaggaatctag

SEQ ID NO: 486 - DNA, 20 bp, human
gagaaacacagttcatccat

SEQ ID NO: 487 - DNA, 20 bp, human
ggcaatgcttacaattcctc

SEQ ID NO: 488 - DNA, 20 bp, human
ggatgtagtagtgacccaaa

SEQ ID NO: 489 - DNA, 20 bp, human
gtagaggttaacttactctc

SEQ ID NO: 490 - DNA, 20 bp, human
gcatgggtctctgcatgttc

SEQ ID NO: 491 - DNA, 20 bp, human
gataggcatgccagacgttt

SEQ ID NO: 492 - DNA, 20 bp, human
gtggtttctacctaaacgtc

SEQ ID NO: 493 - DNA, 20 bp, human
gcaaaaatgttttagttacg

SEQ ID NO: 494 - DNA, 20 bp, human
gaagttaacctctaaaattg

SEQ ID NO: 495 - DNA, 20 bp, human
gaataacttactgcttttaa

SEQ ID NO: 496 - DNA, 20 bp, human
gggaggagctacatgaacta

SEQ ID NO: 497 - DNA, 20 bp, human
gcttaagaaaggaagtaagt

SEQ ID NO: 498 - DNA, 20 bp, human
ggtgtttatcccagtaccag

SEQ ID NO: 499 - DNA, 20 bp, human
gtttatcccagtaccagagg

SEQ ID NO: 500 - DNA, 20 bp, human
gagaagttaactaaaaaatg

SEQ ID NO: 501 - DNA, 20 bp, human
gtagctcctcctctggtact

SEQ ID NO: 502 - DNA, 20 bp, human
ggagctacatgaactaaggc

SEQ ID NO: 503 - DNA, 20 bp, human
ggctttggaactcttaagaa

SEQ ID NO: 504 - DNA, 20 bp, human
gcaggaagcaaccagataaa

SEQ ID NO: 505 - DNA, 20 bp, human
gtacatgaactaaggcaggc

SEQ ID NO: 506 - DNA, 20 bp, human
gcgatagggacccgggaacg

SEQ ID NO: 507 - DNA, 20 bp, human
gcgcggccagccgcgttccc

SEQ ID NO: 508 - DNA, 20 bp, human
gccggcgggctgaggcgtac

SEQ ID NO: 509 - DNA, 20 bp, human
gcaggcgcgcgcaaagcccg

SEQ ID NO: 510 - DNA, 20 bp, human
gcaaagcccgaggaccctcc

SEQ ID NO: 511 - DNA, 20 bp, human
gcaggcaggggggcctcgca

SEQ ID NO: 512 - DNA, 20 bp, human
gtcgcacgcagcgccatgcg

SEQ ID NO: 513 - DNA, 20 bp, human
gcgcagccgctgcctgggca

SEQ ID NO: 514 - DNA, 20 bp, human
gtgaacggcgatagggaccc

SEQ ID NO: 515 - DNA, 20 bp, human
gaggccagtgaacggcgata

SEQ ID NO: 516 - DNA, 20 bp, human
ggaaataatggactccactg

SEQ ID NO: 517 - DNA, 20 bp, human
gtccactgtggagagttaaa

SEQ ID NO: 518 - DNA, 20 bp, human
gagttaaaaaagaagcccac

SEQ ID NO: 519 - DNA, 20 bp, human
ggaatgatgaaaaccgaggt

SEQ ID NO: 520 - DNA, 20 bp, human
gtcaaagtaaaaataccagt

SEQ ID NO: 521 - DNA, 20 bp, human
gtttagaatgatgaaaaccg

SEQ ID NO: 522 - DNA, 20 bp, human
gaccttttaactctccacag

SEQ ID NO: 523 - DNA, 20 bp, human
gtacttggatagaaacttac

SEQ ID NO: 524 - DNA, 20 bp, human
gccacaaagtaagagttaaa

SEQ ID NO: 525 - DNA, 20 bp, human
gtaaacaacgctacaatact

SEQ ID NO: 526 - DNA, 20 bp, human
ggcgaggttcgaggtgagag

SEQ ID NO: 527 - DNA, 20 bp, human
gttcgaggtgagagaggtcc

SEQ ID NO: 528 - DNA, 20 bp, human
gacctcgcgcgtgtctggca

SEQ ID NO: 529 - DNA, 20 bp, human
gccaaaacaaaggtcttcaa

SEQ ID NO: 530 - DNA, 20 bp, human
ggccgcggcgagcaaagtcc

SEQ ID NO: 531 - DNA, 20 bp, human
ggcagggcctctggacgcgc

SEQ ID NO: 532 - DNA, 20 bp, human
gcagacacgcgcgaggttcg

SEQ ID NO: 533 - DNA, 20 bp, human
gatcttgaggcggcaaagaa

SEQ ID NO: 534 - DNA, 20 bp, human
gaagggagacccgggacgtg

SEQ ID NO: 535 - DNA, 20 bp, human
ggcaggactaagttcaccct

SEQ ID NO: 536 - DNA, 20 bp, human
ggctcacagagagatattag

SEQ ID NO: 537 - DNA, 20 bp, human
gcctcttagaaaagaattaa

SEQ ID NO: 538 - DNA, 20 bp, human
gatgttggccagttgtttat

SEQ ID NO: 539 - DNA, 20 bp, human
gataacctggaaaatatgaa

SEQ ID NO: 540 - DNA, 20 bp, human
ggctcctcgggctattgcga

SEQ ID NO: 541 - DNA, 20 bp, human
gaaaccttcgcaatagcccg

SEQ ID NO: 542 - DNA, 20 bp, human
gtgcattgagttagacatga

SEQ ID NO: 543 - DNA, 20 bp, human
gtccatagcagttattgcat

SEQ ID NO: 544 - DNA, 20 bp, human
gtgcgaaggtttcaaagtga

SEQ ID NO: 545 - DNA, 20 bp, human
gtcactttgtttgttcctgt

SEQ ID NO: 546 - DNA, 20 bp, human
ggccgccacgcactcacgca

SEQ ID NO: 547 - DNA, 20 bp, human
ggaagcagctgcagcacgta

SEQ ID NO: 548 - DNA, 20 bp, human
gcacgtagggagagatgcga

SEQ ID NO: 549 - DNA, 20 bp, human
gggactggtcactcggagag

SEQ ID NO: 550 - DNA, 20 bp, human
gcccgcagcttggcgcccag

SEQ ID NO: 551 - DNA, 20 bp, human
gcacgctcgtgccctcgacg

SEQ ID NO: 552 - DNA, 20 bp, human
gcaacaccgagcattcccgt

SEQ ID NO: 553 - DNA, 20 bp, human
ggccctgcgtgagtgcgtgg

SEQ ID NO: 554 - DNA, 20 bp, human
gccagagccatccgcgtcga

SEQ ID NO: 555 - DNA, 20 bp, human
gcagcggggccgtgctgaga

SEQ ID NO: 556 - DNA, 20 bp, human
gagccgctaacagagactaa

SEQ ID NO: 557 - DNA, 20 bp, human
gtaggctcgagcggttccca

SEQ ID NO: 558 - DNA, 20 bp, human
gatgcattcttggcgctggg

SEQ ID NO: 559 - DNA, 20 bp, human
ggatcagaatcgcggagtgc

SEQ ID NO: 560 - DNA, 20 bp, human
gaagggcaaggggacctgta

SEQ ID NO: 561 - DNA, 20 bp, human
gaaaggccggatcagaatcg

SEQ ID NO: 562 - DNA, 20 bp, human
gaaacggggcaggaggttct

SEQ ID NO: 563 - DNA, 20 bp, human
gaggacacctggagcgctgg

SEQ ID NO: 564 - DNA, 20 bp, human
gagaatagggtgaagggcaa

SEQ ID NO: 565 - DNA, 20 bp, human
gctctctctgccccgaggtc

SEQ ID NO: 566 - DNA, 20 bp, human
ggccaacatagagccctcag

SEQ ID NO: 567 - DNA, 20 bp, human
ggtgaaactgctattgccgg

SEQ ID NO: 568 - DNA, 20 bp, human
gcgcgtgtcagccagaagga

SEQ ID NO: 569 - DNA, 20 bp, human
gcagtccgcactcccgaccg

SEQ ID NO: 570 - DNA, 20 bp, human
gggaaaggggacccccggtc

SEQ ID NO: 571 - DNA, 20 bp, human
gcccactgagggctctatgt

SEQ ID NO: 572 - DNA, 20 bp, human
gatgcaccagcatgctgacg

SEQ ID NO: 573 - DNA, 20 bp, human
gccagaaggaggggacgctc

SEQ ID NO: 574 - DNA, 20 bp, human
gcactccagtcgccagcagg

SEQ ID NO: 575 - DNA, 20 bp, human
gggacccccggtcgggagtg

SEQ ID NO: 576 - DNA, 20 bp, human
ggcagcggcgcagcgcgggt

SEQ ID NO: 577 - DNA, 20 bp, human
ggctgcctcttggaaaatgt

SEQ ID NO: 578 - DNA, 20 bp, human
gcgctgcgccgctgcaaggt

SEQ ID NO: 579 - DNA, 20 bp, human
gggaggtgttggaggatcct

SEQ ID NO: 580 - DNA, 20 bp, human
gggtgccaggtaacaggtaa

SEQ ID NO: 581 - DNA, 20 bp, human
ggtgttggaggatcctggga

SEQ ID NO: 582 - DNA, 20 bp, human
gggggaacgacagccatccc

SEQ ID NO: 583 - DNA, 20 bp, human
ggggctggcgcgccttctga

SEQ ID NO: 584 - DNA, 20 bp, human
gcgcgccagccccgtcctgg

SEQ ID NO: 585 - DNA, 20 bp, human
gaggcgcgccagccccgtcc

SEQ ID NO: 586 - DNA, 20 bp, human
ggcggcgccatggctcacgt

SEQ ID NO: 587 - DNA, 20 bp, human
ggacggcggccagttcccag

SEQ ID NO: 588 - DNA, 20 bp, human
gggagtcgcagccggtcccg

SEQ ID NO: 589 - DNA, 20 bp, human
gcgacccccgtccccgggac

SEQ ID NO: 590 - DNA, 20 bp, human
ggagcaggaaagacacctcg

SEQ ID NO: 591 - DNA, 20 bp, human
gcccgcagggcggtcgaggt

SEQ ID NO: 592 - DNA, 20 bp, human
ggaggccgagcagttcctcg

SEQ ID NO: 593 - DNA, 20 bp, human
ggcgccccagacgccactcg

SEQ ID NO: 594 - DNA, 20 bp, human
gccgccgcgagtggcgtctg

SEQ ID NO: 595 - DNA, 20 bp, human
gcacccggctccaaacccct

SEQ ID NO: 596 - DNA, 20 bp, human
gctggcgctagcgctggcgg

SEQ ID NO: 597 - DNA, 20 bp, human
gcaggaaggcctcctcacgg

SEQ ID NO: 598 - DNA, 20 bp, human
gaggggacgctagagatggg

SEQ ID NO: 599 - DNA, 20 bp, human
gggtcagagccgccgtgagg

SEQ ID NO: 600 - DNA, 20 bp, human
gttcctgcggagcagagcgt

SEQ ID NO: 601 - DNA, 20 bp, human
gccgaccctccaaaacccca

SEQ ID NO: 602 - DNA, 20 bp, human
gcagacgggaaccccaaaac

SEQ ID NO: 603 - DNA, 20 bp, human
gccccggcacgtacccagag

SEQ ID NO: 604 - DNA, 20 bp, human
gcaaggcatgggggaaactt

SEQ ID NO: 605 - DNA, 20 bp, human
gggaaggggacgctagagat

SEQ ID NO: 606 - DNA, 20 bp, human
gtggcaccccacctagaggt

SEQ ID NO: 607 - DNA, 20 bp, human
gtagcgaggtctctggagta

SEQ ID NO: 608 - DNA, 20 bp, human
gctaggtggggtgccagccg

SEQ ID NO: 609 - DNA, 20 bp, human
gggtcttccaacctctaggt

SEQ ID NO: 610 - DNA, 20 bp, human
gccccgaggtgggtagagac

SEQ ID NO: 611 - DNA, 20 bp, human
ggctaggtcttccaacctct

SEQ ID NO: 612 - DNA, 20 bp, human
gcggtaccaagggtaaaaac

SEQ ID NO: 613 - DNA, 20 bp, human
gggctgtgcagggtaacagc

SEQ ID NO: 614 - DNA, 20 bp, human
gccttcaggtgaggcgtcca

SEQ ID NO: 615 - DNA, 20 bp, human
gtaccaagggtaaaaacggg

SEQ ID NO: 616 - DNA, 20 bp, human
gacgctcaagtcttaccggg

SEQ ID NO: 617 - DNA, 20 bp, human
gaggacgctcaagtcttacc

SEQ ID NO: 618 - DNA, 20 bp, human
gtggcttcgcgctgctctct

SEQ ID NO: 619 - DNA, 20 bp, human
gggcagaggctgcaagccgt

SEQ ID NO: 620 - DNA, 20 bp, human
gcacgtctttccgcataggt

SEQ ID NO: 621 - DNA, 20 bp, human
gcgtagcgcgtagccggaag

SEQ ID NO: 622 - DNA, 20 bp, human
gcgcgctacggtccgtcccc

SEQ ID NO: 623 - DNA, 20 bp, human
gcttgagcgtcctacctatg

SEQ ID NO: 624 - DNA, 20 bp, human
gagcgcgtagccggaagcgg

SEQ ID NO: 625 - DNA, 20 bp, human
gtgcaatggcgcgataccca

SEQ ID NO: 626 - DNA, 20 bp, human
ggcacactaacgtgcagaaa

SEQ ID NO: 627 - DNA, 20 bp, human
gtacttctaggataactaga

SEQ ID NO: 628 - DNA, 20 bp, human
gtggtacaatctttccacat

SEQ ID NO: 629 - DNA, 20 bp, human
gaaaagtcttcatagaagtc

SEQ ID NO: 630 - DNA, 20 bp, human
gtctgtgtggcaaagaacgc

SEQ ID NO: 631 - DNA, 20 bp, human
ggctatggattactcagtat

SEQ ID NO: 632 - DNA, 20 bp, human
gcgtcacctggatagcgcaa

SEQ ID NO: 633 - DNA, 20 bp, human
gtggaaacaggctaatgcta

SEQ ID NO: 634 - DNA, 20 bp, human
gggaaggacagacttgtgcg

SEQ ID NO: 635 - DNA, 20 bp, human
gctttgccacacagagtggc

SEQ ID NO: 636 - DNA, 20 bp, human
gccaagagcagaaaacccta

SEQ ID NO: 637 - DNA, 20 bp, human
gagcagaaaaccctatggtg

SEQ ID NO: 638 - DNA, 20 bp, human
gggagccggtccaatgacca

SEQ ID NO: 639 - DNA, 20 bp, human
gcaaccaaaaccacaccata

SEQ ID NO: 640 - DNA, 20 bp, human
gctggtccagatctgagata

SEQ ID NO: 641 - DNA, 20 bp, human
gcaacccaacatgagaaaag

SEQ ID NO: 642 - DNA, 20 bp, human
gtctggaccagcgaggccgg

SEQ ID NO: 643 - DNA, 20 bp, human
gtccccaggccaaaagccca

SEQ ID NO: 644 - DNA, 20 bp, human
ggtcccttaatgctacgctg

SEQ ID NO: 645 - DNA, 20 bp, human
gctccaggctgccatcagga

SEQ ID NO: 646 - DNA, 20 bp, human
gtctcagcaagactcagtca

SEQ ID NO: 647 - DNA, 20 bp, human
gttcctcacacggattaaat

SEQ ID NO: 648 - DNA, 20 bp, human
gtcacacggattaaattgga

SEQ ID NO: 649 - DNA, 20 bp, human
gctccagaggatataagatc

SEQ ID NO: 650 - DNA, 20 bp, human
gcttgtttcatcaaagaaag

SEQ ID NO: 651 - DNA, 20 bp, human
ggtggtagttagttaactta

SEQ ID NO: 652 - DNA, 20 bp, human
ggtagttagttaacttaggg

SEQ ID NO: 653 - DNA, 20 bp, human
ggccttctctaaagagaaac

SEQ ID NO: 654 - DNA, 20 bp, human
gctaaaaagccctagggaca

SEQ ID NO: 655 - DNA, 20 bp, human
gggttaacgattaaatggtt

SEQ ID NO: 656 - DNA, 20 bp, human
gcgagcgcggtcggacccag

SEQ ID NO: 657 - DNA, 20 bp, human
gcgaggcgcggctgcaagga

SEQ ID NO: 658 - DNA, 20 bp, human
gccttccgcacccgacggag

SEQ ID NO: 659 - DNA, 20 bp, human
gccagtgctgcagccgggaa

SEQ ID NO: 660 - DNA, 20 bp, human
gggcgcccaggccgtctcag

SEQ ID NO: 661 - DNA, 20 bp, human
ggcagggagaccggacccag

SEQ ID NO: 662 - DNA, 20 bp, human
gaaccgcacagggcgtccat

SEQ ID NO: 663 - DNA, 20 bp, human
ggcgcggtcggacccagcgg

SEQ ID NO: 664 - DNA, 20 bp, human
gtccatcccagcccctccgt

SEQ ID NO: 665 - DNA, 20 bp, human
ggcaaccgagtcctaacctg

SEQ ID NO: 666 - DNA, 20 bp, human
gcgccgcggacgcactctcc

SEQ ID NO: 667 - DNA, 20 bp, human
ggccccagcatccctgcttg

SEQ ID NO: 668 - DNA, 20 bp, human
gcgctcctggacctcaagca

SEQ ID NO: 669 - DNA, 20 bp, human
ggccgagcggacaggcgtgg

SEQ ID NO: 670 - DNA, 20 bp, human
gcggggtcgcgctgatcagg

SEQ ID NO: 671 - DNA, 20 bp, human
gaggctccagccgagcggac

SEQ ID NO: 672 - DNA, 20 bp, human
gttcacaggctccagccgag

SEQ ID NO: 673 - DNA, 20 bp, human
gccggaagcggctgcttcac

SEQ ID NO: 674 - DNA, 20 bp, human
gagtgcgtccgcggcgccag

SEQ ID NO: 675 - DNA, 20 bp, human
ggcttcacctcctggtacac

SEQ ID NO: 676 - DNA, 20 bp, human
gggcggcggcaggagaccag

SEQ ID NO: 677 - DNA, 20 bp, human
gctgggatgcccgggcccta

SEQ ID NO: 678 - DNA, 20 bp, human
ggctcgggagcgtggttgag

SEQ ID NO: 679 - DNA, 20 bp, human
ggcggccgatgccgctataa

SEQ ID NO: 680 - DNA, 20 bp, human
gcgagcgcgacccacaccca

SEQ ID NO: 681 - DNA, 20 bp, human
ggggctgtgggaacgcccta

SEQ ID NO: 682 - DNA, 20 bp, human
gagagaaacgcccacctggg

SEQ ID NO: 683 - DNA, 20 bp, human
gtgggaacgccctagggccc

SEQ ID NO: 684 - DNA, 20 bp, human
ggtgtgggtcgcgctcgcct

SEQ ID NO: 685 - DNA, 20 bp, human
gccgtgacaaccgagctgga

SEQ ID NO: 686 - DNA, 20 bp, human
gctcttagcaaaggactcca

SEQ ID NO: 687 - DNA, 20 bp, human
ggagagtggggcgcgatggg

SEQ ID NO: 688 - DNA, 20 bp, human
gagcctggaaaaggagagtg

SEQ ID NO: 689 - DNA, 20 bp, human
gtgggacccacgacgacaga

SEQ ID NO: 690 - DNA, 20 bp, human
gcgacgacagaaggcgccga

SEQ ID NO: 691 - DNA, 20 bp, human
gagtggagttcatggagtgg

SEQ ID NO: 692 - DNA, 20 bp, human
gccctagtagctgggaggtc

SEQ ID NO: 693 - DNA, 20 bp, human
gtagtagctgggaggtctgg

SEQ ID NO: 694 - DNA, 20 bp, human
gtccctggccctcgaaatgc

SEQ ID NO: 695 - DNA, 20 bp, human
gtgtctgtcgctaagtctct

SEQ ID NO: 696 - DNA, 20 bp, human
ggcggagctgcaagggacag

SEQ ID NO: 697 - DNA, 20 bp, human
ggatcccgcgccaaacacag

SEQ ID NO: 698 - DNA, 20 bp, human
ggtgtttggcgcgggatcgg

SEQ ID NO: 699 - DNA, 20 bp, human
gtgaagagtaggaagacgtg

SEQ ID NO: 700 - DNA, 20 bp, human
gggggcaccgggggagtgaa

SEQ ID NO: 701 - DNA, 20 bp, human
gaccagggggtcctcaacaa

SEQ ID NO: 702 - DNA, 20 bp, human
gaccccctggtccacccggt

SEQ ID NO: 703 - DNA, 20 bp, human
gccgggcggcggagctgcaa

SEQ ID NO: 704 - DNA, 20 bp, human
gggggaccccgggaacgagg

SEQ ID NO: 705 - DNA, 20 bp, human
gggtcgggcctcaccctccg

SEQ ID NO: 706 - DNA, 20 bp, human
gcccggctcgagaagtgaag

SEQ ID NO: 707 - DNA, 20 bp, human
ggctcgagaagtgaaggggt

SEQ ID NO: 708 - DNA, 20 bp, human
ggaaggtagctcaagtgcac

SEQ ID NO: 709 - DNA, 20 bp, human
gagctcaagtgcaccggcag

SEQ ID NO: 710 - DNA, 20 bp, human
gaggtctccggccccaggcg

SEQ ID NO: 711 - DNA, 20 bp, human
ggcactgcgtgcttcgccta

SEQ ID NO: 712 - DNA, 20 bp, human
gtgcgtgcttcgcctagggg

SEQ ID NO: 713 - DNA, 20 bp, human
gggcattcatgtaaaagaca

SEQ ID NO: 714 - DNA, 20 bp, human
ggaagtgcgagagagtgcga

SEQ ID NO: 715 - DNA, 20 bp, human
gagttgatttgagtaggaga

SEQ ID NO: 716 - DNA, 20 bp, human
gcttcagccaggctgcggag

SEQ ID NO: 717 - DNA, 20 bp, human
ggagcaccggcatgtcacct

SEQ ID NO: 718 - DNA, 20 bp, human
ggagaggtctcgggcagagg

SEQ ID NO: 719 - DNA, 20 bp, human
gcggggaggggcgccaccgg

SEQ ID NO: 720 - DNA, 20 bp, human
gaccagccccagtccctacg

SEQ ID NO: 721 - DNA, 20 bp, human
gagccaggctgcggagcgga

SEQ ID NO: 722 - DNA, 20 bp, human
gtgtcgcttcagccaggctg

SEQ ID NO: 723 - DNA, 20 bp, human
gctgggctggctgccgcgta

SEQ ID NO: 724 - DNA, 20 bp, human
ggagccaagttcctccactt

SEQ ID NO: 725 - DNA, 20 bp, human
ggccagcccaggtgacatgc

SEQ ID NO: 726 - DNA, 20 bp, human
gtcattcccggtagatgcag

SEQ ID NO: 727 - DNA, 20 bp, human
ggagaaacgctgcagactat

SEQ ID NO: 728 - DNA, 20 bp, human
gagactccgctgcatctacc

SEQ ID NO: 729 - DNA, 20 bp, human
gctgcattcactccaggcga

SEQ ID NO: 730 - DNA, 20 bp, human
gtgtgaccactgaaacaggg

SEQ ID NO: 731 - DNA, 20 bp, human
gctcttagcagcactcgatc

SEQ ID NO: 732 - DNA, 20 bp, human
gagcatatgccgcagccacc

SEQ ID NO: 733 - DNA, 20 bp, human
gaaaccctctatcccatcat

SEQ ID NO: 734 - DNA, 20 bp, human
ggcagactatgggacgctgt

SEQ ID NO: 735 - DNA, 20 bp, human
gttgccaatgatgggataga

SEQ ID NO: 736 - DNA, 20 bp, human
ggtaccagcgagccggcgag

SEQ ID NO: 737 - DNA, 20 bp, human
gtacttgctgaaggccgcca

SEQ ID NO: 738 - DNA, 20 bp, human
gccccgcgctgcgtgcagta

SEQ ID NO: 739 - DNA, 20 bp, human
gactgccggtaccagcgagc

SEQ ID NO: 740 - DNA, 20 bp, human
gcacagaagggggtgatgta

SEQ ID NO: 741 - DNA, 20 bp, human
gggcgacctcgctccacccc

SEQ ID NO: 742 - DNA, 20 bp, human
ggccttcagcaagtacttga

SEQ ID NO: 743 - DNA, 20 bp, human
gagagacctgtcggccgggt

SEQ ID NO: 744 - DNA, 20 bp, human
ggtcgggcaaagagacctgt

SEQ ID NO: 745 - DNA, 20 bp, human
gcaggcagcggcctccagtt

SEQ ID NO: 746 - DNA, 20 bp, human
gtccctcgggtctcaggtca

SEQ ID NO: 747 - DNA, 20 bp, human
gcggcgtttgatagagagga

SEQ ID NO: 748 - DNA, 20 bp, human
ggccatgacctgagacccga

SEQ ID NO: 749 - DNA, 20 bp, human
gtactgggtagagtccgagg

SEQ ID NO: 750 - DNA, 20 bp, human
gctacccagtactgaactag

SEQ ID NO: 751 - DNA, 20 bp, human
gcaccctgtgggccaatgca

SEQ ID NO: 752 - DNA, 20 bp, human
ggctgggctccagagtccct

SEQ ID NO: 753 - DNA, 20 bp, human
ggctgcccctagttcagtac

SEQ ID NO: 754 - DNA, 20 bp, human
gagagtggctgtctgaaaag

SEQ ID NO: 755 - DNA, 20 bp, human
ggaaagaggagctctcgaag

SEQ ID NO: 756 - DNA, 20 bp, human
gcgttggcgaagccagctgc

SEQ ID NO: 757 - DNA, 20 bp, human
gctgtgtggctgaaaagtga

SEQ ID NO: 758 - DNA, 20 bp, human
ggccgtgagaacacgctgtg

SEQ ID NO: 759 - DNA, 20 bp, human
gcggccaccggccaaaatgg

SEQ ID NO: 760 - DNA, 20 bp, human
gaaagggggagtggagacta

SEQ ID NO: 761 - DNA, 20 bp, human
gcgggtgtggcaggcaacag

SEQ ID NO: 762 - DNA, 20 bp, human
ggcgcgcgcactacgtccta

SEQ ID NO: 763 - DNA, 20 bp, human
gccacctaaggcctaaccaa

SEQ ID NO: 764 - DNA, 20 bp, human
ggccacacagcgtgttctca

SEQ ID NO: 765 - DNA, 20 bp, human
gtcacggccaccggccaaaa

SEQ ID NO: 766 - DNA, 20 bp, human
ggtggcagttacagctactg

SEQ ID NO: 767 - DNA, 20 bp, human
gcctggtggaatacagtgta

SEQ ID NO: 768 - DNA, 20 bp, human
gtggcaccgagggagagatg

SEQ ID NO: 769 - DNA, 20 bp, human
gcggaagcggaaatagcacc

SEQ ID NO: 770 - DNA, 20 bp, human
gtccccggcaaactcctccc

SEQ ID NO: 771 - DNA, 20 bp, human
gggcagggctcatatattcc

SEQ ID NO: 772 - DNA, 20 bp, human
gacgtgacctaagtgagact

SEQ ID NO: 773 - DNA, 20 bp, human
ggcgcgcatacacacacctt

SEQ ID NO: 774 - DNA, 20 bp, human
gtgcgcagtaactcccgcag

SEQ ID NO: 775 - DNA, 20 bp, human
gggttccccgccgccggaag

SEQ ID NO: 776 - DNA, 20 bp, human
ggagaagaatcggatcaata

SEQ ID NO: 777 - DNA, 20 bp, human
gtgccaagccggagaagaat

SEQ ID NO: 778 - DNA, 20 bp, human
gatcaataaggtgacagtgg

SEQ ID NO: 779 - DNA, 20 bp, human
gccggcttggcaggcttagg

SEQ ID NO: 780 - DNA, 20 bp, human
gtctccggcttggcaggctt

SEQ ID NO: 781 - DNA, 20 bp, human
gatggccagaaggtgctaaa

SEQ ID NO: 782 - DNA, 20 bp, human
gtagcaccttctggccatgg

SEQ ID NO: 783 - DNA, 20 bp, human
ggcgggaaattactccacca

SEQ ID NO: 784 - DNA, 20 bp, human
gtagaatacatgcccaggct

SEQ ID NO: 785 - DNA, 20 bp, human
gttactccaccatggccaga

SEQ ID NO: 786 - DNA, 20 bp, human
gccgcacgcggaggatccta

SEQ ID NO: 787 - DNA, 20 bp, human
gaccaggttctgcccctcag

SEQ ID NO: 788 - DNA, 20 bp, human
ggacggagacctccgctgag

SEQ ID NO: 789 - DNA, 20 bp, human
ggcgaggcccagtgagttag

SEQ ID NO: 790 - DNA, 20 bp, human
gtgcggagcgccaagttgta

SEQ ID NO: 791 - DNA, 20 bp, human
gggaggaagcccggaaagtg

SEQ ID NO: 792 - DNA, 20 bp, human
ggaagaggcccgagacggac

SEQ ID NO: 793 - DNA, 20 bp, human
gcgagcgtggagactcggag

SEQ ID NO: 794 - DNA, 20 bp, human
ggcgcgccgagaaccacccg

SEQ ID NO: 795 - DNA, 20 bp, human
ggtgagccggccgcacgcgg

SEQ ID NO: 796 - DNA, 20 bp, human
ggacttgcgccgaaatcctg

SEQ ID NO: 797 - DNA, 20 bp, human
ggcgcggacgggttcctgag

SEQ ID NO: 798 - DNA, 20 bp, human
gtcacagcgactgcgcggac

SEQ ID NO: 799 - DNA, 20 bp, human
ggacctggtggaagctgtag

SEQ ID NO: 800 - DNA, 20 bp, human
gctattgcaagaggtgtccg

SEQ ID NO: 801 - DNA, 20 bp, human
ggagtctgtggatgacctgg

SEQ ID NO: 802 - DNA, 20 bp, human
ggggacagcaaggatgacgc

SEQ ID NO: 803 - DNA, 20 bp, human
ggaggcctggcaacagtccc

SEQ ID NO: 804 - DNA, 20 bp, human
ggcgagttccccgaaattga

SEQ ID NO: 805 - DNA, 20 bp, human
ggaagggacggcgaacggtc

SEQ ID NO: 806 - DNA, 20 bp, human
ggccatcggtccaacttgta

SEQ ID NO: 807 - DNA, 20 bp, human
gcagcccgcaccccgcgcag

SEQ ID NO: 808 - DNA, 20 bp, human
gtcctctgggcgctgaccca

SEQ ID NO: 809 - DNA, 20 bp, human
gggagccgggcgccactcta

SEQ ID NO: 810 - DNA, 20 bp, human
gctcgggatgccccttgcac

SEQ ID NO: 811 - DNA, 20 bp, human
ggcagagagcacggactagg

SEQ ID NO: 812 - DNA, 20 bp, human
gccggcagagagcacggact

SEQ ID NO: 813 - DNA, 20 bp, human
ggagcacggactaggtggag

SEQ ID NO: 814 - DNA, 20 bp, human
ggaggacgcgctcctgggag

SEQ ID NO: 815 - DNA, 20 bp, human
ggacccagggcaccctagag

SEQ ID NO: 816 - DNA, 20 bp, human
gccactgcgttcagctctgg

SEQ ID NO: 817 - DNA, 20 bp, human
ggctcgtcccctggatgtcc

SEQ ID NO: 818 - DNA, 20 bp, human
ggggagacccggacatccag

SEQ ID NO: 819 - DNA, 20 bp, human
gacatccaggggacgagctc

SEQ ID NO: 820 - DNA, 20 bp, human
gcggtccacagcccgaagcg

SEQ ID NO: 821 - DNA, 20 bp, human
gggcagcctgtggaggaact

SEQ ID NO: 822 - DNA, 20 bp, human
gagagctcggtcttaaccaa

SEQ ID NO: 823 - DNA, 20 bp, human
gtcaggatgcgtgcgctcgg

SEQ ID NO: 824 - DNA, 20 bp, human
gtgcggctggaggtcacgat

SEQ ID NO: 825 - DNA, 20 bp, human
gccactgagattgagagacg

SEQ ID NO: 826 - DNA, 20 bp, human
gctcggaggacacagcgtcc

SEQ ID NO: 827 - DNA, 20 bp, human
ggcttcccagagcctggtcc

SEQ ID NO: 828 - DNA, 20 bp, human
ggcgtccgggaccaggctct

SEQ ID NO: 829 - DNA, 20 bp, human
gagtcgccccgcgggctcgg

SEQ ID NO: 830 - DNA, 20 bp, human
gcggcaaggatggtgagagg

SEQ ID NO: 831 - DNA, 20 bp, human
gccggcgagcagtagctggt

SEQ ID NO: 832 - DNA, 20 bp, human
ggagagcgcagtcgccccgc

SEQ ID NO: 833 - DNA, 20 bp, human
gggcgtcgcgccaagggatg

SEQ ID NO: 834 - DNA, 20 bp, human
gctcaaaactaagcgcccca

SEQ ID NO: 835 - DNA, 20 bp, human
gtggctttggggacagcccg

SEQ ID NO: 836 - DNA, 20 bp, human
gcaggccgtagacactgggt

SEQ ID NO: 837 - DNA, 20 bp, human
gggcctgggcataaacaaag

SEQ ID NO: 838 - DNA, 20 bp, human
gcccaactgaagccactctg

SEQ ID NO: 839 - DNA, 20 bp, human
ggagggcaggccgtagacac

SEQ ID NO: 840 - DNA, 20 bp, human
ggccaacaggcagcaaagct

SEQ ID NO: 841 - DNA, 20 bp, human
ggagcccgaagtgcccagac

SEQ ID NO: 842 - DNA, 20 bp, human
gcctcctacagcgtcaggta

SEQ ID NO: 843 - DNA, 20 bp, human
gcgtagacactgggttggca

SEQ ID NO: 844 - DNA, 20 bp, human
gtagtggatcgggtggagag

SEQ ID NO: 845 - DNA, 20 bp, human
gaactgaagccactctgggg

SEQ ID NO: 846 - DNA, 20 bp, human
gcccacaggtctgtgaccct

SEQ ID NO: 847 - DNA, 20 bp, human
gctaagagagctgcagccca

SEQ ID NO: 848 - DNA, 20 bp, human
gtaggacagaaggctcctga

SEQ ID NO: 849 - DNA, 20 bp, human
gtcccggccatggggcccac

SEQ ID NO: 850 - DNA, 20 bp, human
gcgggtggtgctaggacaga

SEQ ID NO: 851 - DNA, 20 bp, human
gcactcaccgaggtatcctg

SEQ ID NO: 852 - DNA, 20 bp, human
gaagtcggcccaggcctggt

SEQ ID NO: 853 - DNA, 20 bp, human
ggacctgtgggccccatggc

SEQ ID NO: 854 - DNA, 20 bp, human
gatggccgggaaggcggcag

SEQ ID NO: 855 - DNA, 20 bp, human
gccggacatcaagcagtgtg

SEQ ID NO: 856 - DNA, 20 bp, human
gggatgcagaggcactagag

SEQ ID NO: 857 - DNA, 20 bp, human
gtatagggagcagcaccctc

SEQ ID NO: 858 - DNA, 20 bp, human
ggggatcacatgggatgcag

SEQ ID NO: 859 - DNA, 20 bp, human
ggctggcatggggatcacat

SEQ ID NO: 860 - DNA, 20 bp, human
ggacctgcacaggccgccta

SEQ ID NO: 861 - DNA, 20 bp, human
gacccgccgcccgccatagg

SEQ ID NO: 862 - DNA, 20 bp, human
gcccacccgccgcccgccat

SEQ ID NO: 863 - DNA, 20 bp, human
gctgcacaggccgcctatgg

SEQ ID NO: 864 - DNA, 20 bp, human
ggagccgactctccattcgg

SEQ ID NO: 865 - DNA, 20 bp, human
gctaccaccgaatggagagt

SEQ ID NO: 866 - DNA, 20 bp, human
ggggacaactacgaagatgg

SEQ ID NO: 867 - DNA, 20 bp, human
ggcgtagcgtgtccctcagt

SEQ ID NO: 868 - DNA, 20 bp, human
gtgagggacacgctacgcaa

SEQ ID NO: 869 - DNA, 20 bp, human
ggtgttggcctttaatgcag

SEQ ID NO: 870 - DNA, 20 bp, human
gcggtaactgacggaacccg

SEQ ID NO: 871 - DNA, 20 bp, human
gcagctccgacaaggtaccc

SEQ ID NO: 872 - DNA, 20 bp, human
ggcggggacaactacgaaga

SEQ ID NO: 873 - DNA, 20 bp, human
ggcgcgcttggcagctgtgg

SEQ ID NO: 874 - DNA, 20 bp, human
ggcacaggcacggtaactga

SEQ ID NO: 875 - DNA, 20 bp, human
gcgccaaagacgcactgcac

SEQ ID NO: 876 - DNA, 20 bp, human
gcctccaggctcgggtccag

SEQ ID NO: 877 - DNA, 20 bp, human
gccgagccgaggtcagtcaa

SEQ ID NO: 878 - DNA, 20 bp, human
ggtctgctgggccaagatct

SEQ ID NO: 879 - DNA, 20 bp, human
gggccggctcgcatctcaca

SEQ ID NO: 880 - DNA, 20 bp, human
ggcccagcagacaggccgta

SEQ ID NO: 881 - DNA, 20 bp, human
gcgcgaagctagggccgtgg

SEQ ID NO: 882 - DNA, 20 bp, human
gccctcacgcgggagcctcc

SEQ ID NO: 883 - DNA, 20 bp, human
ggagcatgcttgcaagctgt

SEQ ID NO: 884 - DNA, 20 bp, human
gtgggcggggctgcgagcta

SEQ ID NO: 885 - DNA, 20 bp, human
ggtagggtgagctttcgagt

SEQ ID NO: 886 - DNA, 20 bp, human
gtgcgccggctacgaaccag

SEQ ID NO: 887 - DNA, 20 bp, human
gtcgggcggacggccactct

SEQ ID NO: 888 - DNA, 20 bp, human
gtggcggcggctgtgagcgg

SEQ ID NO: 889 - DNA, 20 bp, human
ggcggacggccactctggga

SEQ ID NO: 890 - DNA, 20 bp, human
gctgggatgtgaggagcggc

SEQ ID NO: 891 - DNA, 20 bp, human
gacacaggcgcggacggggg

SEQ ID NO: 892 - DNA, 20 bp, human
gcgggccaaatgcgggacac

SEQ ID NO: 893 - DNA, 20 bp, human
gcaaatgcgggacacaggcg

SEQ ID NO: 894 - DNA, 20 bp, human
ggaggggctgggaggtaccg

SEQ ID NO: 895 - DNA, 20 bp, human
gtggccgtccgcccgatccg

SEQ ID NO: 896 - DNA, 20 bp, human
gcggactgcagctcccgcgg

SEQ ID NO: 897 - DNA, 20 bp, human
ggtggcggcgtatcgggaca

SEQ ID NO: 898 - DNA, 20 bp, human
gttgaggctgaggatagcaa

SEQ ID NO: 899 - DNA, 20 bp, human
gctggaccagcgagactctc

SEQ ID NO: 900 - DNA, 20 bp, human
gcgccggggcgggaaggtcg

SEQ ID NO: 901 - DNA, 20 bp, human
gccagcgagactctcaggtt

SEQ ID NO: 902 - DNA, 20 bp, human
gatcgggacacggcgcggga

SEQ ID NO: 903 - DNA, 20 bp, human
gatggacgcgcaggactgcc

SEQ ID NO: 904 - DNA, 20 bp, human
ggacgcgcaggactgccagg

SEQ ID NO: 905 - DNA, 20 bp, human
ggcggcggtggcggcgtatc

SEQ ID NO: 906 - DNA, 20 bp, human
gcgccggcaaatgcccccgc

SEQ ID NO: 907 - DNA, 20 bp, human
ggcccccgctcgggtgtcgc

SEQ ID NO: 908 - DNA, 20 bp, human
gggagctccgggctagaccg

SEQ ID NO: 909 - DNA, 20 bp, human
gtccgctcaccactcaccag

SEQ ID NO: 910 - DNA, 20 bp, human
gtgagtggtgagcggagtcg

SEQ ID NO: 911 - DNA, 20 bp, human
gtagaccgtggcgccggcag

SEQ ID NO: 912 - DNA, 20 bp, human
ggcccccgcacgacccccag

SEQ ID NO: 913 - DNA, 20 bp, human
gaaggtgcgcgcattgccag

SEQ ID NO: 914 - DNA, 20 bp, human
gggaggatgatgaggagcga

SEQ ID NO: 915 - DNA, 20 bp, human
gtcccctggtgagtggtgag

SEQ ID NO: 916 - DNA, 20 bp, human
gggtaaagacggccctcccc

SEQ ID NO: 917 - DNA, 20 bp, human
gcccaacgggatgagcgggc

SEQ ID NO: 918 - DNA, 20 bp, human
gccgcacagcgccccgacca

SEQ ID NO: 919 - DNA, 20 bp, human
ggcggaggcagccatggtcg

SEQ ID NO: 920 - DNA, 20 bp, human
ggctcctggccgcctagagc

SEQ ID NO: 921 - DNA, 20 bp, human
gggagctgcggaggcagcca

SEQ ID NO: 922 - DNA, 20 bp, human
ggcagctccgcgggccgctc

SEQ ID NO: 923 - DNA, 20 bp, human
ggccaggagcgcggccatct

SEQ ID NO: 924 - DNA, 20 bp, human
ggccccggggcagagtcccg

SEQ ID NO: 925 - DNA, 20 bp, human
gccgggcccaacgggatgag

SEQ ID NO: 926 - DNA, 20 bp, human
gagtgcagggcgggtacctg

SEQ ID NO: 927 - DNA, 20 bp, human
ggcgtgctggcggtgacctg

SEQ ID NO: 928 - DNA, 20 bp, human
ggagccagaaccgtagtccg

SEQ ID NO: 929 - DNA, 20 bp, human
ggggtacctggggagctgcg

SEQ ID NO: 930 - DNA, 20 bp, human
gacgggaagcaggcgcgtgc

SEQ ID NO: 931 - DNA, 20 bp, human
gtggctcgctagctctggaa

SEQ ID NO: 932 - DNA, 20 bp, human
gtgcgtggactcgcgcagac

SEQ ID NO: 933 - DNA, 20 bp, human
gggaagcaggcgcgtgctgg

SEQ ID NO: 934 - DNA, 20 bp, human
gctggaagggagcaccggga

SEQ ID NO: 935 - DNA, 20 bp, human
gcacaggcgcgcttccacac

SEQ ID NO: 936 - DNA, 20 bp, human
ggcctcctggagttcagtgt

SEQ ID NO: 937 - DNA, 20 bp, human
ggcctcagcgagattactgg

SEQ ID NO: 938 - DNA, 20 bp, human
gagatccggatcccgtcccc

SEQ ID NO: 939 - DNA, 20 bp, human
ggcccacactgaactccagg

SEQ ID NO: 940 - DNA, 20 bp, human
gtcgctgaggcccgaaccag

SEQ ID NO: 941 - DNA, 20 bp, human
gtgaggcccgaaccagaggc

SEQ ID NO: 942 - DNA, 20 bp, human
gctcctcggcaagtctccaa

SEQ ID NO: 943 - DNA, 20 bp, human
gcgggcctcagcgagattac

SEQ ID NO: 944 - DNA, 20 bp, human
gttcctcccgccctatccgg

SEQ ID NO: 945 - DNA, 20 bp, human
gggcagaaccttgcaggaag

SEQ ID NO: 946 - DNA, 20 bp, human
gcgagggcggcgccccacgg

SEQ ID NO: 947 - DNA, 20 bp, human
gcgctacgggcaggacgaag

SEQ ID NO: 948 - DNA, 20 bp, human
ggctcaggcccaggcgctac

SEQ ID NO: 949 - DNA, 20 bp, human
gggtcctaccacccagtcca

SEQ ID NO: 950 - DNA, 20 bp, human
ggaagctggagagccccggc

SEQ ID NO: 951 - DNA, 20 bp, human
ggccaactgcaggtactccc

SEQ ID NO: 952 - DNA, 20 bp, human
gacggccaagatgagcgcga

SEQ ID NO: 953 - DNA, 20 bp, human
ggggccgagcaggccgagaa

SEQ ID NO: 954 - DNA, 20 bp, human
ggcttcgccatgccgccgtg

SEQ ID NO: 955 - DNA, 20 bp, human
ggcccgggagtacctgcagt

SEQ ID NO: 956 - DNA, 20 bp, human
gcacgacacacagggtcggg

SEQ ID NO: 957 - DNA, 20 bp, human
gagggcacacaacacctcag

SEQ ID NO: 958 - DNA, 20 bp, human
gaaggaggcggccagtccgt

SEQ ID NO: 959 - DNA, 20 bp, human
gcggtacgggctgacgtcaa

SEQ ID NO: 960 - DNA, 20 bp, human
ggcacgaaccacgacacaca

SEQ ID NO: 961 - DNA, 20 bp, human
ggcccataatgggaaataag

SEQ ID NO: 962 - DNA, 20 bp, human
gcgggactcaagactcaact

SEQ ID NO: 963 - DNA, 20 bp, human
ggaaccacgacacacagggt

SEQ ID NO: 964 - DNA, 20 bp, human
gctcaagactcaactgggac

SEQ ID NO: 965 - DNA, 20 bp, human
gcgggtctccaggctaggtt

SEQ ID NO: 966 - DNA, 20 bp, human
gcgcggcgatcccggcccag

SEQ ID NO: 967 - DNA, 20 bp, human
ggatcgccgcgagaggcaca

SEQ ID NO: 968 - DNA, 20 bp, human
gagcagatgacgcacatgag

SEQ ID NO: 969 - DNA, 20 bp, human
gaggcacagggcagtcttag

SEQ ID NO: 970 - DNA, 20 bp, human
ggcgcgcgtcatcagggaca

SEQ ID NO: 971 - DNA, 20 bp, human
gagccagcggcccagcgagt

SEQ ID NO: 972 - DNA, 20 bp, human
gagcagcgcgcgcgtcatca

SEQ ID NO: 973 - DNA, 20 bp, human
gcagggccaagagcgcctcg

SEQ ID NO: 974 - DNA, 20 bp, human
ggccgtggtagcgctccacg

SEQ ID NO: 975 - DNA, 20 bp, human
gtgctgcgggacgagacgct

SEQ ID NO: 976 - DNA, 20 bp, human
gccgcagctccccccacgga

SEQ ID NO: 977 - DNA, 20 bp, human
gtcggacgggtgctccccga

SEQ ID NO: 978 - DNA, 20 bp, human
gggcaaaagagcggaatccg

SEQ ID NO: 979 - DNA, 20 bp, human
ggaagcgtttgtcggactgg

SEQ ID NO: 980 - DNA, 20 bp, human
ggctcacttccgtccgtggg

SEQ ID NO: 981 - DNA, 20 bp, human
gcagtttcggggcaaaagag

SEQ ID NO: 982 - DNA, 20 bp, human
ggggtgctccccgaaggcaa

SEQ ID NO: 983 - DNA, 20 bp, human
gcggaatccgcggctcggac

SEQ ID NO: 984 - DNA, 20 bp, human
gggagcacccgtccgagccg

SEQ ID NO: 985 - DNA, 20 bp, human
gaagggccgcgtccgcagga

SEQ ID NO: 986 - DNA, 20 bp, human
gctgcagactggcccgacag

SEQ ID NO: 987 - DNA, 20 bp, human
gccagtcagtggccaactcc

SEQ ID NO: 988 - DNA, 20 bp, human
ggacagaggagcggggacca

SEQ ID NO: 989 - DNA, 20 bp, human
gaggcccgagagcaaccgac

SEQ ID NO: 990 - DNA, 20 bp, human
ggtctgcaggcggagagagt

SEQ ID NO: 991 - DNA, 20 bp, human
gggcaccttcctccagtcag

SEQ ID NO: 992 - DNA, 20 bp, human
gcgacgcgctgtcctccaca

SEQ ID NO: 993 - DNA, 20 bp, human
gtggccaactcctggctcag

SEQ ID NO: 994 - DNA, 20 bp, human
gagcgtgagcggggcccctg

SEQ ID NO: 995 - DNA, 20 bp, human
gaaggtgccaaagctgaccc

SEQ ID NO: 996 - DNA, 20 bp, human
gggctggcccgggaggacgg

SEQ ID NO: 997 - DNA, 20 bp, human
gcgcgagaagaagacctcga

SEQ ID NO: 998 - DNA, 20 bp, human
ggctggcaggcgagcgcgga

SEQ ID NO: 999 - DNA, 20 bp, human
gccgtgtaggtgggctcggg

SEQ ID NO: 1000 - DNA, 20 bp, human
ggcgccagcaccgtgtaggt

SEQ ID NO: 1001 - DNA, 20 bp, human
gaggacggaggacggacgcg

SEQ ID NO: 1002 - DNA, 20 bp, human
gcgagaagagcagcgtgtag

SEQ ID NO: 1003 - DNA, 20 bp, human
ggcgcacggcccgggacaac

SEQ ID NO: 1004 - DNA, 20 bp, human
ggtccgtcctccgtcctccc

SEQ ID NO: 1005 - DNA, 20 bp, human
gcctcagcgagcgcgccgac

SEQ ID NO: 1006 - DNA, 20 bp, human
gagctgcaggaaccagactg

SEQ ID NO: 1007 - DNA, 20 bp, human
gcaggagtgagcaccaatgg

SEQ ID NO: 1008 - DNA, 20 bp, human
gtgagcgccgctggcagccg

SEQ ID NO: 1009 - DNA, 20 bp, human
ggatatacagccggaacccc

SEQ ID NO: 1010 - DNA, 20 bp, human
gggctcggcgaagaaggtcc

SEQ ID NO: 1011 - DNA, 20 bp, human
gcgcagcctgaggggatcct

SEQ ID NO: 1012 - DNA, 20 bp, human
gggcgtggcggcagttactt

SEQ ID NO: 1013 - DNA, 20 bp, human
gccttctgcccgaggaaccg

SEQ ID NO: 1014 - DNA, 20 bp, human
ggaggcctctcgggtatctc

SEQ ID NO: 1015 - DNA, 20 bp, human
ggtggggacagcccagatcg

SEQ ID NO: 1016 - DNA, 20 bp, human
gggagcgcggcttccgacaa

SEQ ID NO: 1017 - DNA, 20 bp, human
ggggtggggttcttcggctc

SEQ ID NO: 1018 - DNA, 20 bp, human
gcgccaggcaggagacactg

SEQ ID NO: 1019 - DNA, 20 bp, human
gagacactgtggtcgggagt

SEQ ID NO: 1020 - DNA, 20 bp, human
gcggcagccccggggatagg

SEQ ID NO: 1021 - DNA, 20 bp, human
ggagcgggcgagagcggacg

SEQ ID NO: 1022 - DNA, 20 bp, human
ggacgctgaagcccaggata

SEQ ID NO: 1023 - DNA, 20 bp, human
gatgctgctcaggtagtaga

SEQ ID NO: 1024 - DNA, 20 bp, human
gagctcgccgcctatccccg

SEQ ID NO: 1025 - DNA, 20 bp, human
gggagagccggctggcgagc

SEQ ID NO: 1026 - DNA, 20 bp, human
ggggcgggctcgccaggacc

SEQ ID NO: 1027 - DNA, 20 bp, human
gccacgactgccgttctggg

SEQ ID NO: 1028 - DNA, 20 bp, human
gctcgacttgccccccagaa

SEQ ID NO: 1029 - DNA, 20 bp, human
ggcccggcaaagagaagatg

SEQ ID NO: 1030 - DNA, 20 bp, human
gcaacatggaatctctccag

SEQ ID NO: 1031 - DNA, 20 bp, human
ggtagaaagccaggatcccc

SEQ ID NO: 1032 - DNA, 20 bp, human
gcagcaccagctgacccggg

SEQ ID NO: 1033 - DNA, 20 bp, human
gcgggcgagcgcgtctccca

SEQ ID NO: 1034 - DNA, 20 bp, human
gttgtgggacgcgggtgcgg

SEQ ID NO: 1035 - DNA, 20 bp, human
gagcttgtgggacgcgggtg

SEQ ID NO: 1036 - DNA, 20 bp, human
gccggcttcgagataagtcc

SEQ ID NO: 1037 - DNA, 20 bp, human
gtaagtgccgcgccagcccg

SEQ ID NO: 1038 - DNA, 20 bp, human
gggctgcgcttacctctctc

SEQ ID NO: 1039 - DNA, 20 bp, human
ggctggcgcggcacttaagg

SEQ ID NO: 1040 - DNA, 20 bp, human
gggtggcttatacaacaacg

SEQ ID NO: 1041 - DNA, 20 bp, human
gggcagagcccgagccggtg

SEQ ID NO: 1042 - DNA, 20 bp, human
ggcccagtcggcctgtcagc

SEQ ID NO: 1043 - DNA, 20 bp, human
ggcttacctctctccggtgt

SEQ ID NO: 1044 - DNA, 20 bp, human
gccggctcgggctctgccaa

SEQ ID NO: 1045 - DNA, 20 bp, human
gtatctcgaagccggctgac

SEQ ID NO: 1046 - DNA, 20 bp, human
ggcccggggctagagaccga

SEQ ID NO: 1047 - DNA, 20 bp, human
gccgctgcagggagacactg

SEQ ID NO: 1048 - DNA, 20 bp, human
gggacagagtgaggacgggt

SEQ ID NO: 1049 - DNA, 20 bp, human
gcactgcgaggggcgcctaa

SEQ ID NO: 1050 - DNA, 20 bp, human
gagctgggagcggcgcgggt

SEQ ID NO: 1051 - DNA, 20 bp, human
gcgcatcgagtggaaagagt

SEQ ID NO: 1052 - DNA, 20 bp, human
gcaggaccccaaaatcctct

SEQ ID NO: 1053 - DNA, 20 bp, human
gggggaggcgaagtagaaag

SEQ ID NO: 1054 - DNA, 20 bp, human
gcctgcagcggcgcatcgag

SEQ ID NO: 1055 - DNA, 20 bp, human
gatcctctcggcactgcgag

SEQ ID NO: 1056 - DNA, 20 bp, human
gcccctggcggtcagcgcag

SEQ ID NO: 1057 - DNA, 20 bp, human
ggcagtggccccagacatac

SEQ ID NO: 1058 - DNA, 20 bp, human
ggccactgcggctcagtctc

SEQ ID NO: 1059 - DNA, 20 bp, human
gaggccgggtgcgtctacgc

SEQ ID NO: 1060 - DNA, 20 bp, human
gcgggtgcgtctacgcgggc

SEQ ID NO: 1061 - DNA, 20 bp, human
gtggccccagacatactgga

SEQ ID NO: 1062 - DNA, 20 bp, human
gcgtggctccgcctactcgg

SEQ ID NO: 1063 - DNA, 20 bp, human
ggaagccacggagccccagt

SEQ ID NO: 1064 - DNA, 20 bp, human
gattagggccccactcgagg

SEQ ID NO: 1065 - DNA, 20 bp, human
gattgtggagggcaacgcac

SEQ ID NO: 1066 - DNA, 20 bp, human
gtctcgcgttaaagagacag

SEQ ID NO: 1067 - DNA, 20 bp, human
ggaggcagcaaggtccgccg

SEQ ID NO: 1068 - DNA, 20 bp, human
gtggtggaaaccgatagaag

SEQ ID NO: 1069 - DNA, 20 bp, human
gcgggctgcgatacaggaag

SEQ ID NO: 1070 - DNA, 20 bp, human
ggcgagaggaagcgatgcag

SEQ ID NO: 1071 - DNA, 20 bp, human
ggtggcagccgctgaggtca

SEQ ID NO: 1072 - DNA, 20 bp, human
gggactggaggctacctggg

SEQ ID NO: 1073 - DNA, 20 bp, human
gtaccagaacctgactcggg

SEQ ID NO: 1074 - DNA, 20 bp, human
gcaaccggggacagagcgag

SEQ ID NO: 1075 - DNA, 20 bp, human
gggtttgtatccgggctgtg

SEQ ID NO: 1076 - DNA, 20 bp, human
ggaaatcccggggggccgcc

SEQ ID NO: 1077 - DNA, 20 bp, human
gcagcgcgcgacaggggagg

SEQ ID NO: 1078 - DNA, 20 bp, human
gactccgaggacggtcaccg

SEQ ID NO: 1079 - DNA, 20 bp, human
gagctccccacccccatcgg

SEQ ID NO: 1080 - DNA, 20 bp, human
ggaccgtcctcggagtccgt

SEQ ID NO: 1081 - DNA, 20 bp, human
gagccgacggactccgagga

SEQ ID NO: 1082 - DNA, 20 bp, human
gcagccccagcgcgcgacag

SEQ ID NO: 1083 - DNA, 20 bp, human
gacggcggcggtaactcgga

SEQ ID NO: 1084 - DNA, 20 bp, human
gcgcgagccgacggactccg

SEQ ID NO: 1085 - DNA, 20 bp, human
gtcgccgcggtgaccgtcct

SEQ ID NO: 1086 - DNA, 20 bp, human
ggcagaggaagccaaggtcg

SEQ ID NO: 1087 - DNA, 20 bp, human
gaggcagagcaaccaatcaa

SEQ ID NO: 1088 - DNA, 20 bp, human
gagcatctgtgtgaggacgg

SEQ ID NO: 1089 - DNA, 20 bp, human
gtcagagcctcccggccagt

SEQ ID NO: 1090 - DNA, 20 bp, human
gtagtcagcgacccgcagca

SEQ ID NO: 1091 - DNA, 20 bp, human
ggcctctgtctggctcccca

SEQ ID NO: 1092 - DNA, 20 bp, human
gtgacccgtgggaactcaga

SEQ ID NO: 1093 - DNA, 20 bp, human
gactcagaaggatgaacctg

SEQ ID NO: 1094 - DNA, 20 bp, human
ggtgacacctgagaacagga

SEQ ID NO: 1095 - DNA, 20 bp, human
ggggatggggtcggagactg

SEQ ID NO: 1096 - DNA, 20 bp, human
gcatggggaatgatgctggt

SEQ ID NO: 1097 - DNA, 20 bp, human
ggactgtctcccagtgacag

SEQ ID NO: 1098 - DNA, 20 bp, human
gcatcattccccatgcgagg

SEQ ID NO: 1099 - DNA, 20 bp, human
gagaagtagacaccccaaac

SEQ ID NO: 1100 - DNA, 20 bp, human
ggccgcccgcctctgtcact

SEQ ID NO: 1101 - DNA, 20 bp, human
gtggggtgtctacttctctg

SEQ ID NO: 1102 - DNA, 20 bp, human
gccacttaaatgcagctcca

SEQ ID NO: 1103 - DNA, 20 bp, human
gggtgggtgcctcgcaaccc

SEQ ID NO: 1104 - DNA, 20 bp, human
gtctgttagaaagagttgtt

SEQ ID NO: 1105 - DNA, 20 bp, human
gtgtctcccagtgacagagg

SEQ ID NO: 1106 - DNA, 20 bp, human
ggcgagagcggccactagtt

SEQ ID NO: 1107 - DNA, 20 bp, human
gcagcgagcgtagagggaaa

SEQ ID NO: 1108 - DNA, 20 bp, human
gagggaaatggcatatacgt

SEQ ID NO: 1109 - DNA, 20 bp, human
gatgaagaagctaagatagg

SEQ ID NO: 1110 - DNA, 20 bp, human
ggaacggtcagcgagcgtag

SEQ ID NO: 1111 - DNA, 20 bp, human
gagggaagaaggaatcatcg

SEQ ID NO: 1112 - DNA, 20 bp, human
gcaaagcagagaagcgagag

SEQ ID NO: 1113 - DNA, 20 bp, human
gagaagctaagatagggggt

SEQ ID NO: 1114 - DNA, 20 bp, human
gggttcaagatcttccagaa

SEQ ID NO: 1115 - DNA, 20 bp, human
gtcacaggggatgctgaaaa

SEQ ID NO: 1116 - DNA, 20 bp, human
gctctgccataactattagg

SEQ ID NO: 1117 - DNA, 20 bp, human
ggatctctgccataactatt

SEQ ID NO: 1118 - DNA, 20 bp, human
gtgggcagaggtatggtcct

SEQ ID NO: 1119 - DNA, 20 bp, human
ggccataactattaggtgga

SEQ ID NO: 1120 - DNA, 20 bp, human
ggtttaacttttgtgcttct

SEQ ID NO: 1121 - DNA, 20 bp, human
gtccttccacctaatagtta

SEQ ID NO: 1122 - DNA, 20 bp, human
gtactgaatggaagaatgta

SEQ ID NO: 1123 - DNA, 20 bp, human
gtgggggaatatctcatagt

SEQ ID NO: 1124 - DNA, 20 bp, human
gctacccgacttaacaggta

SEQ ID NO: 1125 - DNA, 20 bp, human
gagagttgatagtttcaggg

SEQ ID NO: 1126 - DNA, 20 bp, human
gcggggcgcaccacagagac

SEQ ID NO: 1127 - DNA, 20 bp, human
gcgaggaggaatgtgaccag

SEQ ID NO: 1128 - DNA, 20 bp, human
gccgagcgctgggaaagcgt

SEQ ID NO: 1129 - DNA, 20 bp, human
gggagccggcatgagagcgt

SEQ ID NO: 1130 - DNA, 20 bp, human
gggcgcggagccgcgacagg

SEQ ID NO: 1131 - DNA, 20 bp, human
gcggagccgcgacaggagga

SEQ ID NO: 1132 - DNA, 20 bp, human
ggaggaatgtgaccaggggt

SEQ ID NO: 1133 - DNA, 20 bp, human
gcccaggccctggccctgag

SEQ ID NO: 1134 - DNA, 20 bp, human
ggcgctcggtggtttaaaga

SEQ ID NO: 1135 - DNA, 20 bp, human
gagtacgcgagagcagggat

SEQ ID NO: 1136 - DNA, 20 bp, human
ggggaacagagagaattgtg

SEQ ID NO: 1137 - DNA, 20 bp, human
gatagtggcacgcctatgag

SEQ ID NO: 1138 - DNA, 20 bp, human
gcaaggactactgcccacgt

SEQ ID NO: 1139 - DNA, 20 bp, human
gtacagcaaatgagtgatag

SEQ ID NO: 1140 - DNA, 20 bp, human
gctgattgttgaggaccgga

SEQ ID NO: 1141 - DNA, 20 bp, human
ggacctccttcaccgctcat

SEQ ID NO: 1142 - DNA, 20 bp, human
gtgaggaccggagggtctct

SEQ ID NO: 1143 - DNA, 20 bp, human
gcgcctatgagcggtgaagg

SEQ ID NO: 1144 - DNA, 20 bp, human
ggcacgcctatgagcggtga

SEQ ID NO: 1145 - DNA, 20 bp, human
ggagactgattgttgaggac

SEQ ID NO: 1146 - DNA, 20 bp, human
gctggcgtgtgcgcaaggag

SEQ ID NO: 1147 - DNA, 20 bp, human
gcccgtgagaagcaaagaag

SEQ ID NO: 1148 - DNA, 20 bp, human
gagcagacctaggcacgcag

SEQ ID NO: 1149 - DNA, 20 bp, human
gcccggagcgcgtagctcag

SEQ ID NO: 1150 - DNA, 20 bp, human
gctgcgccaggatgtctgga

SEQ ID NO: 1151 - DNA, 20 bp, human
gggcgggcggaggatagcgc

SEQ ID NO: 1152 - DNA, 20 bp, human
ggggcgccttccagacatcc

SEQ ID NO: 1153 - DNA, 20 bp, human
gctgcgacagccagaccctc

SEQ ID NO: 1154 - DNA, 20 bp, human
gagggctgggtggcattcgg

SEQ ID NO: 1155 - DNA, 20 bp, human
gtgttccaggctgcagaaag

SEQ ID NO: 1156 - DNA, 20 bp, human
gggccgagaggtgggttccg

SEQ ID NO: 1157 - DNA, 20 bp, human
gggctagcaatgcgaaatag

SEQ ID NO: 1158 - DNA, 20 bp, human
ggctacagcccagacagaga

SEQ ID NO: 1159 - DNA, 20 bp, human
gcacgcgccttcaaggccag

SEQ ID NO: 1160 - DNA, 20 bp, human
gtgaaggcgcgtggactaat

SEQ ID NO: 1161 - DNA, 20 bp, human
ggaatcctggtcctcgtctg

SEQ ID NO: 1162 - DNA, 20 bp, human
ggggggtgtggaccacaggg

SEQ ID NO: 1163 - DNA, 20 bp, human
gtctggggtctcgaattcca

SEQ ID NO: 1164 - DNA, 20 bp, human
ggagctcgacatccatgatg

SEQ ID NO: 1165 - DNA, 20 bp, human
ggcggctccggagcccaaag

SEQ ID NO: 1166 - DNA, 20 bp, human
gccgaccctggactaggaca

SEQ ID NO: 1167 - DNA, 20 bp, human
ggccagcgtccgcaacacct

SEQ ID NO: 1168 - DNA, 20 bp, human
ggagaccagacgcggagcca

SEQ ID NO: 1169 - DNA, 20 bp, human
gtagtccagggtcgggcggt

SEQ ID NO: 1170 - DNA, 20 bp, human
ggtccgcaacacctcggcca

SEQ ID NO: 1171 - DNA, 20 bp, human
gagagccttgtcctagtcca

SEQ ID NO: 1172 - DNA, 20 bp, human
gagccatggccgaggtgttg

SEQ ID NO: 1173 - DNA, 20 bp, human
gccaggacgcagggtctcgg

SEQ ID NO: 1174 - DNA, 20 bp, human
ggccgccgtgcccgagggaa

SEQ ID NO: 1175 - DNA, 20 bp, human
gcggccccgggtgcccgcga

SEQ ID NO: 1176 - DNA, 20 bp, human
gctcacaacaggacggacaa

SEQ ID NO: 1177 - DNA, 20 bp, human
gggcttcagttactcacaac

SEQ ID NO: 1178 - DNA, 20 bp, human
gtcagttactcacaacagga

SEQ ID NO: 1179 - DNA, 20 bp, human
gtgtgtttctgtggccggaa

SEQ ID NO: 1180 - DNA, 20 bp, human
ggggtgtgtgtgatttgagg

SEQ ID NO: 1181 - DNA, 20 bp, human
gaatcgcagatacgcccttc

SEQ ID NO: 1182 - DNA, 20 bp, human
gtgtgatttgaggtggggac

SEQ ID NO: 1183 - DNA, 20 bp, human
ggtgtaatggtgtgtttctg

SEQ ID NO: 1184 - DNA, 20 bp, human
gtaatggtgtctctgtggtg

SEQ ID NO: 1185 - DNA, 20 bp, human
gtggtgtctctgtggtgggg

SEQ ID NO: 1186 - DNA, 20 bp, human
ggccgcgccgagcccagctg

SEQ ID NO: 1187 - DNA, 20 bp, human
gggatcgggaccccaagatc

SEQ ID NO: 1188 - DNA, 20 bp, human
gggatcgggacccaggcacc

SEQ ID NO: 1189 - DNA, 20 bp, human
gcgagcccagctgcggatcc

SEQ ID NO: 1190 - DNA, 20 bp, human
gcccccgcgaagttgctcat

SEQ ID NO: 1191 - DNA, 20 bp, human
gggttccgggatccgcagct

SEQ ID NO: 1192 - DNA, 20 bp, human
ggctggggccgggagggttc

SEQ ID NO: 1193 - DNA, 20 bp, human
gggaccccaggatggagatc

SEQ ID NO: 1194 - DNA, 20 bp, human
gggtcccgatctccatcctg

SEQ ID NO: 1195 - DNA, 20 bp, human
ggagcggctccatcccgcgg

SEQ ID NO: 1196 - DNA, 20 bp, human
gtcagcagagaaagacaggt

SEQ ID NO: 1197 - DNA, 20 bp, human
gagcatggctccgggcgaaa

SEQ ID NO: 1198 - DNA, 20 bp, human
gctccgggcgaaaaggaaag

SEQ ID NO: 1199 - DNA, 20 bp, human
gcctcagccacaggtacgag

SEQ ID NO: 1200 - DNA, 20 bp, human
ggccaagctgatgaccaggg

SEQ ID NO: 1201 - DNA, 20 bp, human
gggcaggcccaggagcctac

SEQ ID NO: 1202 - DNA, 20 bp, human
gaggtgggcagcatggctcc

SEQ ID NO: 1203 - DNA, 20 bp, human
gcgggccaagctgatgacca

SEQ ID NO: 1204 - DNA, 20 bp, human
ggctgtgcgtatcttccgga

SEQ ID NO: 1205 - DNA, 20 bp, human
gcgtgagccacctcagccac

SEQ ID NO: 1206 - DNA, 20 bp, human
gaagtcgacccgagaggtgg

SEQ ID NO: 1207 - DNA, 20 bp, human
gaagagaaagacggctgtgg

SEQ ID NO: 1208 - DNA, 20 bp, human
ggcaaagagaaagacggctg

SEQ ID NO: 1209 - DNA, 20 bp, human
gtgagagtcgggtcaggagg

SEQ ID NO: 1210 - DNA, 20 bp, human
gtaccttcttcagtgcactg

SEQ ID NO: 1211 - DNA, 20 bp, human
gtaggtagcagggatggact

SEQ ID NO: 1212 - DNA, 20 bp, human
gacgtcacgtgagccgagtg

SEQ ID NO: 1213 - DNA, 20 bp, human
ggctgccccgaggaacgtgg

SEQ ID NO: 1214 - DNA, 20 bp, human
gagaaagacggctgtggagg

SEQ ID NO: 1215 - DNA, 20 bp, human
gactgggaagccggcagaaa

SEQ ID NO: 1216 - DNA, 20 bp, human
gacgcgtccgacctcgccat

SEQ ID NO: 1217 - DNA, 20 bp, human
gactgacacgagcggcacga

SEQ ID NO: 1218 - DNA, 20 bp, human
ggctggtgaatcagtctgtg

SEQ ID NO: 1219 - DNA, 20 bp, human
gggagcaagagccgctggaa

SEQ ID NO: 1220 - DNA, 20 bp, human
gtcagcgcctatggcgaggt

SEQ ID NO: 1221 - DNA, 20 bp, human
gctcgccataggcgctgaga

SEQ ID NO: 1222 - DNA, 20 bp, human
gccctgacggtgacaggagg

SEQ ID NO: 1223 - DNA, 20 bp, human
ggggcgggcggaggggatat

SEQ ID NO: 1224 - DNA, 20 bp, human
gcagttggcaaggcacttta

SEQ ID NO: 1225 - DNA, 20 bp, human
ggaaggttgcggacgtgcag

SEQ ID NO: 1226 - DNA, 20 bp, human
gcgagccgaacgacctcggg

SEQ ID NO: 1227 - DNA, 20 bp, human
gacccgagccgaacgacctc

SEQ ID NO: 1228 - DNA, 20 bp, human
gccgaaggcgcagaagtggg

SEQ ID NO: 1229 - DNA, 20 bp, human
gggcgaagccgcgcacccgg

SEQ ID NO: 1230 - DNA, 20 bp, human
gtgacgtccgggccctacca

SEQ ID NO: 1231 - DNA, 20 bp, human
gttcgccgcccgaggtcgtt

SEQ ID NO: 1232 - DNA, 20 bp, human
ggccctaccagggcgaacag

SEQ ID NO: 1233 - DNA, 20 bp, human
ggtaagaagggactgctcag

SEQ ID NO: 1234 - DNA, 20 bp, human
gaagtgggcggagagaaggc

SEQ ID NO: 1235 - DNA, 20 bp, human
ggtcgctggtgtccatggcg

SEQ ID NO: 1236 - DNA, 20 bp, human
ggaatcccgggagaacaggg

SEQ ID NO: 1237 - DNA, 20 bp, human
gcagggcgcagcgcgagtcc

SEQ ID NO: 1238 - DNA, 20 bp, human
ggccatggggagcctgccga

SEQ ID NO: 1239 - DNA, 20 bp, human
ggagtccccggccccatacc

SEQ ID NO: 1240 - DNA, 20 bp, human
gggaaggtggccgagatccg

SEQ ID NO: 1241 - DNA, 20 bp, human
gtcgggacgccgggagcgtg

SEQ ID NO: 1242 - DNA, 20 bp, human
ggcgacggggttctttccag

SEQ ID NO: 1243 - DNA, 20 bp, human
gggcggcgtcgccgagcgag

SEQ ID NO: 1244 - DNA, 20 bp, human
ggaaccccgtcgctaccccc

SEQ ID NO: 1245 - DNA, 20 bp, human
ggccccatacccggagtcca

SEQ ID NO: 1246 - DNA, 20 bp, human
gccagtccgggaactgaccg

SEQ ID NO: 1247 - DNA, 20 bp, human
ggccgagagaagctcgtcgg

SEQ ID NO: 1248 - DNA, 20 bp, human
ggttgacctgcgcaatgcag

SEQ ID NO: 1249 - DNA, 20 bp, human
gcggctgtctgttaactccg

SEQ ID NO: 1250 - DNA, 20 bp, human
gtagtgctgggccacctgag

SEQ ID NO: 1251 - DNA, 20 bp, human
gactgccgagagaagctcgt

SEQ ID NO: 1252 - DNA, 20 bp, human
gtctcaaggacgtgaatctg

SEQ ID NO: 1253 - DNA, 20 bp, human
gatcggccggacccctcagg

SEQ ID NO: 1254 - DNA, 20 bp, human
gctctcggcagtcatgaccg

SEQ ID NO: 1255 - DNA, 20 bp, human
ggagagaagctcgtcggggg

SEQ ID NO: 1256 - DNA, 20 bp, human
gtcacctcggagcagagcca

SEQ ID NO: 1257 - DNA, 20 bp, human
gcctcggagcagagccatgg

SEQ ID NO: 1258 - DNA, 20 bp, human
ggacgacccagcagccgcca

SEQ ID NO: 1259 - DNA, 20 bp, human
gcctgaccaccgaggccgag

SEQ ID NO: 1260 - DNA, 20 bp, human
ggcggctgctgggtcgtcgg

SEQ ID NO: 1261 - DNA, 20 bp, human
gcggggagccctgaccaccg

SEQ ID NO: 1262 - DNA, 20 bp, human
gggctccccgggtgaatcga

SEQ ID NO: 1263 - DNA, 20 bp, human
ggcggcgcgggtctgtggtg

SEQ ID NO: 1264 - DNA, 20 bp, human
ggctagcgccttacaagtaa

SEQ ID NO: 1265 - DNA, 20 bp, human
gcccgggtgaatcgatggag

SEQ ID NO: 1266 - DNA, 20 bp, human
ggccgcgtgcgggtgagcgg

SEQ ID NO: 1267 - DNA, 20 bp, human
gcctgcgtggaggaactgct

SEQ ID NO: 1268 - DNA, 20 bp, human
gagggctcctctaggaaggg

SEQ ID NO: 1269 - DNA, 20 bp, human
gttccggagcccctgcgtgg

SEQ ID NO: 1270 - DNA, 20 bp, human
ggagagggagaagaccacgt

SEQ ID NO: 1271 - DNA, 20 bp, human
gggctcgggcgatggctgac

SEQ ID NO: 1272 - DNA, 20 bp, human
gctcagggtggcaacgtgtg

SEQ ID NO: 1273 - DNA, 20 bp, human
gctgggaggcgtacagttca

SEQ ID NO: 1274 - DNA, 20 bp, human
gttcagatcccggaactggg

SEQ ID NO: 1275 - DNA, 20 bp, human
gatcagaccacgctggagct

SEQ ID NO: 1276 - DNA, 20 bp, human
ggcgcccacagggtgactaa

SEQ ID NO: 1277 - DNA, 20 bp, human
ggtggctgcatccccagtga

SEQ ID NO: 1278 - DNA, 20 bp, human
gaggctgacaggcgcccaca

SEQ ID NO: 1279 - DNA, 20 bp, human
ggttcccttagtcaccctgt

SEQ ID NO: 1280 - DNA, 20 bp, human
gccacagaggttcactggaa

SEQ ID NO: 1281 - DNA, 20 bp, human
gcactcaagaatggagctgg

SEQ ID NO: 1282 - DNA, 20 bp, human
ggtcatgatagcgtccacag

SEQ ID NO: 1283 - DNA, 20 bp, human
gcttcgctgaaataacccag

SEQ ID NO: 1284 - DNA, 20 bp, human
gtaagtgctggccagtcacc

SEQ ID NO: 1285 - DNA, 20 bp, human
gtaagtggcaacaagtgctg

SEQ ID NO: 1286 - DNA, 20 bp, human
ggcaagcgcagcgcgaagtt

SEQ ID NO: 1287 - DNA, 20 bp, human
gcagccaggtcgcgacccgg

SEQ ID NO: 1288 - DNA, 20 bp, human
gtcccaccgggctcccgcag

SEQ ID NO: 1289 - DNA, 20 bp, human
gaggccagctagagtttcca

SEQ ID NO: 1290 - DNA, 20 bp, human
gcgcagggtgcatttcggga

SEQ ID NO: 1291 - DNA, 20 bp, human
gtagctggccttggcgggag

SEQ ID NO: 1292 - DNA, 20 bp, human
gggggttctgctgcagccgg

SEQ ID NO: 1293 - DNA, 20 bp, human
gtgcagtcctagagcgccgc

SEQ ID NO: 1294 - DNA, 20 bp, human
gcgcgaagttgggcgcccgc

SEQ ID NO: 1295 - DNA, 20 bp, human
gggacagccaggtcgcgacc

SEQ ID NO: 1296 - DNA, 20 bp, human
gtcggagcggaaggacgtcg

SEQ ID NO: 1297 - DNA, 20 bp, human
gaattttgaggaggtcggag

SEQ ID NO: 1298 - DNA, 20 bp, human
ggtggagattgcttgcgctg

SEQ ID NO: 1299 - DNA, 20 bp, human
gaacaaaaccatccagacta

SEQ ID NO: 1300 - DNA, 20 bp, human
gtctaaggggccgtagagag

SEQ ID NO: 1301 - DNA, 20 bp, human
gtccggacgcaattttgagg

SEQ ID NO: 1302 - DNA, 20 bp, human
gttgcgtccggaagagcagt

SEQ ID NO: 1303 - DNA, 20 bp, human
gaccgcgcacagcgattggg

SEQ ID NO: 1304 - DNA, 20 bp, human
gtctctaaccctagtctgga

SEQ ID NO: 1305 - DNA, 20 bp, human
ggccgaggtggattaggacg

SEQ ID NO: 1306 - DNA, 20 bp, human
gctggagcgggaacttgccc

SEQ ID NO: 1307 - DNA, 20 bp, human
gcgctccacagactccgcca

SEQ ID NO: 1308 - DNA, 20 bp, human
gcccgcaggccacagcaacg

SEQ ID NO: 1309 - DNA, 20 bp, human
gacagcaacgcggcatccac

SEQ ID NO: 1310 - DNA, 20 bp, human
ggtcagtggacgcaccctac

SEQ ID NO: 1311 - DNA, 20 bp, human
gcaggaaaagcaatcagggt

SEQ ID NO: 1312 - DNA, 20 bp, human
gcttcggcactcgagacctg

SEQ ID NO: 1313 - DNA, 20 bp, human
gcccaattggagggcggtaa

SEQ ID NO: 1314 - DNA, 20 bp, human
gcggactcgccagtagcacc

SEQ ID NO: 1315 - DNA, 20 bp, human
ggggcttcccaattggaggg

SEQ ID NO: 1316 - DNA, 20 bp, human
ggccagtgcgagcgcaacgg

SEQ ID NO: 1317 - DNA, 20 bp, human
gcggcggctatgctgtggag

SEQ ID NO: 1318 - DNA, 20 bp, human
gagctgcggcggctatgctg

SEQ ID NO: 1319 - DNA, 20 bp, human
ggaggcgcgccccgaaacgc

SEQ ID NO: 1320 - DNA, 20 bp, human
gcgagcgcaacggaggtcga

SEQ ID NO: 1321 - DNA, 20 bp, human
gttagctgaacgcggagctg

SEQ ID NO: 1322 - DNA, 20 bp, human
gggacaggtgtccagaaccc

SEQ ID NO: 1323 - DNA, 20 bp, human
gcccgccagtgcgagcgcaa

SEQ ID NO: 1324 - DNA, 20 bp, human
gtcagactcttagctgaacg

SEQ ID NO: 1325 - DNA, 20 bp, human
ggaacctgcggggggatgac

SEQ ID NO: 1326 - DNA, 20 bp, human
ggaacatcgggcagcatgag

SEQ ID NO: 1327 - DNA, 20 bp, human
gcgcagtagccgccggttcg

SEQ ID NO: 1328 - DNA, 20 bp, human
gtccctgcggcgctaagaag

SEQ ID NO: 1329 - DNA, 20 bp, human
gcgctaagaaggggagactg

SEQ ID NO: 1330 - DNA, 20 bp, human
gggctgaggctggggaacat

SEQ ID NO: 1331 - DNA, 20 bp, human
gggtagagaccaccagaccc

SEQ ID NO: 1332 - DNA, 20 bp, human
ggacagcaagggttcgccca

SEQ ID NO: 1333 - DNA, 20 bp, human
ggccgcagggtgtatctctc

SEQ ID NO: 1334 - DNA, 20 bp, human
ggccagagagatacaccctg

SEQ ID NO: 1335 - DNA, 20 bp, human
gccgaggcgtgttaacactc

SEQ ID NO: 1336 - DNA, 20 bp, human
gcagctgaggcgtccacctg

SEQ ID NO: 1337 - DNA, 20 bp, human
ggcggctactcggcgactcg

SEQ ID NO: 1338 - DNA, 20 bp, human
gcggcggtctgttctcgggg

SEQ ID NO: 1339 - DNA, 20 bp, human
gggcgacggaggcgactctg

SEQ ID NO: 1340 - DNA, 20 bp, human
gctgggtgcaaccagcatct

SEQ ID NO: 1341 - DNA, 20 bp, human
ggccgctgaactagacgggt

SEQ ID NO: 1342 - DNA, 20 bp, human
gttttttgggaggacaccac

SEQ ID NO: 1343 - DNA, 20 bp, human
gggccatgtccgaaacacag

SEQ ID NO: 1344 - DNA, 20 bp, human
gcatctgggcggaggaaaaa

SEQ ID NO: 1345 - DNA, 20 bp, human
ggactcggggcagggtcccc

SEQ ID NO: 1346 - DNA, 20 bp, human
gcactcggacaataatacac

SEQ ID NO: 1347 - DNA, 20 bp, human
gcagcgcggaaagagagcca

SEQ ID NO: 1348 - DNA, 20 bp, human
ggccggaacgggagccaaca

SEQ ID NO: 1349 - DNA, 20 bp, human
gtgaggaaggagccagccta

SEQ ID NO: 1350 - DNA, 20 bp, human
ggtcgcctgacgggaggata

SEQ ID NO: 1351 - DNA, 20 bp, human
ggaggatgccggctataacg

SEQ ID NO: 1352 - DNA, 20 bp, human
gattgtccgagtggccggaa

SEQ ID NO: 1353 - DNA, 20 bp, human
gtgggaagtcgggctgagga

SEQ ID NO: 1354 - DNA, 20 bp, human
gtggttctgacacagagacg

SEQ ID NO: 1355 - DNA, 20 bp, human
gcacgcctcctaccaccgga

SEQ ID NO: 1356 - DNA, 20 bp, human
gcgagcagcgcggcggccat

SEQ ID NO: 1357 - DNA, 20 bp, human
gcggaacagcgcgctcgcag

SEQ ID NO: 1358 - DNA, 20 bp, human
ggccaaccgaggctgaggag

SEQ ID NO: 1359 - DNA, 20 bp, human
ggcgggaggtcgcgaagcct

SEQ ID NO: 1360 - DNA, 20 bp, human
gacagcgcgctcgcagcggg

SEQ ID NO: 1361 - DNA, 20 bp, human
ggcaaggagcagcagaactg

SEQ ID NO: 1362 - DNA, 20 bp, human
ggctgttccggagtgctggg

SEQ ID NO: 1363 - DNA, 20 bp, human
ggaggcccgggcgagcagcg

SEQ ID NO: 1364 - DNA, 20 bp, human
gagtgcgctggggatccgta

SEQ ID NO: 1365 - DNA, 20 bp, human
gcaggcctggctccggaaga

SEQ ID NO: 1366 - DNA, 20 bp, human
gggcctgcggcgaggatgga

SEQ ID NO: 1367 - DNA, 20 bp, human
ggtgcgttagggcatcaggg

SEQ ID NO: 1368 - DNA, 20 bp, human
gtccagagatccagactcgg

SEQ ID NO: 1369 - DNA, 20 bp, human
gaaggtgcgttagggcatca

SEQ ID NO: 1370 - DNA, 20 bp, human
gggtggctctcaggacgcaa

SEQ ID NO: 1371 - DNA, 20 bp, human
gactcgggaaaggtgcgtta

SEQ ID NO: 1372 - DNA, 20 bp, human
gcttgctcgggtaactccca

SEQ ID NO: 1373 - DNA, 20 bp, human
gagatccagagatccagact

SEQ ID NO: 1374 - DNA, 20 bp, human
gcccgcgggtaaagagtctg

SEQ ID NO: 1375 - DNA, 20 bp, human
gggccctccatcctcgccgc

SEQ ID NO: 1376 - DNA, 20 bp, human
gtgccctagggcgaaactag

SEQ ID NO: 1377 - DNA, 20 bp, human
ggctcagtcgccgaaagtag

SEQ ID NO: 1378 - DNA, 20 bp, human
ggggtcagagctcgagccag

SEQ ID NO: 1379 - DNA, 20 bp, human
gggcaagccagggtgcccta

SEQ ID NO: 1380 - DNA, 20 bp, human
gcactgtggacgatgagtca

SEQ ID NO: 1381 - DNA, 20 bp, human
ggtgtgacaagagggacggt

SEQ ID NO: 1382 - DNA, 20 bp, human
ggtcctgcacgcccacgtcc

SEQ ID NO: 1383 - DNA, 20 bp, human
ggctgtgtcaaggggagaac

SEQ ID NO: 1384 - DNA, 20 bp, human
ggttaggggcgccaggacgt

SEQ ID NO: 1385 - DNA, 20 bp, human
gagcggcgcccggagagatt

SEQ ID NO: 1386 - DNA, 20 bp, human
gagctctagggcggagacca

SEQ ID NO: 1387 - DNA, 20 bp, human
gcccggcacacatagctcta

SEQ ID NO: 1388 - DNA, 20 bp, human
gctccccgccgctccagagg

SEQ ID NO: 1389 - DNA, 20 bp, human
gcgcccggcgagccaggaac

SEQ ID NO: 1390 - DNA, 20 bp, human
gggcacacatagctctaggg

SEQ ID NO: 1391 - DNA, 20 bp, human
ggagcggcggggaggtaggt

SEQ ID NO: 1392 - DNA, 20 bp, human
ggagcctcgctctggaggga

SEQ ID NO: 1393 - DNA, 20 bp, human
gccctgggagagcctcgctc

SEQ ID NO: 1394 - DNA, 20 bp, human
gacgcgcgcagcgctgctca

SEQ ID NO: 1395 - DNA, 20 bp, human
ggggagagcctcgctctgga

SEQ ID NO: 1396 - DNA, 20 bp, human
ggagggaatgccagctctag

SEQ ID NO: 1397 - DNA, 20 bp, human
ggcgagcctgtgggccaaag

SEQ ID NO: 1398 - DNA, 20 bp, human
gcccaggaaggggagatgag

SEQ ID NO: 1399 - DNA, 20 bp, human
gccagcactgcctggaagtg

SEQ ID NO: 1400 - DNA, 20 bp, human
ggctctcaccccacacttcc

SEQ ID NO: 1401 - DNA, 20 bp, human
ggagggacctccgcggggaa

SEQ ID NO: 1402 - DNA, 20 bp, human
gggggtgagggaaactgcag

SEQ ID NO: 1403 - DNA, 20 bp, human
gcaggccaggtctccttcca

SEQ ID NO: 1404 - DNA, 20 bp, human
gtaccccagctgtgaaagca

SEQ ID NO: 1405 - DNA, 20 bp, human
gggcacaattctttccccaa

SEQ ID NO: 1406 - DNA, 20 bp, human
gtcgcggctgctatgaccag

SEQ ID NO: 1407 - DNA, 20 bp, human
gctcgcagggtgggaaacgg

SEQ ID NO: 1408 - DNA, 20 bp, human
gccctcgggagggctcggtg

SEQ ID NO: 1409 - DNA, 20 bp, human
gacttcgtcgcccctcggga

SEQ ID NO: 1410 - DNA, 20 bp, human
ggctgggacgcagacggcta

SEQ ID NO: 1411 - DNA, 20 bp, human
gggactgcagtgccctcgca

SEQ ID NO: 1412 - DNA, 20 bp, human
gaagacggcgacgactagtc

SEQ ID NO: 1413 - DNA, 20 bp, human
gggcgctccgccccggcaga

SEQ ID NO: 1414 - DNA, 20 bp, human
gcgaggggcgacgaagtggc

SEQ ID NO: 1415 - DNA, 20 bp, human
gctgctatgaccagcgggcg

SEQ ID NO: 1416 - DNA, 20 bp, human
gcgggcgggacgagcggtcc

SEQ ID NO: 1417 - DNA, 20 bp, human
ggacgctccccggcggtgac

SEQ ID NO: 1418 - DNA, 20 bp, human
gctcactggcacgaggaccg

SEQ ID NO: 1419 - DNA, 20 bp, human
gcggcggccgcggcgctcac

SEQ ID NO: 1420 - DNA, 20 bp, human
gaccccgccgccgggcacaa

SEQ ID NO: 1421 - DNA, 20 bp, human
ggacggtcccgaggtgccca

SEQ ID NO: 1422 - DNA, 20 bp, human
gcgtgcgcgtgggcagccgt

SEQ ID NO: 1423 - DNA, 20 bp, human
gccacggacccagacgaccc

SEQ ID NO: 1424 - DNA, 20 bp, human
ggcgcggcggcctcattccg

SEQ ID NO: 1425 - DNA, 20 bp, human
gcgcggcgctcactggcacg

SEQ ID NO: 1426 - DNA, 20 bp, human
ggtcgcagagggctgagtat

SEQ ID NO: 1427 - DNA, 20 bp, human
ggcacagccatggtcgcaga

SEQ ID NO: 1428 - DNA, 20 bp, human
gctccacaggcgtagactag

SEQ ID NO: 1429 - DNA, 20 bp, human
gggcctgagcggtgggatcg

SEQ ID NO: 1430 - DNA, 20 bp, human
gtggcggcacttctgcgcag

SEQ ID NO: 1431 - DNA, 20 bp, human
gactcagccctctgcgacca

SEQ ID NO: 1432 - DNA, 20 bp, human
ggccgggccagcgccaatcc

SEQ ID NO: 1433 - DNA, 20 bp, human
gggccgctagtctacgcctg

SEQ ID NO: 1434 - DNA, 20 bp, human
ggggccagcgccaatcctgg

SEQ ID NO: 1435 - DNA, 20 bp, human
gcgggcaggaccgccaggat

SEQ ID NO: 1436 - DNA, 20 bp, human
gctagcttgcaggcagcgca

SEQ ID NO: 1437 - DNA, 20 bp, human
gctacgccaaccaatgggag

SEQ ID NO: 1438 - DNA, 20 bp, human
gcggcggcgcggaccatcat

SEQ ID NO: 1439 - DNA, 20 bp, human
gctgccgcaggcattaccga

SEQ ID NO: 1440 - DNA, 20 bp, human
gccgcccgcggcaggcctgt

SEQ ID NO: 1441 - DNA, 20 bp, human
gctacctcaggtcccgcccg

SEQ ID NO: 1442 - DNA, 20 bp, human
gccgccgagacgatgaccac

SEQ ID NO: 1443 - DNA, 20 bp, human
gggagaggcaggccacgcga

SEQ ID NO: 1444 - DNA, 20 bp, human
gcaggggcggaactgctagg

SEQ ID NO: 1445 - DNA, 20 bp, human
ggggtcgggctgtcacacaa

SEQ ID NO: 1446 - DNA, 20 bp, human
gctgctgcacctcctcagcg

SEQ ID NO: 1447 - DNA, 20 bp, human
ggactcgaggtgtccgtcga

SEQ ID NO: 1448 - DNA, 20 bp, human
gcagcagccggagatggcgg

SEQ ID NO: 1449 - DNA, 20 bp, human
gcctcctcagcggggacaga

SEQ ID NO: 1450 - DNA, 20 bp, human
gaccacagcccagtatgagt

SEQ ID NO: 1451 - DNA, 20 bp, human
ggtctggtccagtcaccctg

SEQ ID NO: 1452 - DNA, 20 bp, human
ggcccagtatgagtgggtga

SEQ ID NO: 1453 - DNA, 20 bp, human
gcttcgggtacccccaagga

SEQ ID NO: 1454 - DNA, 20 bp, human
gaaggttgcaggcccgtcag

SEQ ID NO: 1455 - DNA, 20 bp, human
gtcccggggccgggcagaag

SEQ ID NO: 1456 - DNA, 20 bp, human
gtcagtaggaagccgcgggg

SEQ ID NO: 1457 - DNA, 20 bp, human
gccggccctgctggaccccg

SEQ ID NO: 1458 - DNA, 20 bp, human
gcgcccactgccaggacacc

SEQ ID NO: 1459 - DNA, 20 bp, human
gcccccggcaccataagcca

SEQ ID NO: 1460 - DNA, 20 bp, human
ggtaggaagccgcggggtgg

SEQ ID NO: 1461 - DNA, 20 bp, human
ggcggcttcctactgacccc

SEQ ID NO: 1462 - DNA, 20 bp, human
gtggaggccccctcacacga

SEQ ID NO: 1463 - DNA, 20 bp, human
ggacccaggtgtcctggcag

SEQ ID NO: 1464 - DNA, 20 bp, human
gcctaaaggaggcgcatctg

SEQ ID NO: 1465 - DNA, 20 bp, human
ggctcaaaagtagggcccca

SEQ ID NO: 1466 - DNA, 20 bp, human
gagactgtggctctccgagg

SEQ ID NO: 1467 - DNA, 20 bp, human
gcccttgcggccaagatcag

SEQ ID NO: 1468 - DNA, 20 bp, human
ggaggctcgcccggactaag

SEQ ID NO: 1469 - DNA, 20 bp, human
ggagacggactcacgagcag

SEQ ID NO: 1470 - DNA, 20 bp, human
ggtccgtctccccttagtcc

SEQ ID NO: 1471 - DNA, 20 bp, human
gaggttggcagtgacgtcat

SEQ ID NO: 1472 - DNA, 20 bp, human
gtccgtcagctccgagactg

SEQ ID NO: 1473 - DNA, 20 bp, human
gaggccaggtgctgccccct

SEQ ID NO: 1474 - DNA, 20 bp, human
ggacggacctggggagcgtg

SEQ ID NO: 1475 - DNA, 20 bp, human
gagcgcgaacccgaagggat

SEQ ID NO: 1476 - DNA, 20 bp, human
gcggactccggcggaatggg

SEQ ID NO: 1477 - DNA, 20 bp, human
gactgacagacggactccgg

SEQ ID NO: 1478 - DNA, 20 bp, human
gttgggaccggggccaacac

SEQ ID NO: 1479 - DNA, 20 bp, human
ggggtgtggctgctccgcca

SEQ ID NO: 1480 - DNA, 20 bp, human
gggagccgctctcccaccct

SEQ ID NO: 1481 - DNA, 20 bp, human
gccccggtcccaaggtctgt

SEQ ID NO: 1482 - DNA, 20 bp, human
ggagatccgtgcacgagact

SEQ ID NO: 1483 - DNA, 20 bp, human
gcggactgacagacggactc

SEQ ID NO: 1484 - DNA, 20 bp, human
gctgtgtaggagccatgtag

SEQ ID NO: 1485 - DNA, 20 bp, human
ggagtcaccggaggacccac

SEQ ID NO: 1486 - DNA, 20 bp, human
gcaacggaacaggagtcgag

SEQ ID NO: 1487 - DNA, 20 bp, human
gtcaggggacgactccgggg

SEQ ID NO: 1488 - DNA, 20 bp, human
gtcggacccaagctcagtcg

SEQ ID NO: 1489 - DNA, 20 bp, human
gggaggagaccgggtcgact

SEQ ID NO: 1490 - DNA, 20 bp, human
ggggccatcaccggcgacag

SEQ ID NO: 1491 - DNA, 20 bp, human
gctcgatctcagggctatgg

SEQ ID NO: 1492 - DNA, 20 bp, human
gtgagctcaggggacgactc

SEQ ID NO: 1493 - DNA, 20 bp, human
ggctcgcgacccagactggt

SEQ ID NO: 1494 - DNA, 20 bp, human
gagggagcagggtcacgtga

SEQ ID NO: 1495 - DNA, 20 bp, human
gaggcctggcccaccagtct

SEQ ID NO: 1496 - DNA, 20 bp, human
gaagcggtgggtgcgagagg

SEQ ID NO: 1497 - DNA, 20 bp, human
gcggcgagccagggctccca

SEQ ID NO: 1498 - DNA, 20 bp, human
gacactaagagaggtcctgg

SEQ ID NO: 1499 - DNA, 20 bp, human
ggaggtcccaacgagcgaag

SEQ ID NO: 1500 - DNA, 20 bp, human
gctccctctcggagacggag

SEQ ID NO: 1501 - DNA, 20 bp, human
ggcgagagggggcagagcac

SEQ ID NO: 1502 - DNA, 20 bp, human
gcggtctacactgccatctg

SEQ ID NO: 1503 - DNA, 20 bp, human
gaggcaaggcaggagcgccg

SEQ ID NO: 1504 - DNA, 20 bp, human
ggctcgccgtcagcaggcac

SEQ ID NO: 1505 - DNA, 20 bp, human
gcaccgccgaccgctcccag

SEQ ID NO: 1506 - DNA, 20 bp, human
gcagatacccgcactcgatg

SEQ ID NO: 1507 - DNA, 20 bp, human
gccccacttgcgggattcca

SEQ ID NO: 1508 - DNA, 20 bp, human
gaccgaaacggccttctaca

SEQ ID NO: 1509 - DNA, 20 bp, human
gacagcccaggtccgaggaa

SEQ ID NO: 1510 - DNA, 20 bp, human
gcaagggattcgagatggaa

SEQ ID NO: 1511 - DNA, 20 bp, human
gccaaggcctcatcgagtgc

SEQ ID NO: 1512 - DNA, 20 bp, human
gctccgcaaagtcttctcag

SEQ ID NO: 1513 - DNA, 20 bp, human
ggccttggaatcccgcaagt

SEQ ID NO: 1514 - DNA, 20 bp, human
gcggtagccgccccacttgc

SEQ ID NO: 1515 - DNA, 20 bp, human
ggaaacggccttctacaggg

SEQ ID NO: 1516 - DNA, 20 bp, human
ggataggtcgcggttgacaa

SEQ ID NO: 1517 - DNA, 20 bp, human
ggcagagggcccaactctct

SEQ ID NO: 1518 - DNA, 20 bp, human
gagaggccagtaaagatacc

SEQ ID NO: 1519 - DNA, 20 bp, human
gggcctctcctctgaccaga

SEQ ID NO: 1520 - DNA, 20 bp, human
gcccacggatggataggtcg

SEQ ID NO: 1521 - DNA, 20 bp, human
ggaggaaaggaggcacactg

SEQ ID NO: 1522 - DNA, 20 bp, human
gtgcagctgacgagcagaca

SEQ ID NO: 1523 - DNA, 20 bp, human
ggagatgtcaatcccacgga

SEQ ID NO: 1524 - DNA, 20 bp, human
gtatctttactggcctctga

SEQ ID NO: 1525 - DNA, 20 bp, human
ggggcctgtcgctggaggaa

SEQ ID NO: 1526 - DNA, 20 bp, human
gtccccacggctacacccag

SEQ ID NO: 1527 - DNA, 20 bp, human
gcggcaggagagcgcgaggt

SEQ ID NO: 1528 - DNA, 20 bp, human
gatccgctgggtgtagccgt

SEQ ID NO: 1529 - DNA, 20 bp, human
gccgacgtcggacgtatcag

SEQ ID NO: 1530 - DNA, 20 bp, human
ggtcctgtagtacctgacgg

SEQ ID NO: 1531 - DNA, 20 bp, human
ggaatcagctcccgaatcca

SEQ ID NO: 1532 - DNA, 20 bp, human
gggggatggcaggttcgggg

SEQ ID NO: 1533 - DNA, 20 bp, human
gggcgtcctgtagtacctga

SEQ ID NO: 1534 - DNA, 20 bp, human
gctacacccagcggatgcaa

SEQ ID NO: 1535 - DNA, 20 bp, human
ggcgggccttgtgttcaggt

SEQ ID NO: 1536 - DNA, 20 bp, human
gggccgcggcgcaggagaag

SEQ ID NO: 1537 - DNA, 20 bp, human
gcgaggcggcccccatgacg

SEQ ID NO: 1538 - DNA, 20 bp, human
gaccgcgcaccgcgtcatgg

SEQ ID NO: 1539 - DNA, 20 bp, human
ggccccgcggctgactgtcg

SEQ ID NO: 1540 - DNA, 20 bp, human
gagcaccgcgcaccgcgtca

SEQ ID NO: 1541 - DNA, 20 bp, human
ggtgtcgtgcgcccagctgg

SEQ ID NO: 1542 - DNA, 20 bp, human
gcgagttggatggatgaggg

SEQ ID NO: 1543 - DNA, 20 bp, human
ggctcccagcatgcacgagt

SEQ ID NO: 1544 - DNA, 20 bp, human
gagcccggggtccaacgcca

SEQ ID NO: 1545 - DNA, 20 bp, human
gctgtcggggcgagggtccg

SEQ ID NO: 1546 - DNA, 20 bp, human
gcccaagtgggaccatgcag

SEQ ID NO: 1547 - DNA, 20 bp, human
gtatgaccggacatcccagg

SEQ ID NO: 1548 - DNA, 20 bp, human
gctcctgcggccatgggcca

SEQ ID NO: 1549 - DNA, 20 bp, human
ggtgcccgtagcagagcagc

SEQ ID NO: 1550 - DNA, 20 bp, human
gctggctggggaccagcaga

SEQ ID NO: 1551 - DNA, 20 bp, human
ggggacagggcagggtacaa

SEQ ID NO: 1552 - DNA, 20 bp, human
gcatcagtcaccaggtctgt

SEQ ID NO: 1553 - DNA, 20 bp, human
ggtagcccaaccctggccca

SEQ ID NO: 1554 - DNA, 20 bp, human
gtgggctctgggctgatgtc

SEQ ID NO: 1555 - DNA, 20 bp, human
ggcactctgtcccacagacc

SEQ ID NO: 1556 - DNA, 20 bp, human
gtacagcaacaaggctgaga

SEQ ID NO: 1557 - DNA, 20 bp, human
ggacgatgtcaagctcttcc

SEQ ID NO: 1558 - DNA, 20 bp, human
ggtcttggcctgttcctcaa

SEQ ID NO: 1559 - DNA, 20 bp, human
gactgtgatgagaattatgg

SEQ ID NO: 1560 - DNA, 20 bp, human
ggagagaaaatctcatgagg

SEQ ID NO: 1561 - DNA, 20 bp, human
gctgactgtgatgagaatta

SEQ ID NO: 1562 - DNA, 20 bp, human
ggaagagaatgtccaaaaca

SEQ ID NO: 1563 - DNA, 20 bp, human
gcattcagtggatgtgatct

SEQ ID NO: 1564 - DNA, 20 bp, human
gttggcctgttcctcaatgg

SEQ ID NO: 1565 - DNA, 20 bp, human
ggagttctcatggctctatt

SEQ ID NO: 1566 - DNA, 20 bp, human
gtccacctcggagctctgat

SEQ ID NO: 1567 - DNA, 20 bp, human
gggtgcccctgagctagagg

SEQ ID NO: 1568 - DNA, 20 bp, human
gaggcagctgtggtaggggg

SEQ ID NO: 1569 - DNA, 20 bp, human
gtctgataggcgaagatgct

SEQ ID NO: 1570 - DNA, 20 bp, human
ggcgatggtgccttcttgga

SEQ ID NO: 1571 - DNA, 20 bp, human
gagagaaggcgagcttggga

SEQ ID NO: 1572 - DNA, 20 bp, human
ggcctatcagagctccgagg

SEQ ID NO: 1573 - DNA, 20 bp, human
gcccaccccctctagctcag

SEQ ID NO: 1574 - DNA, 20 bp, human
ggcctctgtgccctccaaga

SEQ ID NO: 1575 - DNA, 20 bp, human
gccagtaaggctgtatgggg

SEQ ID NO: 1576 - DNA, 20 bp, human
gctgctgcggaggcaaaacg

SEQ ID NO: 1577 - DNA, 20 bp, human
gccacgcgtccaggaaccag

SEQ ID NO: 1578 - DNA, 20 bp, human
gagcccagctgtcgggaatg

SEQ ID NO: 1579 - DNA, 20 bp, human
ggaagatgagcccagctgtc

SEQ ID NO: 1580 - DNA, 20 bp, human
ggtccagcttccagacgctg

SEQ ID NO: 1581 - DNA, 20 bp, human
gggtctctgcgcgcatctgg

SEQ ID NO: 1582 - DNA, 20 bp, human
ggcgtctggaagctggacgt

SEQ ID NO: 1583 - DNA, 20 bp, human
ggggggccaaacaagacaat

SEQ ID NO: 1584 - DNA, 20 bp, human
gagctgtcgggaatggggac

SEQ ID NO: 1585 - DNA, 20 bp, human
gcccccagctgacccaaaca

SEQ ID NO: 1586 - DNA, 20 bp, human
gcctggtcgccagcctaacc

SEQ ID NO: 1587 - DNA, 20 bp, human
gagtgagcggagcgcctggg

SEQ ID NO: 1588 - DNA, 20 bp, human
gcacagtgagcggagcgcct

SEQ ID NO: 1589 - DNA, 20 bp, human
ggagcccctgctggacctaa

SEQ ID NO: 1590 - DNA, 20 bp, human
gccgctcactgtgccgggtt

SEQ ID NO: 1591 - DNA, 20 bp, human
gctccggccgcggaccgaga

SEQ ID NO: 1592 - DNA, 20 bp, human
ggagcggagcgcctgggcgg

SEQ ID NO: 1593 - DNA, 20 bp, human
gcccgcccaagggtgaagag

SEQ ID NO: 1594 - DNA, 20 bp, human
ggagtccagtgtgtagaggg

SEQ ID NO: 1595 - DNA, 20 bp, human
gctggccccactccgctctc

SEQ ID NO: 1596 - DNA, 20 bp, human
gagcctgcgccggggaacat

SEQ ID NO: 1597 - DNA, 20 bp, human
gggggagggagactcacctg

SEQ ID NO: 1598 - DNA, 20 bp, human
gggaggcggccgatgttccc

SEQ ID NO: 1599 - DNA, 20 bp, human
gcgggtaccgccccaattag

SEQ ID NO: 1600 - DNA, 20 bp, human
gatcggccgcctccagctcc

SEQ ID NO: 1601 - DNA, 20 bp, human
gtctgcggggcgctgcgcag

SEQ ID NO: 1602 - DNA, 20 bp, human
gccgggaacctgcgcagctc

SEQ ID NO: 1603 - DNA, 20 bp, human
gccttaaggagagtcccggg

SEQ ID NO: 1604 - DNA, 20 bp, human
gccgatcgctccctagtccg

SEQ ID NO: 1605 - DNA, 20 bp, human
gccaggcccccctaacggga

SEQ ID NO: 1606 - DNA, 20 bp, human
gctcccacgcggggtctcgg

SEQ ID NO: 1607 - DNA, 20 bp, human
gagcccccgagaccccgcgt

SEQ ID NO: 1608 - DNA, 20 bp, human
gggcgaggcgcactccgcgg

SEQ ID NO: 1609 - DNA, 20 bp, human
gctgggcgaggcgcactccg

SEQ ID NO: 1610 - DNA, 20 bp, human
gcgccggccgctctcccacg

SEQ ID NO: 1611 - DNA, 20 bp, human
gtgcatgcggcaataccgcg

SEQ ID NO: 1612 - DNA, 20 bp, human
gcaccaggcctagcattcat

SEQ ID NO: 1613 - DNA, 20 bp, human
ggcgcacgcacgcccgacgc

SEQ ID NO: 1614 - DNA, 20 bp, human
ggcccccagcctgctccgag

SEQ ID NO: 1615 - DNA, 20 bp, human
gcgtcaccagggtccggtcg

SEQ ID NO: 1616 - DNA, 20 bp, human
gagtacctcacgcaagatgg

SEQ ID NO: 1617 - DNA, 20 bp, human
gtcacccgcagcgcctgaag

SEQ ID NO: 1618 - DNA, 20 bp, human
gtccagtgcggccttcaggt

SEQ ID NO: 1619 - DNA, 20 bp, human
gctcaggccagcaacgccgt

SEQ ID NO: 1620 - DNA, 20 bp, human
gacagatacaaacaaggagg

SEQ ID NO: 1621 - DNA, 20 bp, human
gagcgcgagcccaaatggga

SEQ ID NO: 1622 - DNA, 20 bp, human
gaccgtgcgcgcggatccag

SEQ ID NO: 1623 - DNA, 20 bp, human
gcggcgcaggcgcagtatcc

SEQ ID NO: 1624 - DNA, 20 bp, human
ggaagatgcccgaagccgtc

SEQ ID NO: 1625 - DNA, 20 bp, human
gggcgttgctggcctgaggg

SEQ ID NO: 1626 - DNA, 20 bp, human
ggatcagccggagacatgca

SEQ ID NO: 1627 - DNA, 20 bp, human
gctctattgtattggcggag

SEQ ID NO: 1628 - DNA, 20 bp, human
gaggaagacgaagggagcta

SEQ ID NO: 1629 - DNA, 20 bp, human
ggtggctggctctattgtat

SEQ ID NO: 1630 - DNA, 20 bp, human
gcggagcggcagcgatcagc

SEQ ID NO: 1631 - DNA, 20 bp, human
ggggataaacagcacttcca

SEQ ID NO: 1632 - DNA, 20 bp, human
gggcggggaaaaggcataca

SEQ ID NO: 1633 - DNA, 20 bp, human
ggctggctctattgtattgg

SEQ ID NO: 1634 - DNA, 20 bp, human
gctcccccatccgcacacac

SEQ ID NO: 1635 - DNA, 20 bp, human
gagcctgtgtgtgcggatgg

SEQ ID NO: 1636 - DNA, 20 bp, human
gtatgagctgctattgaaca

SEQ ID NO: 1637 - DNA, 20 bp, human
gtcctttcaggatacagtac

SEQ ID NO: 1638 - DNA, 20 bp, human
gtcccgtactgtatcctgaa

SEQ ID NO: 1639 - DNA, 20 bp, human
gtacgggatcctttctggaa

SEQ ID NO: 1640 - DNA, 20 bp, human
ggtatgacagatagacagga

SEQ ID NO: 1641 - DNA, 20 bp, human
gagctgctattgaacacggc

SEQ ID NO: 1642 - DNA, 20 bp, human
gtacagtacgggatcctttc

SEQ ID NO: 1643 - DNA, 20 bp, human
ggagggtatgacagatagac

SEQ ID NO: 1644 - DNA, 20 bp, human
gtggggaagcttagaggttc

SEQ ID NO: 1645 - DNA, 20 bp, human
ggtttctgtaatcagccttg

SEQ ID NO: 1646 - DNA, 20 bp, human
gtccccatgccaaattggtc

SEQ ID NO: 1647 - DNA, 20 bp, human
gtcctggctgtgctgtgcgc

SEQ ID NO: 1648 - DNA, 20 bp, human
ggcagctctgctcggaaaga

SEQ ID NO: 1649 - DNA, 20 bp, human
gcagcccggaggtaaggaaa

SEQ ID NO: 1650 - DNA, 20 bp, human
gaagcaaaacaggtaaacag

SEQ ID NO: 1651 - DNA, 20 bp, human
gcccagccagcccggaggta

SEQ ID NO: 1652 - DNA, 20 bp, human
gaggtaaggaaacggtgctc

SEQ ID NO: 1653 - DNA, 20 bp, human
gtttaagctccagtaagcag

SEQ ID NO: 1654 - DNA, 20 bp, human
gccattctgcctgaccaatt

SEQ ID NO: 1655 - DNA, 20 bp, human
gtctgctcggaaagaaggca

SEQ ID NO: 1656 - DNA, 20 bp, human
ggtgagtgcggaacaagtct

SEQ ID NO: 1657 - DNA, 20 bp, human
gcccggtggaaacacagagt

SEQ ID NO: 1658 - DNA, 20 bp, human
ggcccggccgtgcgtgagtg

SEQ ID NO: 1659 - DNA, 20 bp, human
gtccgcactcacgcacggcc

SEQ ID NO: 1660 - DNA, 20 bp, human
gaggacaggccccggagtca

SEQ ID NO: 1661 - DNA, 20 bp, human
gggacaggatgctaacgtag

SEQ ID NO: 1662 - DNA, 20 bp, human
gggctgtagccgtgactccg

SEQ ID NO: 1663 - DNA, 20 bp, human
gccggggccagaattctcgc

SEQ ID NO: 1664 - DNA, 20 bp, human
gcaggcgcctgcgagaattc

SEQ ID NO: 1665 - DNA, 20 bp, human
gtgcggagcgcgttctctga

SEQ ID NO: 1666 - DNA, 20 bp, human
gtctgccgactacaacaggt

SEQ ID NO: 1667 - DNA, 20 bp, human
gcctctctgccgactacaac

SEQ ID NO: 1668 - DNA, 20 bp, human
gtgtctatatatctgccgga

SEQ ID NO: 1669 - DNA, 20 bp, human
gaacaaaagtagctggagtt

SEQ ID NO: 1670 - DNA, 20 bp, human
gaagttttaccgacaagtaa

SEQ ID NO: 1671 - DNA, 20 bp, human
gagtaaatatacaagatctt

SEQ ID NO: 1672 - DNA, 20 bp, human
gtgtcggtaaaactttgtta

SEQ ID NO: 1673 - DNA, 20 bp, human
ggtatatttacttatataga

SEQ ID NO: 1674 - DNA, 20 bp, human
gatattaagattttcattta

SEQ ID NO: 1675 - DNA, 20 bp, human
ggagtaaaaaagagtagaaa

SEQ ID NO: 1676 - DNA, 20 bp, human
gccggtagcttcccgggatc

SEQ ID NO: 1677 - DNA, 20 bp, human
gcggaggcaggaagctccta

SEQ ID NO: 1678 - DNA, 20 bp, human
gggcgcgcctcacccctccc

SEQ ID NO: 1679 - DNA, 20 bp, human
gcgatagctgtgcccgggag

SEQ ID NO: 1680 - DNA, 20 bp, human
gcttcggcagaggtgagcac

SEQ ID NO: 1681 - DNA, 20 bp, human
gccgtcccggcatccgatgg

SEQ ID NO: 1682 - DNA, 20 bp, human
gtgcgcggcgcttcttccac

SEQ ID NO: 1683 - DNA, 20 bp, human
gcagcagccggtagcttccc

SEQ ID NO: 1684 - DNA, 20 bp, human
gcgggaagtagagaaagcgg

SEQ ID NO: 1685 - DNA, 20 bp, human
gcgacgaaccccgcaaaatc

SEQ ID NO: 1686 - DNA, 20 bp, human
ggagacctttgtgaaaactg

SEQ ID NO: 1687 - DNA, 20 bp, human
gaactccacagttttcacaa

SEQ ID NO: 1688 - DNA, 20 bp, human
gaatggacctagactgggtt

SEQ ID NO: 1689 - DNA, 20 bp, human
ggcgagggggttaaatcatt

SEQ ID NO: 1690 - DNA, 20 bp, human
gtatttctgaaacttctcca

SEQ ID NO: 1691 - DNA, 20 bp, human
gcctactgactgctgcctga

SEQ ID NO: 1692 - DNA, 20 bp, human
gccagatctaaaaaaggtaa

SEQ ID NO: 1693 - DNA, 20 bp, human
gttttggtagaatatgacta

SEQ ID NO: 1694 - DNA, 20 bp, human
ggttctaatggacctagact

SEQ ID NO: 1695 - DNA, 20 bp, human
gagtagaagaccattaaaaa

SEQ ID NO: 1696 - DNA, 20 bp, human
ggtggggcgctatgccgggg

SEQ ID NO: 1697 - DNA, 20 bp, human
gggacaccgaggaaccccaa

SEQ ID NO: 1698 - DNA, 20 bp, human
gccagggatttgaggtccgg

SEQ ID NO: 1699 - DNA, 20 bp, human
gcggcacgtttctcgagtcc

SEQ ID NO: 1700 - DNA, 20 bp, human
ggctctagtgagaaacccgt

SEQ ID NO: 1701 - DNA, 20 bp, human
ggcagatgccaggtgctcaa

SEQ ID NO: 1702 - DNA, 20 bp, human
ggacgcgcttgtacaatgcc

SEQ ID NO: 1703 - DNA, 20 bp, human
gaggtcttgggcaaagagaa

SEQ ID NO: 1704 - DNA, 20 bp, human
gctcgagaaacgtgccgccc

SEQ ID NO: 1705 - DNA, 20 bp, human
gtctgcgcaggcgcagtcgg

SEQ ID NO: 1706 - DNA, 20 bp, human
ggcgaacctgacccaagcag

SEQ ID NO: 1707 - DNA, 20 bp, human
gagccccgccgtgcagtcgg

SEQ ID NO: 1708 - DNA, 20 bp, human
gagggtgtgcggccagtcct

SEQ ID NO: 1709 - DNA, 20 bp, human
gctgggagtcctaaccccga

SEQ ID NO: 1710 - DNA, 20 bp, human
ggtgcgggcctcacaccctc

SEQ ID NO: 1711 - DNA, 20 bp, human
gctggaaccgcgcagcgcac

SEQ ID NO: 1712 - DNA, 20 bp, human
gcacctccgactgcacggcg

SEQ ID NO: 1713 - DNA, 20 bp, human
ggaggctgagaggagaatcg

SEQ ID NO: 1714 - DNA, 20 bp, human
gaggcccggctggctggata

SEQ ID NO: 1715 - DNA, 20 bp, human
ggcgtcccgctgcttgggtc

SEQ ID NO: 1716 - DNA, 20 bp, human
gtgaggacaaggtgactagg

SEQ ID NO: 1717 - DNA, 20 bp, human
gcagccgccggcacagtagg

SEQ ID NO: 1718 - DNA, 20 bp, human
gccggggacgccttgaccta

SEQ ID NO: 1719 - DNA, 20 bp, human
gcccgcccccgtgaacccag

SEQ ID NO: 1720 - DNA, 20 bp, human
ggagcgagctcagggacctc

SEQ ID NO: 1721 - DNA, 20 bp, human
gcttctaggcccagttcctg

SEQ ID NO: 1722 - DNA, 20 bp, human
ggaatggaaacacaccccac

SEQ ID NO: 1723 - DNA, 20 bp, human
gaagtgaggcctcaggaact

SEQ ID NO: 1724 - DNA, 20 bp, human
gtctctggtgccctaggtca

SEQ ID NO: 1725 - DNA, 20 bp, human
gccacagccgccggcacagt

SEQ ID NO: 1726 - DNA, 20 bp, human
gcagcccgagaggaagagtt

SEQ ID NO: 1727 - DNA, 20 bp, human
ggagttgggcagagttgcag

SEQ ID NO: 1728 - DNA, 20 bp, human
gagcaggaacccaaataatc

SEQ ID NO: 1729 - DNA, 20 bp, human
ggcttgctggctcgcggaat

SEQ ID NO: 1730 - DNA, 20 bp, human
gggccaggactggttcgtcc

SEQ ID NO: 1731 - DNA, 20 bp, human
gcagtttggccggattattt

SEQ ID NO: 1732 - DNA, 20 bp, human
gctggctcgcggaatgggct

SEQ ID NO: 1733 - DNA, 20 bp, human
ggcggctgctgtgccgggtg

SEQ ID NO: 1734 - DNA, 20 bp, human
gcgctacttcctcccgcccg

SEQ ID NO: 1735 - DNA, 20 bp, human
gacagctgaggcagtttggc

SEQ ID NO: 1736 - DNA, 20 bp, human
ggtgaccagcttgtgtctct

SEQ ID NO: 1737 - DNA, 20 bp, human
ggactccaaatgaagcctgt

SEQ ID NO: 1738 - DNA, 20 bp, human
gtctggatcatcgcgccggg

SEQ ID NO: 1739 - DNA, 20 bp, human
gtcatcgcgccgggtggccg

SEQ ID NO: 1740 - DNA, 20 bp, human
ggggctgtcagatcccccac

SEQ ID NO: 1741 - DNA, 20 bp, human
ggaggcccacaggcttcatt

SEQ ID NO: 1742 - DNA, 20 bp, human
gatggcccgtggagagtgtg

SEQ ID NO: 1743 - DNA, 20 bp, human
gcacctgcgacgggtatgga

SEQ ID NO: 1744 - DNA, 20 bp, human
gcggcctctggaattctatt

SEQ ID NO: 1745 - DNA, 20 bp, human
ggagaaatcgcagaacccct

SEQ ID NO: 1746 - DNA, 20 bp, human
gctgcgggcaggctgaaggg

SEQ ID NO: 1747 - DNA, 20 bp, human
gctgggctcggggacctcgg

SEQ ID NO: 1748 - DNA, 20 bp, human
gtggctccggagaagacctg

SEQ ID NO: 1749 - DNA, 20 bp, human
gagccagaggcgggaagctg

SEQ ID NO: 1750 - DNA, 20 bp, human
gtccgcaaatgagtcagcag

SEQ ID NO: 1751 - DNA, 20 bp, human
gggtacaggctgatctcccc

SEQ ID NO: 1752 - DNA, 20 bp, human
gcgcaagactcagaggccag

SEQ ID NO: 1753 - DNA, 20 bp, human
gctggcccggcgcgccgcag

SEQ ID NO: 1754 - DNA, 20 bp, human
ggaggcgggaagctgcgggc

SEQ ID NO: 1755 - DNA, 20 bp, human
gcgtccggggagcgagtccg

SEQ ID NO: 1756 - DNA, 20 bp, human
gcctgcgcagccagggatag

SEQ ID NO: 1757 - DNA, 20 bp, human
gaaccccgcagaagctctct

SEQ ID NO: 1758 - DNA, 20 bp, human
gagcgctctcgccctggcca

SEQ ID NO: 1759 - DNA, 20 bp, human
gtgggcatggccgagaccgg

SEQ ID NO: 1760 - DNA, 20 bp, human
ggtgcgccggctggatggct

SEQ ID NO: 1761 - DNA, 20 bp, human
ggggcatggtggggtgtcgg

SEQ ID NO: 1762 - DNA, 20 bp, human
gtgttgttgagctctctccc

SEQ ID NO: 1763 - DNA, 20 bp, human
ggccctggccatggagcggc

SEQ ID NO: 1764 - DNA, 20 bp, human
gagcccagagagcttctgcg

SEQ ID NO: 1765 - DNA, 20 bp, human
gtggctcatgaccacctcgc

SEQ ID NO: 1766 - DNA, 20 bp, human
gcggcctcttgcgctcctag

SEQ ID NO: 1767 - DNA, 20 bp, human
ggcgcaagaggccgggagtc

SEQ ID NO: 1768 - DNA, 20 bp, human
gagcaaatcgcggaccaccg

SEQ ID NO: 1769 - DNA, 20 bp, human
ggttcttgcgcaaagcccaa

SEQ ID NO: 1770 - DNA, 20 bp, human
gctaggggcggagaagggtg

SEQ ID NO: 1771 - DNA, 20 bp, human
gcctcttgcgctcctagggg

SEQ ID NO: 1772 - DNA, 20 bp, human
gtctctgcgggaggtgataa

SEQ ID NO: 1773 - DNA, 20 bp, human
gcatgcgcgcttcgtcacaa

SEQ ID NO: 1774 - DNA, 20 bp, human
gactcgtggagacagttcca

SEQ ID NO: 1775 - DNA, 20 bp, human
gctcacaacggcaccaagca

SEQ ID NO: 1776 - DNA, 20 bp, human
gtcagaagcttgctggcctg

SEQ ID NO: 1777 - DNA, 20 bp, human
gagcgtcccggctgtaccaa

SEQ ID NO: 1778 - DNA, 20 bp, human
gcctgagaacaactgaatgg

SEQ ID NO: 1779 - DNA, 20 bp, human
ggcggctgctgtgccagacg

SEQ ID NO: 1780 - DNA, 20 bp, human
ggtacagccgggacgctcga

SEQ ID NO: 1781 - DNA, 20 bp, human
gaggctccattggtacagcc

SEQ ID NO: 1782 - DNA, 20 bp, human
ggaactgcgccgaactcttc

SEQ ID NO: 1783 - DNA, 20 bp, human
gtgctgtccttcgagcgtcc

SEQ ID NO: 1784 - DNA, 20 bp, human
gagagttcggcgcagttcct

SEQ ID NO: 1785 - DNA, 20 bp, human
gcaggttggtcagatcatta

SEQ ID NO: 1786 - DNA, 20 bp, human
gtgacatcttggagccggag

SEQ ID NO: 1787 - DNA, 20 bp, human
ggccggagcggggaattcaa

SEQ ID NO: 1788 - DNA, 20 bp, human
ggccactctaccaaaataga

SEQ ID NO: 1789 - DNA, 20 bp, human
gaaaggcttctcgggttcca

SEQ ID NO: 1790 - DNA, 20 bp, human
gagcgccaaaaaggcttctc

SEQ ID NO: 1791 - DNA, 20 bp, human
gcgggtggtgtgagcgtcag

SEQ ID NO: 1792 - DNA, 20 bp, human
gtccagcagcagcggcctgg

SEQ ID NO: 1793 - DNA, 20 bp, human
gactggcgccgcacccctgg

SEQ ID NO: 1794 - DNA, 20 bp, human
gagcgcgccgaatgtccgga

SEQ ID NO: 1795 - DNA, 20 bp, human
gccggcccgctcgcaccgac

SEQ ID NO: 1796 - DNA, 20 bp, human
gccttcctgccacaaaccat

SEQ ID NO: 1797 - DNA, 20 bp, human
gacagaagcctaagaatcat

SEQ ID NO: 1798 - DNA, 20 bp, human
ggttgggtttggccaaagag

SEQ ID NO: 1799 - DNA, 20 bp, human
gcttttttagaaggaaccta

SEQ ID NO: 1800 - DNA, 20 bp, human
gagctgggaacatagcaggg

SEQ ID NO: 1801 - DNA, 20 bp, human
gatctgaaggttcaagggaa

SEQ ID NO: 1802 - DNA, 20 bp, human
gtgtagaaccctgaatctga

SEQ ID NO: 1803 - DNA, 20 bp, human
gagggcagctgcagtgcaag

SEQ ID NO: 1804 - DNA, 20 bp, human
gccttgaaccttcagattca

SEQ ID NO: 1805 - DNA, 20 bp, human
gccagctaggttgagctgtg

SEQ ID NO: 1806 - DNA, 20 bp, human
ggcggcgggcggctgcagaa

SEQ ID NO: 1807 - DNA, 20 bp, human
ggtctgggcccgacatgctg

SEQ ID NO: 1808 - DNA, 20 bp, human
ggccgcagcccccagcatgt

SEQ ID NO: 1809 - DNA, 20 bp, human
gggggctgcggcggcggatg

SEQ ID NO: 1810 - DNA, 20 bp, human
gtaccggcagatctggatgg

SEQ ID NO: 1811 - DNA, 20 bp, human
gggacggcgtctcgacgtct

SEQ ID NO: 1812 - DNA, 20 bp, human
gaggccgtgcggggaatcgg

SEQ ID NO: 1813 - DNA, 20 bp, human
gccgggccgcgccataaagg

SEQ ID NO: 1814 - DNA, 20 bp, human
gcgcgcgggccctctcttac

SEQ ID NO: 1815 - DNA, 20 bp, human
gtcttaccggcagatctgga

SEQ ID NO: 1816 - DNA, 20 bp, human
gacccgctccgcggaagacg

SEQ ID NO: 1817 - DNA, 20 bp, human
ggcaatctgccggaagagtc

SEQ ID NO: 1818 - DNA, 20 bp, human
ggccctgcacacccgctccg

SEQ ID NO: 1819 - DNA, 20 bp, human
gctgccgagcagggtctctc

SEQ ID NO: 1820 - DNA, 20 bp, human
gctgccctaagccttcacgg

SEQ ID NO: 1821 - DNA, 20 bp, human
gaggagacttccggttacta

SEQ ID NO: 1822 - DNA, 20 bp, human
gccctaaaggaggggatgct

SEQ ID NO: 1823 - DNA, 20 bp, human
gtgacctgagagaccctgct

SEQ ID NO: 1824 - DNA, 20 bp, human
gtatgtctccgcgtcttccg

SEQ ID NO: 1825 - DNA, 20 bp, human
gcagacctcgcagcgcggag

SEQ ID NO: 1826 - DNA, 20 bp, human
gggccccgcgcgctagtcgg

SEQ ID NO: 1827 - DNA, 20 bp, human
gcccgggctgtcctcagcaa

SEQ ID NO: 1828 - DNA, 20 bp, human
ggaagaagtgggccacgcat

SEQ ID NO: 1829 - DNA, 20 bp, human
gcctcagcaagggcgcggtc

SEQ ID NO: 1830 - DNA, 20 bp, human
gcagcccgggagccggacag

SEQ ID NO: 1831 - DNA, 20 bp, human
gtggccccggcggaagaagt

SEQ ID NO: 1832 - DNA, 20 bp, human
ggcggctaccaaccacaccc

SEQ ID NO: 1833 - DNA, 20 bp, human
ggtgcgcgcgatggagaacc

SEQ ID NO: 1834 - DNA, 20 bp, human
ggctgtcctcagcaagggcg

SEQ ID NO: 1835 - DNA, 20 bp, human
ggggccagcccgaagctcta

SEQ ID NO: 1836 - DNA, 20 bp, human
gctgcctcctagggtccggc

SEQ ID NO: 1837 - DNA, 20 bp, human
ggttcatggcgacgaccagc

SEQ ID NO: 1838 - DNA, 20 bp, human
gaagtaagcaccgaccgagg

SEQ ID NO: 1839 - DNA, 20 bp, human
ggcgccggccggaccctagg

SEQ ID NO: 1840 - DNA, 20 bp, human
ggcgaagtaagcaccgaccg

SEQ ID NO: 1841 - DNA, 20 bp, human
gtctctgaaagggggttaaa

SEQ ID NO: 1842 - DNA, 20 bp, human
gggggacttgcgccgtcctg

SEQ ID NO: 1843 - DNA, 20 bp, human
gttgtcactgccacctcggt

SEQ ID NO: 1844 - DNA, 20 bp, human
gagagtcgcggacacacctg

SEQ ID NO: 1845 - DNA, 20 bp, human
ggcctattgtgattcaggga

SEQ ID NO: 1846 - DNA, 20 bp, human
gaggctgcggcctacagccg

SEQ ID NO: 1847 - DNA, 20 bp, human
gcggcctacagtgcggacac

SEQ ID NO: 1848 - DNA, 20 bp, human
gggaggacagggaatgccgg

SEQ ID NO: 1849 - DNA, 20 bp, human
ggcggcctacagccggggag

SEQ ID NO: 1850 - DNA, 20 bp, human
gagtgcggacacaggacaga

SEQ ID NO: 1851 - DNA, 20 bp, human
gctggcctctccccggctgt

SEQ ID NO: 1852 - DNA, 20 bp, human
ggcggacagggtcatcatgg

SEQ ID NO: 1853 - DNA, 20 bp, human
ggggcttggggttttaaaga

SEQ ID NO: 1854 - DNA, 20 bp, human
gtgtcctgtgtccgcactgt

SEQ ID NO: 1855 - DNA, 20 bp, human
gggccctgcactaagtgtta

SEQ ID NO: 1856 - DNA, 20 bp, human
gtggtggcctagaagtggat

SEQ ID NO: 1857 - DNA, 20 bp, human
gttagggggcctccaccata

SEQ ID NO: 1858 - DNA, 20 bp, human
gtgcacagggttggtcccta

SEQ ID NO: 1859 - DNA, 20 bp, human
ggaggatggtggcctagaag

SEQ ID NO: 1860 - DNA, 20 bp, human
ggctcagtaagtggtgcaca

SEQ ID NO: 1861 - DNA, 20 bp, human
gaagcttggtgggtccccaa

SEQ ID NO: 1862 - DNA, 20 bp, human
gctgagtggcctgccatcac

SEQ ID NO: 1863 - DNA, 20 bp, human
gggataggttagtcatactg

SEQ ID NO: 1864 - DNA, 20 bp, human
ggcagggcctgtggcggaca

SEQ ID NO: 1865 - DNA, 20 bp, human
gggggttgggcggtgttagg

SEQ ID NO: 1866 - DNA, 20 bp, human
gcgcgaccgactcggagtac

SEQ ID NO: 1867 - DNA, 20 bp, human
gtcacccagcaggcgctcag

SEQ ID NO: 1868 - DNA, 20 bp, human
gtagtcccagtactccgagt

SEQ ID NO: 1869 - DNA, 20 bp, human
gcagagacagctgcgctgtg

SEQ ID NO: 1870 - DNA, 20 bp, human
gtgtcggcccgcgaccgact

SEQ ID NO: 1871 - DNA, 20 bp, human
gtgcccagggtctaccgtct

SEQ ID NO: 1872 - DNA, 20 bp, human
gcggaggccgagaggcgtgg

SEQ ID NO: 1873 - DNA, 20 bp, human
gtaggcagctgttcacgaaa

SEQ ID NO: 1874 - DNA, 20 bp, human
ggccccgcccatgggacgga

SEQ ID NO: 1875 - DNA, 20 bp, human
gtgcagagcagcgaggaccg

SEQ ID NO: 1876 - DNA, 20 bp, human
gagcaggaaaggatctccag

SEQ ID NO: 1877 - DNA, 20 bp, human
ggttgaactgtggagtgtgt

SEQ ID NO: 1878 - DNA, 20 bp, human
gcctggcaggggttgaactg

SEQ ID NO: 1879 - DNA, 20 bp, human
gtgccagggaaaccaaaagc

SEQ ID NO: 1880 - DNA, 20 bp, human
gcggcgcgttgacgtcatgg

SEQ ID NO: 1881 - DNA, 20 bp, human
gtgattaccgataaaagtca

SEQ ID NO: 1882 - DNA, 20 bp, human
ggaaatgagaatggcgccgc

SEQ ID NO: 1883 - DNA, 20 bp, human
ggctgcactcagacttagga

SEQ ID NO: 1884 - DNA, 20 bp, human
gctcagacttaggaaggcac

SEQ ID NO: 1885 - DNA, 20 bp, human
ggcgttgacgtcatggaggc

SEQ ID NO: 1886 - DNA, 20 bp, human
ggaagtcgccgtccaggtag

SEQ ID NO: 1887 - DNA, 20 bp, human
gtgcacccgactcttcgtgg

SEQ ID NO: 1888 - DNA, 20 bp, human
gctcagggggccgaagaggt

SEQ ID NO: 1889 - DNA, 20 bp, human
gggagagggcacctctcagg

SEQ ID NO: 1890 - DNA, 20 bp, human
gccctcccccacgaagagtc

SEQ ID NO: 1891 - DNA, 20 bp, human
gtccaggtagcggtgcaggg

SEQ ID NO: 1892 - DNA, 20 bp, human
gggtgtctacgaagaccgtg

SEQ ID NO: 1893 - DNA, 20 bp, human
ggcagccggcgccgggtctg

SEQ ID NO: 1894 - DNA, 20 bp, human
gagggggccgaagaggtcgg

SEQ ID NO: 1895 - DNA, 20 bp, human
gacacgctcggcggcttcgg

SEQ ID NO: 1896 - DNA, 20 bp, human
gtctgcgcgcgggaagatgg

SEQ ID NO: 1897 - DNA, 20 bp, human
ggcctctgcgcgcgggaaga

SEQ ID NO: 1898 - DNA, 20 bp, human
gcggcctaggaaccatgagg

SEQ ID NO: 1899 - DNA, 20 bp, human
gccattggaggggaacgaga

SEQ ID NO: 1900 - DNA, 20 bp, human
gcacacaaacagcacggact

SEQ ID NO: 1901 - DNA, 20 bp, human
gcgcgggaagatggcggaac

SEQ ID NO: 1902 - DNA, 20 bp, human
gggaggttgtcggactgatg

SEQ ID NO: 1903 - DNA, 20 bp, human
gccctccaatgggcccaggt

SEQ ID NO: 1904 - DNA, 20 bp, human
gccagggactgggaggccta

SEQ ID NO: 1905 - DNA, 20 bp, human
ggtcggcgtgcggaacgccg

SEQ ID NO: 1906 - DNA, 20 bp, human
gtgatggcgggcaagcggtc

SEQ ID NO: 1907 - DNA, 20 bp, human
gagattacaacggtgatggc

SEQ ID NO: 1908 - DNA, 20 bp, human
gtatgtggtggggacaactg

SEQ ID NO: 1909 - DNA, 20 bp, human
ggccaaggtacaggtaggaa

SEQ ID NO: 1910 - DNA, 20 bp, human
gcaagctggaacccgctggg

SEQ ID NO: 1911 - DNA, 20 bp, human
gaagcggtccggctggagcc

SEQ ID NO: 1912 - DNA, 20 bp, human
ggaggtcgaggatctcggga

SEQ ID NO: 1913 - DNA, 20 bp, human
ggaagtgaaagcaacgtatg

SEQ ID NO: 1914 - DNA, 20 bp, human
gataggcaaagccaaggtac

SEQ ID NO: 1915 - DNA, 20 bp, human
gcaccaggttcacgccgaga

SEQ ID NO: 1916 - DNA, 20 bp, human
ggacacaggccagtcaccgg

SEQ ID NO: 1917 - DNA, 20 bp, human
ggaggctctgagaggctggt

SEQ ID NO: 1918 - DNA, 20 bp, human
gtggcaccatcagccaggga

SEQ ID NO: 1919 - DNA, 20 bp, human
gtgcccagcactcacccagg

SEQ ID NO: 1920 - DNA, 20 bp, human
gggaataaaggctcagggac

SEQ ID NO: 1921 - DNA, 20 bp, human
ggctacaaagcgcagggcag

SEQ ID NO: 1922 - DNA, 20 bp, human
gacccctccccagtcaccca

SEQ ID NO: 1923 - DNA, 20 bp, human
gcttcctcctcagggaataa

SEQ ID NO: 1924 - DNA, 20 bp, human
gcccacggctacaaagcgca

SEQ ID NO: 1925 - DNA, 20 bp, human
gccgcctgccctgagataga

SEQ ID NO: 1926 - DNA, 20 bp, human
gacgggaccgcagcctggga

SEQ ID NO: 1927 - DNA, 20 bp, human
ggccgatccgccctgctcga

SEQ ID NO: 1928 - DNA, 20 bp, human
gcaggcgatcgcactcctgg

SEQ ID NO: 1929 - DNA, 20 bp, human
gccgcaggcgatcgcactcc

SEQ ID NO: 1930 - DNA, 20 bp, human
gggcggccccagctttaagc

SEQ ID NO: 1931 - DNA, 20 bp, human
ggccctcgagcagggcggat

SEQ ID NO: 1932 - DNA, 20 bp, human
gcaggctgcggtcccgtgga

SEQ ID NO: 1933 - DNA, 20 bp, human
gggtgaggagcaggtcagac

SEQ ID NO: 1934 - DNA, 20 bp, human
gacagctgctgagactatga

SEQ ID NO: 1935 - DNA, 20 bp, human
gcgccctgctcgagggctca

SEQ ID NO: 1936 - DNA, 20 bp, human
gagaccccgagtgggaacgg

SEQ ID NO: 1937 - DNA, 20 bp, human
gcctgagggagaccccgagt

SEQ ID NO: 1938 - DNA, 20 bp, human
ggcagcagcgaagagtccct

SEQ ID NO: 1939 - DNA, 20 bp, human
gggcctaccaccatgatcac

SEQ ID NO: 1940 - DNA, 20 bp, human
gctcaagccgctcccgctgg

SEQ ID NO: 1941 - DNA, 20 bp, human
gggcgtactgcctgcaccag

SEQ ID NO: 1942 - DNA, 20 bp, human
ggcaggtgagaggtcggccc

SEQ ID NO: 1943 - DNA, 20 bp, human
ggctctgaagatgtgtgtca

SEQ ID NO: 1944 - DNA, 20 bp, human
gcctgcagcctcaacccgga

SEQ ID NO: 1945 - DNA, 20 bp, human
gtgcgcttgtggaccccagt

SEQ ID NO: 1946 - DNA, 20 bp, human
gggccccgcgagctccccgg

SEQ ID NO: 1947 - DNA, 20 bp, human
ggcgcaagtcctaggctcag

SEQ ID NO: 1948 - DNA, 20 bp, human
ggcgagcgcggggataaagg

SEQ ID NO: 1949 - DNA, 20 bp, human
gctgggagaagggggctatg

SEQ ID NO: 1950 - DNA, 20 bp, human
gaatctcggctggaatccag

SEQ ID NO: 1951 - DNA, 20 bp, human
gctcctcccggcgcgagggg

SEQ ID NO: 1952 - DNA, 20 bp, human
ggtgagacggcgccagctct

SEQ ID NO: 1953 - DNA, 20 bp, human
gggcttggagacagagccgg

SEQ ID NO: 1954 - DNA, 20 bp, human
ggcagccccgcactctcccg

SEQ ID NO: 1955 - DNA, 20 bp, human
gagcgcggggataaaggagg

SEQ ID NO: 1956 - DNA, 20 bp, human
gaaacaagaagccaaggcta

SEQ ID NO: 1957 - DNA, 20 bp, human
ggggtgcagctctcatgttg

SEQ ID NO: 1958 - DNA, 20 bp, human
ggactggtgtggctgtcaaa

SEQ ID NO: 1959 - DNA, 20 bp, human
ggctgtttctggcaggagtt

SEQ ID NO: 1960 - DNA, 20 bp, human
ggtctctgggaaacaatcca

SEQ ID NO: 1961 - DNA, 20 bp, human
gaagcagaaacaagaagcca

SEQ ID NO: 1962 - DNA, 20 bp, human
gggtttcttctggactggtg

SEQ ID NO: 1963 - DNA, 20 bp, human
gcctctacaggcttttgaag

SEQ ID NO: 1964 - DNA, 20 bp, human
gttcccagcaaagtctgata

SEQ ID NO: 1965 - DNA, 20 bp, human
ggctgtggtttcttctggac

SEQ ID NO: 1966 - DNA, 20 bp, human
gactcaggaaggcctcgtag

SEQ ID NO: 1967 - DNA, 20 bp, human
ggtaccggcgggaggaggta

SEQ ID NO: 1968 - DNA, 20 bp, human
gcagcaggagaggtccagca

SEQ ID NO: 1969 - DNA, 20 bp, human
gccagagccacgaacaccag

SEQ ID NO: 1970 - DNA, 20 bp, human
gcccatggacccacacaagg

SEQ ID NO: 1971 - DNA, 20 bp, human
gcggtactccggactcagga

SEQ ID NO: 1972 - DNA, 20 bp, human
gctgagtccggagtaccggc

SEQ ID NO: 1973 - DNA, 20 bp, human
gcgaacaccaggggtccttc

SEQ ID NO: 1974 - DNA, 20 bp, human
gtaccccatggacccacaca

SEQ ID NO: 1975 - DNA, 20 bp, human
gtcacaggtgggaggtcagg

SEQ ID NO: 1976 - DNA, 20 bp, human
gagtgagagagcctactggg

SEQ ID NO: 1977 - DNA, 20 bp, human
gccaggcagtgccaggagta

SEQ ID NO: 1978 - DNA, 20 bp, human
ggtgaagcgatgatatcctg

SEQ ID NO: 1979 - DNA, 20 bp, human
gtccagggctagggaaaagg

SEQ ID NO: 1980 - DNA, 20 bp, human
gctggtcttggcagtgtccg

SEQ ID NO: 1981 - DNA, 20 bp, human
gagtaggctctctcactcca

SEQ ID NO: 1982 - DNA, 20 bp, human
ggtgctgaggggtccatctc

SEQ ID NO: 1983 - DNA, 20 bp, human
gagcatctcaaccatactcc

SEQ ID NO: 1984 - DNA, 20 bp, human
ggggctgttgggggcaacca

SEQ ID NO: 1985 - DNA, 20 bp, human
gagacagctgtcccaacccg

SEQ ID NO: 1986 - DNA, 20 bp, human
gctgcggcttggcccgttag

SEQ ID NO: 1987 - DNA, 20 bp, human
gcggcttggcccgttagagg

SEQ ID NO: 1988 - DNA, 20 bp, human
gagaggcggcttgtgtccac

SEQ ID NO: 1989 - DNA, 20 bp, human
ggagagagggctgcctggag

SEQ ID NO: 1990 - DNA, 20 bp, human
ggaggcctgagtcgaatcct

SEQ ID NO: 1991 - DNA, 20 bp, human
gcgactcaggcctccactcc

SEQ ID NO: 1992 - DNA, 20 bp, human
ggtattcggtaggagagaga

SEQ ID NO: 1993 - DNA, 20 bp, human
gggacacaagccgcctctaa

SEQ ID NO: 1994 - DNA, 20 bp, human
gggggggagtctagagacag

SEQ ID NO: 1995 - DNA, 20 bp, human
ggacgcgggcggatcttctc

SEQ ID NO: 1996 - DNA, 20 bp, human
gagaggctgcaacaccaggt

SEQ ID NO: 1997 - DNA, 20 bp, human
gggtctggacaattcaagta

SEQ ID NO: 1998 - DNA, 20 bp, human
gagagaagtaggggcaccag

SEQ ID NO: 1999 - DNA, 20 bp, human
gctgctgccggccacgccag

SEQ ID NO: 2000 - DNA, 20 bp, human
gcgtcattgcagatagtggg

SEQ ID NO: 2001 - DNA, 20 bp, human
ggagcagctggtagtgccag

SEQ ID NO: 2002 - DNA, 20 bp, human
gcagctggtagtgccagtgg

SEQ ID NO: 2003 - DNA, 20 bp, human
ggaagtaggggcaccagtgg

SEQ ID NO: 2004 - DNA, 20 bp, human
gatagtggggggcctggtgg

SEQ ID NO: 2005 - DNA, 20 bp, human
gtggagtgtgtgcaaagatc

SEQ ID NO: 2006 - DNA, 20 bp, human
ggaagctgtggcccacactg

SEQ ID NO: 2007 - DNA, 20 bp, human
gtacagtcagagggtcccac

SEQ ID NO: 2008 - DNA, 20 bp, human
gggtgggacaaaccttcatt

SEQ ID NO: 2009 - DNA, 20 bp, human
gtctggatttaggaaaagag

SEQ ID NO: 2010 - DNA, 20 bp, human
gtaatgtgccaaggaaagat

SEQ ID NO: 2011 - DNA, 20 bp, human
ggttcaggagctctccgagt

SEQ ID NO: 2012 - DNA, 20 bp, human
gtccctcacatttaattggt

SEQ ID NO: 2013 - DNA, 20 bp, human
ggtcccaccaattaaatgtg

SEQ ID NO: 2014 - DNA, 20 bp, human
gaggatccctcacatttaat

SEQ ID NO: 2015 - DNA, 20 bp, human
ggtttgggtgactgagagac

SEQ ID NO: 2016 - DNA, 20 bp, human
gtgtcttcagtggaagcccg

SEQ ID NO: 2017 - DNA, 20 bp, human
gcatgctggggtccccgtgt

SEQ ID NO: 2018 - DNA, 20 bp, human
ggcaattctggagctggata

SEQ ID NO: 2019 - DNA, 20 bp, human
gatcccaggggtatgagctg

SEQ ID NO: 2020 - DNA, 20 bp, human
gaaaggctcatcaaagaatg

SEQ ID NO: 2021 - DNA, 20 bp, human
gcacccccactgctcactca

SEQ ID NO: 2022 - DNA, 20 bp, human
gagtcccccttgaggagaca

SEQ ID NO: 2023 - DNA, 20 bp, human
ggctgcagttggagaccagt

SEQ ID NO: 2024 - DNA, 20 bp, human
gggcagatgccacgcaattc

SEQ ID NO: 2025 - DNA, 20 bp, human
gagtctagaactcggcccac

SEQ ID NO: 2026 - DNA, 20 bp, human
gcgttctggaaggttgaatg

SEQ ID NO: 2027 - DNA, 20 bp, human
gctccgtccagccaggatga

SEQ ID NO: 2028 - DNA, 20 bp, human
gggtagaaggcctgttgtgg

SEQ ID NO: 2029 - DNA, 20 bp, human
gtggctgggatggaacgttc

SEQ ID NO: 2030 - DNA, 20 bp, human
gctggacggagagggtgacg

SEQ ID NO: 2031 - DNA, 20 bp, human
gcagccagtgatgtcacaag

SEQ ID NO: 2032 - DNA, 20 bp, human
gtgtcactcttcaagaggtg

SEQ ID NO: 2033 - DNA, 20 bp, human
gccacctcttgtgacatcac

SEQ ID NO: 2034 - DNA, 20 bp, human
gtgacaggtgccagtggtat

SEQ ID NO: 2035 - DNA, 20 bp, human
gtgcccttctcccataccac

SEQ ID NO: 2036 - DNA, 20 bp, human
gcgcagggcaaagcgagcca

SEQ ID NO: 2037 - DNA, 20 bp, human
ggagccatggctgtctacgt

SEQ ID NO: 2038 - DNA, 20 bp, human
ggtgcactcgtccagaggtg

SEQ ID NO: 2039 - DNA, 20 bp, human
gtctggacgagtgcactggg

SEQ ID NO: 2040 - DNA, 20 bp, human
gatcccgacgtagacagcca

SEQ ID NO: 2041 - DNA, 20 bp, human
gccccccgcgggaagagagg

SEQ ID NO: 2042 - DNA, 20 bp, human
gtaaggagaatattccgatg

SEQ ID NO: 2043 - DNA, 20 bp, human
gtgccaactccgagagaggg

SEQ ID NO: 2044 - DNA, 20 bp, human
gacgtcgggatgctgcgcct

SEQ ID NO: 2045 - DNA, 20 bp, human
gggccgccctctctcggagt

SEQ ID NO: 2046 - DNA, 20 bp, human
gagtcgggccggaccagttc

SEQ ID NO: 2047 - DNA, 20 bp, human
ggccgcgccggggaagctgt

SEQ ID NO: 2048 - DNA, 20 bp, human
ggccgcccgcacctacgaga

SEQ ID NO: 2049 - DNA, 20 bp, human
ggcccgactcacgaccccgc

SEQ ID NO: 2050 - DNA, 20 bp, human
ggctccccaccggacacgag

SEQ ID NO: 2051 - DNA, 20 bp, human
gggtcgggccgggttccggc

SEQ ID NO: 2052 - DNA, 20 bp, human
gccgcgcgcgcgccggggtc

SEQ ID NO: 2053 - DNA, 20 bp, human
gacgaggaagagttgtggcg

SEQ ID NO: 2054 - DNA, 20 bp, human
ggcgggacccggccggaacc

SEQ ID NO: 2055 - DNA, 20 bp, human
gaagcccagctgcgacccag

SEQ ID NO: 2056 - DNA, 20 bp, human
gcggacgagggcaacgtcag

SEQ ID NO: 2057 - DNA, 20 bp, human
gcggagcggccggtccacgg

SEQ ID NO: 2058 - DNA, 20 bp, human
ggtgacagccggcggcggag

SEQ ID NO: 2059 - DNA, 20 bp, human
gccgcgcttcggctgggagg

SEQ ID NO: 2060 - DNA, 20 bp, human
gcggcggagcggccggtcca

SEQ ID NO: 2061 - DNA, 20 bp, human
gccgcccgcgactcagacac

SEQ ID NO: 2062 - DNA, 20 bp, human
ggagcaggcgcggctccgca

SEQ ID NO: 2063 - DNA, 20 bp, human
gggcccggcgaagcagccgg

SEQ ID NO: 2064 - DNA, 20 bp, human
ggggctgcagtgacagccgg

SEQ ID NO: 2065 - DNA, 20 bp, human
gcgcaaccagcgggccgagg

SEQ ID NO: 2066 - DNA, 20 bp, human
ggacgaggaggcgttggacg

SEQ ID NO: 2067 - DNA, 20 bp, human
gactcgttgcctatgcagag

SEQ ID NO: 2068 - DNA, 20 bp, human
ggagcagcggcgagcagggt

SEQ ID NO: 2069 - DNA, 20 bp, human
ggacactgcagttgtctacg

SEQ ID NO: 2070 - DNA, 20 bp, human
gtgcagctcccggctcgcgt

SEQ ID NO: 2071 - DNA, 20 bp, human
gtccgggaagcggctgacgt

SEQ ID NO: 2072 - DNA, 20 bp, human
gcgcccgcgcgcacacccag

SEQ ID NO: 2073 - DNA, 20 bp, human
ggggcctgggaccctgtcgt

SEQ ID NO: 2074 - DNA, 20 bp, human
gcacacccagcggtcaggtg

SEQ ID NO: 2075 - DNA, 20 bp, human
gggccgggacgaggaggcgt

SEQ ID NO: 2076 - DNA, 20 bp, human
gaccgcgtgcccgctagcgc

SEQ ID NO: 2077 - DNA, 20 bp, human
gccggccggctgcgaagacg

SEQ ID NO: 2078 - DNA, 20 bp, human
gtgcggtgagcggcaggaag

SEQ ID NO: 2079 - DNA, 20 bp, human
ggccctcgggatgcggtgag

SEQ ID NO: 2080 - DNA, 20 bp, human
ggcccgctagcgctgggacg

SEQ ID NO: 2081 - DNA, 20 bp, human
gagccgggaggaggttgggt

SEQ ID NO: 2082 - DNA, 20 bp, human
gcctgagccgggaggaggtt

SEQ ID NO: 2083 - DNA, 20 bp, human
gactcggaaagctcgcaaaa

SEQ ID NO: 2084 - DNA, 20 bp, human
gggaccccagagtccatcac

SEQ ID NO: 2085 - DNA, 20 bp, human
gatccagggatactcaccgg

SEQ ID NO: 2086 - DNA, 20 bp, human
gtcagagcagggcagaactg

SEQ ID NO: 2087 - DNA, 20 bp, human
gggcatgaccgagaccagga

SEQ ID NO: 2088 - DNA, 20 bp, human
gctcctgacacagggtctga

SEQ ID NO: 2089 - DNA, 20 bp, human
ggcctgacatggcctgactc

SEQ ID NO: 2090 - DNA, 20 bp, human
ggtcaggaggagcaacggga

SEQ ID NO: 2091 - DNA, 20 bp, human
gagaaggacagggactcgtg

SEQ ID NO: 2092 - DNA, 20 bp, human
gctctgagctgtcccgagtc

SEQ ID NO: 2093 - DNA, 20 bp, human
ggggtaaggggaccatcgag

SEQ ID NO: 2094 - DNA, 20 bp, human
gggaggagcaacgggaagga

SEQ ID NO: 2095 - DNA, 20 bp, human
gtgaaggcatgaccgagacc

SEQ ID NO: 2096 - DNA, 20 bp, human
ggagtagaagtgcctgaatg

SEQ ID NO: 2097 - DNA, 20 bp, human
ggcacaccaagccagaatgt

SEQ ID NO: 2098 - DNA, 20 bp, human
ggtgtgtcccagtcagtcct

SEQ ID NO: 2099 - DNA, 20 bp, human
gcaatacagccagctgtgag

SEQ ID NO: 2100 - DNA, 20 bp, human
ggagggcagagagtcccatt

SEQ ID NO: 2101 - DNA, 20 bp, human
gatcgtgcgtcagctgctga

SEQ ID NO: 2102 - DNA, 20 bp, human
gatgaaggagacccacattc

SEQ ID NO: 2103 - DNA, 20 bp, human
gtcccatttggcagacagag

SEQ ID NO: 2104 - DNA, 20 bp, human
gtctgtgagatagtagggag

SEQ ID NO: 2105 - DNA, 20 bp, human
gggagacccacattctggct

SEQ ID NO: 2106 - DNA, 20 bp, human
gcggctcaagggggagggcg

SEQ ID NO: 2107 - DNA, 20 bp, human
gatttttagcccccgccctc

SEQ ID NO: 2108 - DNA, 20 bp, human
gggcggcgcggctactgctg

SEQ ID NO: 2109 - DNA, 20 bp, human
ggtctgcggagggagatata

SEQ ID NO: 2110 - DNA, 20 bp, human
gggctaaaaatacccggcag

SEQ ID NO: 2111 - DNA, 20 bp, human
gcagggcctaatctgatccg

SEQ ID NO: 2112 - DNA, 20 bp, human
ggaagggggacgcaagaact

SEQ ID NO: 2113 - DNA, 20 bp, human
gggcgggggctaaaaatacc

SEQ ID NO: 2114 - DNA, 20 bp, human
gtgatggcaaggaccatccg

SEQ ID NO: 2115 - DNA, 20 bp, human
gcggagcccgcgagaactgg

SEQ ID NO: 2116 - DNA, 20 bp, human
gtgtgtccatgggtaagaca

SEQ ID NO: 2117 - DNA, 20 bp, human
ggctcccaggagggacaagt

SEQ ID NO: 2118 - DNA, 20 bp, human
gttctgcaggcgacgggcat

SEQ ID NO: 2119 - DNA, 20 bp, human
gccaggagggacaagtgggg

SEQ ID NO: 2120 - DNA, 20 bp, human
gtaaggccctggcatcaggg

SEQ ID NO: 2121 - DNA, 20 bp, human
gtccctggaacaatgctccc

SEQ ID NO: 2122 - DNA, 20 bp, human
ggcctgccctgtcttaccca

SEQ ID NO: 2123 - DNA, 20 bp, human
gaggtaccataggggtcaga

SEQ ID NO: 2124 - DNA, 20 bp, human
gaaggcccggtcagtcaggt

SEQ ID NO: 2125 - DNA, 20 bp, human
gtgtcctcagaaggtaccat

SEQ ID NO: 2126 - DNA, 20 bp, human
gtagccctggaagacagcca

SEQ ID NO: 2127 - DNA, 20 bp, human
gatgccctggctgtcttcca

SEQ ID NO: 2128 - DNA, 20 bp, human
ggccatccatcactaaaaga

SEQ ID NO: 2129 - DNA, 20 bp, human
gggctgaccaatggcactat

SEQ ID NO: 2130 - DNA, 20 bp, human
gagggagggtgtctcaggtc

SEQ ID NO: 2131 - DNA, 20 bp, human
ggccctcttttagtgatgga

SEQ ID NO: 2132 - DNA, 20 bp, human
gtttgtctccgtagttgcca

SEQ ID NO: 2133 - DNA, 20 bp, human
gaatggcactataggtaaat

SEQ ID NO: 2134 - DNA, 20 bp, human
gttaaggtagtgactagccc

SEQ ID NO: 2135 - DNA, 20 bp, human
ggagaaaccagctgcgctgg

SEQ ID NO: 2136 - DNA, 20 bp, human
gagagaaggatgaatctcag

SEQ ID NO: 2137 - DNA, 20 bp, human
gcagcaacagggagagacga

SEQ ID NO: 2138 - DNA, 20 bp, human
gagtcttaggaggaaacact

SEQ ID NO: 2139 - DNA, 20 bp, human
gagctgctggctggagagga

SEQ ID NO: 2140 - DNA, 20 bp, human
ggttactgtgctctcttcca

SEQ ID NO: 2141 - DNA, 20 bp, human
gaaacactgggcagaggaaa

SEQ ID NO: 2142 - DNA, 20 bp, human
gggaaaaaggtggtaacagg

SEQ ID NO: 2143 - DNA, 20 bp, human
gtccagaactcctacagcct

SEQ ID NO: 2144 - DNA, 20 bp, human
gcagggggctggtagttggg

SEQ ID NO: 2145 - DNA, 20 bp, human
ggacgagggcagctggaaaa

SEQ ID NO: 2146 - DNA, 20 bp, human
gagagaaggatgaatcccag

SEQ ID NO: 2147 - DNA, 20 bp, human
ggaaggatgaatcccagagg

SEQ ID NO: 2148 - DNA, 20 bp, human
gcagcaacagggagagacga

SEQ ID NO: 2149 - DNA, 20 bp, human
gagctgctggctggagagga

SEQ ID NO: 2150 - DNA, 20 bp, human
gagtcttaggaggaaacact

SEQ ID NO: 2151 - DNA, 20 bp, human
ggttactgtgctctcttcca

SEQ ID NO: 2152 - DNA, 20 bp, human
gaaacactgggcagaggaaa

SEQ ID NO: 2153 - DNA, 20 bp, human
gggaaaaaggtggtaacagg

SEQ ID NO: 2154 - DNA, 20 bp, human
gtccagaactcctacagcct

SEQ ID NO: 2155 - DNA, 20 bp, human
gttctggtctcacctcctct

SEQ ID NO: 2156 - DNA, 20 bp, human
gcgtggcagtctaaagaaga

SEQ ID NO: 2157 - DNA, 20 bp, human
gccaacacagatggagatta

SEQ ID NO: 2158 - DNA, 20 bp, human
gaagcagatgtgagaactca

SEQ ID NO: 2159 - DNA, 20 bp, human
ggagcagtctgacaatccgg

SEQ ID NO: 2160 - DNA, 20 bp, human
gttaattgaaccagatgcgg

SEQ ID NO: 2161 - DNA, 20 bp, human
gcacatctgctttttcctcg

SEQ ID NO: 2162 - DNA, 20 bp, human
ggaggagcagtctgacaatc

SEQ ID NO: 2163 - DNA, 20 bp, human
gcaatccggaggagcaagac

SEQ ID NO: 2164 - DNA, 20 bp, human
gtaacagattccaacacaga

SEQ ID NO: 2165 - DNA, 20 bp, human
gaggagtatgcacacacaaa

SEQ ID NO: 2166 - DNA, 20 bp, human
gtctgtgaggaacgaccatg

SEQ ID NO: 2167 - DNA, 20 bp, human
ggaggaacgaccatggggat

SEQ ID NO: 2168 - DNA, 20 bp, human
gtggaagactgagagataag

SEQ ID NO: 2169 - DNA, 20 bp, human
gggggacaccaagcatctac

SEQ ID NO: 2170 - DNA, 20 bp, human
gccagatgaatctaaatgtc

SEQ ID NO: 2171 - DNA, 20 bp, human
gggagaaggtatatgacgat

SEQ ID NO: 2172 - DNA, 20 bp, human
gaaatcttcatggttcccaa

SEQ ID NO: 2173 - DNA, 20 bp, human
gagaagtactacagcctgta

SEQ ID NO: 2174 - DNA, 20 bp, human
gtcagccacaaatggctggg

SEQ ID NO: 2175 - DNA, 20 bp, human
ggcagtagacaaagtccttt

SEQ ID NO: 2176 - DNA, 20 bp, human
gaggtggctgaggaatccag

SEQ ID NO: 2177 - DNA, 20 bp, human
gggagaggtgggtcagagaa

SEQ ID NO: 2178 - DNA, 20 bp, human
gggcctggtggccactgcag

SEQ ID NO: 2179 - DNA, 20 bp, human
gtggggctgaagttccctgt

SEQ ID NO: 2180 - DNA, 20 bp, human
gagactgaggaaaaggactg

SEQ ID NO: 2181 - DNA, 20 bp, human
gtcacttcctggaaaaacat

SEQ ID NO: 2182 - DNA, 20 bp, human
gcagaaaacagcctcccaca

SEQ ID NO: 2183 - DNA, 20 bp, human
ggcagagctcagttcaggag

SEQ ID NO: 2184 - DNA, 20 bp, human
gccccaaatgcagccaagag

SEQ ID NO: 2185 - DNA, 20 bp, human
ggggtgggagactgaggaaa

SEQ ID NO: 2186 - DNA, 20 bp, human
gggcgtgaggcacccactct

SEQ ID NO: 2187 - DNA, 20 bp, human
gactcggagcctctcgccag

SEQ ID NO: 2188 - DNA, 20 bp, human
gctcaggtagcctgcctaga

SEQ ID NO: 2189 - DNA, 20 bp, human
gagaggctccgagtcccctc

SEQ ID NO: 2190 - DNA, 20 bp, human
gcccctcgggacccaagagt

SEQ ID NO: 2191 - DNA, 20 bp, human
gcagcctgcgagggctctcg

SEQ ID NO: 2192 - DNA, 20 bp, human
ggatccgcgctgcccgggga

SEQ ID NO: 2193 - DNA, 20 bp, human
gcaggacgcccccaactctt

SEQ ID NO: 2194 - DNA, 20 bp, human
gtgcgcgccgccatctaggc

SEQ ID NO: 2195 - DNA, 20 bp, human
gcccaactcttgggtcccga

SEQ ID NO: 2196 - DNA, 20 bp, human
ggcacccgccgcgaccgcaa

SEQ ID NO: 2197 - DNA, 20 bp, human
ggaggagacgagggttccat

SEQ ID NO: 2198 - DNA, 20 bp, human
gcccgccgcgaccgcaaagg

SEQ ID NO: 2199 - DNA, 20 bp, human
gctaggaacttgacgtgatg

SEQ ID NO: 2200 - DNA, 20 bp, human
gcgctccggacccgctcctc

SEQ ID NO: 2201 - DNA, 20 bp, human
gagttccctgcagacttgga

SEQ ID NO: 2202 - DNA, 20 bp, human
ggcttcctgaggagcgggtc

SEQ ID NO: 2203 - DNA, 20 bp, human
ggagacgcgggattccgtga

SEQ ID NO: 2204 - DNA, 20 bp, human
gctgcaccggcgctccgtgg

SEQ ID NO: 2205 - DNA, 20 bp, human
gtgcagacttggagggtccg

SEQ ID NO: 2206 - DNA, 20 bp, human
gggaggagatgaaaccgtct

SEQ ID NO: 2207 - DNA, 20 bp, human
gtcgcacactcggggaccgc

SEQ ID NO: 2208 - DNA, 20 bp, human
ggatgcagggcactgtcctc

SEQ ID NO: 2209 - DNA, 20 bp, human
gccggagaggacccaggcaa

SEQ ID NO: 2210 - DNA, 20 bp, human
ggggcactgtcctccggcag

SEQ ID NO: 2211 - DNA, 20 bp, human
gtacgacactgcagccaaga

SEQ ID NO: 2212 - DNA, 20 bp, human
gtaccagggatgggggatca

SEQ ID NO: 2213 - DNA, 20 bp, human
gcacactcggggaccgcggg

SEQ ID NO: 2214 - DNA, 20 bp, human
gggcgcccaaaaagttacca

SEQ ID NO: 2215 - DNA, 20 bp, human
gctctcggggtcggtcaccg

SEQ ID NO: 2216 - DNA, 20 bp, human
ggtagctacccgcccaggta

SEQ ID NO: 2217 - DNA, 20 bp, human
gcacttggcgctgtccgctg

SEQ ID NO: 2218 - DNA, 20 bp, human
ggcgtgtggctccggagacg

SEQ ID NO: 2219 - DNA, 20 bp, human
gggggaagcgaggcttcact

SEQ ID NO: 2220 - DNA, 20 bp, human
gcccaactcctgccctacct

SEQ ID NO: 2221 - DNA, 20 bp, human
ggggaacctgaaggactccg

SEQ ID NO: 2222 - DNA, 20 bp, human
ggctcgggccctggtcgccg

SEQ ID NO: 2223 - DNA, 20 bp, human
gaagcctcgcttcccctccg

SEQ ID NO: 2224 - DNA, 20 bp, human
ggggacagggcactaccgag

SEQ ID NO: 2225 - DNA, 20 bp, human
gtagctacaactgctactct

SEQ ID NO: 2226 - DNA, 20 bp, human
ggccggctccctctgcggag

SEQ ID NO: 2227 - DNA, 20 bp, human
gcagcctgacctggtgtcgg

SEQ ID NO: 2228 - DNA, 20 bp, human
gacgcctccggcaggaccac

SEQ ID NO: 2229 - DNA, 20 bp, human
ggacgggaacacggccctag

SEQ ID NO: 2230 - DNA, 20 bp, human
ggtcctgccggaggcgtaga

SEQ ID NO: 2231 - DNA, 20 bp, human
ggggcagcctgacctggtgt

SEQ ID NO: 2232 - DNA, 20 bp, human
ggtgggccgcccccgacacc

SEQ ID NO: 2233 - DNA, 20 bp, human
gcaggctgcccctccgcaga

SEQ ID NO: 2234 - DNA, 20 bp, human
ggccggggatgacgccccta

SEQ ID NO: 2235 - DNA, 20 bp, human
gcactcaccggtggtcctgc

SEQ ID NO: 2236 - DNA, 20 bp, human
gcaagcactgtcagggtaag

SEQ ID NO: 2237 - DNA, 20 bp, human
gaccctgacagtgcttggct

SEQ ID NO: 2238 - DNA, 20 bp, human
gtgtgacttatagattccag

SEQ ID NO: 2239 - DNA, 20 bp, human
ggggtaattaaaagagccac

SEQ ID NO: 2240 - DNA, 20 bp, human
gtagtttggtatgatggaag

SEQ ID NO: 2241 - DNA, 20 bp, human
gaatctataagtcacatcct

SEQ ID NO: 2242 - DNA, 20 bp, human
ggtattgtgctgcaagatct

SEQ ID NO: 2243 - DNA, 20 bp, human
gttggtgcagcttaggtgtc

SEQ ID NO: 2244 - DNA, 20 bp, human
gtggttctgatttgttgtag

SEQ ID NO: 2245 - DNA, 20 bp, human
gacagggctaatatgtagtt

SEQ ID NO: 2246 - DNA, 20 bp, human
gcctttggcttggcttgtca

SEQ ID NO: 2247 - DNA, 20 bp, human
gtatccccgggactaagacg

SEQ ID NO: 2248 - DNA, 20 bp, human
gacggggtaagcctccaccc

SEQ ID NO: 2249 - DNA, 20 bp, human
gggggaccccggttggagag

SEQ ID NO: 2250 - DNA, 20 bp, human
ggagagaggagcggaactcc

SEQ ID NO: 2251 - DNA, 20 bp, human
gggcttgtcagggcttgtcc

SEQ ID NO: 2252 - DNA, 20 bp, human
gccgcgccggagcggacctt

SEQ ID NO: 2253 - DNA, 20 bp, human
gatctggaccctcctacctc

SEQ ID NO: 2254 - DNA, 20 bp, human
gcaccaacccgcgggagaag

SEQ ID NO: 2255 - DNA, 20 bp, human
gagggctcaccagaggtagg

SEQ ID NO: 2256 - DNA, 20 bp, human
gacgggcggcggatcggcaa

SEQ ID NO: 2257 - DNA, 20 bp, human
gaagcccggccagccgaccg

SEQ ID NO: 2258 - DNA, 20 bp, human
ggcgtgcgcgctgggactca

SEQ ID NO: 2259 - DNA, 20 bp, human
gcccatctccggaggcccag

SEQ ID NO: 2260 - DNA, 20 bp, human
gcggccaccagaagaggtag

SEQ ID NO: 2261 - DNA, 20 bp, human
ggcacgcagttagcgcccaa

SEQ ID NO: 2262 - DNA, 20 bp, human
gggtagcgggccactcacct

SEQ ID NO: 2263 - DNA, 20 bp, human
ggtgtggacgggcggcggat

SEQ ID NO: 2264 - DNA, 20 bp, human
gccaatggggatcgcagggt

SEQ ID NO: 2265 - DNA, 20 bp, human
gcccgctgcggcccagacgg

SEQ ID NO: 2266 - DNA, 20 bp, human
ggaggctgcaccgggaccac

SEQ ID NO: 2267 - DNA, 20 bp, human
ggactgctacgtgggagatg

SEQ ID NO: 2268 - DNA, 20 bp, human
ggttcaggggtgcctcggtg

SEQ ID NO: 2269 - DNA, 20 bp, human
gggacgatatggaaaagatc

SEQ ID NO: 2270 - DNA, 20 bp, human
gcatcccatcctcctcaccg

SEQ ID NO: 2271 - DNA, 20 bp, human
gtgtcgaggacgccctatca

SEQ ID NO: 2272 - DNA, 20 bp, human
gaaatgctttcagacacggg

SEQ ID NO: 2273 - DNA, 20 bp, human
gtagggcgtcctcgacacca

SEQ ID NO: 2274 - DNA, 20 bp, human
ggagctcattgtagaatgtg

SEQ ID NO: 2275 - DNA, 20 bp, human
gaggacgccctatcatggag

SEQ ID NO: 2276 - DNA, 20 bp, human
gccgggcgctgactcaccgt

SEQ ID NO: 2277 - DNA, 20 bp, human
gaccaggcgaggagtgaacg

SEQ ID NO: 2278 - DNA, 20 bp, human
ggaagccgcggaggagactg

SEQ ID NO: 2279 - DNA, 20 bp, human
gtcctcgcaggacctcgcag

SEQ ID NO: 2280 - DNA, 20 bp, human
gtagggtgccaggtgcaagg

SEQ ID NO: 2281 - DNA, 20 bp, human
gagccgacccgccccgccga

SEQ ID NO: 2282 - DNA, 20 bp, human
gaggcgaggagtgaacgcgg

SEQ ID NO: 2283 - DNA, 20 bp, human
gtggccttctccgcacccag

SEQ ID NO: 2284 - DNA, 20 bp, human
gggcgctgactcaccgtcgg

SEQ ID NO: 2285 - DNA, 20 bp, human
gtgactcaccgtcggcgggg

SEQ ID NO: 2286 - DNA, 20 bp, human
gcaccggcagagaaacgcga

SEQ ID NO: 2287 - DNA, 20 bp, human
gagagtgcgagagctggcag

SEQ ID NO: 2288 - DNA, 20 bp, human
ggagaaacgcgacggcggag

SEQ ID NO: 2289 - DNA, 20 bp, human
gcggcagagaaacgcgacgg

SEQ ID NO: 2290 - DNA, 20 bp, human
gacgtccagctcaggccccg

SEQ ID NO: 2291 - DNA, 20 bp, human
gaaacgcgacggcggagcgg

SEQ ID NO: 2292 - DNA, 20 bp, human
gcggcgactgagaccgaccg

SEQ ID NO: 2293 - DNA, 20 bp, human
gcgacctgcccggaaaagga

SEQ ID NO: 2294 - DNA, 20 bp, human
gcccggaaaaggatggactc

SEQ ID NO: 2295 - DNA, 20 bp, human
gaagaacagagtgcgagagc

SEQ ID NO: 2296 - DNA, 20 bp, human
gggcagccccggaaaggaag

SEQ ID NO: 2297 - DNA, 20 bp, human
gaccctcggtaagtactgta

SEQ ID NO: 2298 - DNA, 20 bp, human
ggccgtacagtacttaccga

SEQ ID NO: 2299 - DNA, 20 bp, human
gtacttaccgagggtatgag

SEQ ID NO: 2300 - DNA, 20 bp, human
gctggccatgggacatcctg

SEQ ID NO: 2301 - DNA, 20 bp, human
gcccaagacaaaggacatca

SEQ ID NO: 2302 - DNA, 20 bp, human
ggaagaacctctcataccct

SEQ ID NO: 2303 - DNA, 20 bp, human
gcccgccagtccccattctg

SEQ ID NO: 2304 - DNA, 20 bp, human
gaggtgccgctgcccaccaa

SEQ ID NO: 2305 - DNA, 20 bp, human
gcttgagtcaaagccaacag

SEQ ID NO: 2306 - DNA, 20 bp, human
ggtgtgtgcacgccaggtgt

SEQ ID NO: 2307 - DNA, 20 bp, human
ggtgcagcgcttactcctag

SEQ ID NO: 2308 - DNA, 20 bp, human
gttgtcacacacgagcgcgg

SEQ ID NO: 2309 - DNA, 20 bp, human
gacacacaccatgtgtgaag

SEQ ID NO: 2310 - DNA, 20 bp, human
gaggagtaagcgctgcactg

SEQ ID NO: 2311 - DNA, 20 bp, human
ggccaaaaccaacatacatc

SEQ ID NO: 2312 - DNA, 20 bp, human
gtggcgagggcggcccacaa

SEQ ID NO: 2313 - DNA, 20 bp, human
gggctgagtgagctggggac

SEQ ID NO: 2314 - DNA, 20 bp, human
ggtggtctcctcttcacaca

SEQ ID NO: 2315 - DNA, 20 bp, human
gtgtctggcttacatttggg

SEQ ID NO: 2316 - DNA, 20 bp, human
gcctcccggcctctgtccta

SEQ ID NO: 2317 - DNA, 20 bp, human
gggactactccctaggacag

SEQ ID NO: 2318 - DNA, 20 bp, human
gggaagaacttaggctccgg

SEQ ID NO: 2319 - DNA, 20 bp, human
gggcagagccaaaggctgaa

SEQ ID NO: 2320 - DNA, 20 bp, human
gacagaggccgggaggtatc

SEQ ID NO: 2321 - DNA, 20 bp, human
gggactgggaggcgctggaa

SEQ ID NO: 2322 - DNA, 20 bp, human
gctgaaggggactactccct

SEQ ID NO: 2323 - DNA, 20 bp, human
gtcgcggtggtggtggacca

SEQ ID NO: 2324 - DNA, 20 bp, human
gtcgtcggcccgatacctcc

SEQ ID NO: 2325 - DNA, 20 bp, human
gcagggctcgggcttcacca

SEQ ID NO: 2326 - DNA, 20 bp, human
ggccagttagcccttagggt

SEQ ID NO: 2327 - DNA, 20 bp, human
gcggcgcgactcctacccta

SEQ ID NO: 2328 - DNA, 20 bp, human
gcccacctcaggcaacaaag

SEQ ID NO: 2329 - DNA, 20 bp, human
ggggtggcggtggaagttaa

SEQ ID NO: 2330 - DNA, 20 bp, human
gttccaccgccacccacctc

SEQ ID NO: 2331 - DNA, 20 bp, human
ggtgcgcgctcggttctcta

SEQ ID NO: 2332 - DNA, 20 bp, human
gctcctcgggctccctgaag

SEQ ID NO: 2333 - DNA, 20 bp, human
gagaccggaagggaacgccg

SEQ ID NO: 2334 - DNA, 20 bp, human
gtaggaggagccagcaagtg

SEQ ID NO: 2335 - DNA, 20 bp, human
gaagcggcgtccacacaccc

SEQ ID NO: 2336 - DNA, 20 bp, human
ggcgcagcgggcactatgag

SEQ ID NO: 2337 - DNA, 20 bp, human
gcagcgggcactatgagcgg

SEQ ID NO: 2338 - DNA, 20 bp, human
gtgcgctgctagcggcccgt

SEQ ID NO: 2339 - DNA, 20 bp, human
ggctgctagcggcccgtggg

SEQ ID NO: 2340 - DNA, 20 bp, human
gtgatcccgccaccgcccac

SEQ ID NO: 2341 - DNA, 20 bp, human
gctatgagcgggggcgtcta

SEQ ID NO: 2342 - DNA, 20 bp, human
gggtggcgggatcagcaccg

SEQ ID NO: 2343 - DNA, 20 bp, human
ggtgcccgctgcgctgctag

SEQ ID NO: 2344 - DNA, 20 bp, human
gggcgggatcagcaccgagg

SEQ ID NO: 2345 - DNA, 20 bp, human
ggctcccaccggccccagac

SEQ ID NO: 2346 - DNA, 20 bp, human
ggcggctcttgacaacatgt

SEQ ID NO: 2347 - DNA, 20 bp, human
gtcgcaaggagacattcgtg

SEQ ID NO: 2348 - DNA, 20 bp, human
gatgggcccaccaagaaggt

SEQ ID NO: 2349 - DNA, 20 bp, human
gttcaggccttgaatccagt

SEQ ID NO: 2350 - DNA, 20 bp, human
gcctgaaaggcctacatcag

SEQ ID NO: 2351 - DNA, 20 bp, human
gtggttaaccctctgcgaca

SEQ ID NO: 2352 - DNA, 20 bp, human
gctgcgacatggcatcatcg

SEQ ID NO: 2353 - DNA, 20 bp, human
gatggagaccgccaagactg

SEQ ID NO: 2354 - DNA, 20 bp, human
ggccgggccatcccttaaag

SEQ ID NO: 2355 - DNA, 20 bp, human
gtcttggcggtctccatgta

SEQ ID NO: 2356 - DNA, 20 bp, human
gcaccctgagccgtgcccag

SEQ ID NO: 2357 - DNA, 20 bp, human
ggactgcgtgcaggacatct

SEQ ID NO: 2358 - DNA, 20 bp, human
gagggaggcagatggcgaca

SEQ ID NO: 2359 - DNA, 20 bp, human
gcacagcctagagccccctg

SEQ ID NO: 2360 - DNA, 20 bp, human
gtggtgaacccgctgaagca

SEQ ID NO: 2361 - DNA, 20 bp, human
gcatgagctgctcaacacgg

SEQ ID NO: 2362 - DNA, 20 bp, human
gcacagcgtgctcctcgggg

SEQ ID NO: 2363 - DNA, 20 bp, human
gtcggggaggatcttcatgg

SEQ ID NO: 2364 - DNA, 20 bp, human
gaggcggtcatcatcgacct

SEQ ID NO: 2365 - DNA, 20 bp, human
gctgaagcacggcatcgtgg

SEQ ID NO: 2366 - DNA, 20 bp, human
gtgccacgtgctcacagagt

SEQ ID NO: 2367 - DNA, 20 bp, human
ggcacgagagcggctgcacg

SEQ ID NO: 2368 - DNA, 20 bp, human
ggtgctcacagagtaggctg

SEQ ID NO: 2369 - DNA, 20 bp, human
gtgcagtgtgcagctgagtt

SEQ ID NO: 2370 - DNA, 20 bp, human
ggcaaacgcctgcacgagag

SEQ ID NO: 2371 - DNA, 20 bp, human
gccaggcggtgcccccacaa

SEQ ID NO: 2372 - DNA, 20 bp, human
gaggctctacctcagaccaa

SEQ ID NO: 2373 - DNA, 20 bp, human
gggaggagactcttccatag

SEQ ID NO: 2374 - DNA, 20 bp, human
ggaaagagcccctcacccca

SEQ ID NO: 2375 - DNA, 20 bp, human
gggctgaggtacagccgcta

SEQ ID NO: 2376 - DNA, 20 bp, human
ggttgcgggacgccaggtga

SEQ ID NO: 2377 - DNA, 20 bp, human
ggtcgtgggtggccactcgg

SEQ ID NO: 2378 - DNA, 20 bp, human
ggtgctcccagagctgacgc

SEQ ID NO: 2379 - DNA, 20 bp, human
gccgggctgcagacgttcat

SEQ ID NO: 2380 - DNA, 20 bp, human
ggcgtggtggttattgacat

SEQ ID NO: 2381 - DNA, 20 bp, human
gcgacgatgccgctgcgcag

SEQ ID NO: 2382 - DNA, 20 bp, human
gacaggctgccaccaaagac

SEQ ID NO: 2383 - DNA, 20 bp, human
gatgggcacaggcacctgta

SEQ ID NO: 2384 - DNA, 20 bp, human
gcaagaaacccgccacctcg

SEQ ID NO: 2385 - DNA, 20 bp, human
gctgcagacgttcatcggcg

SEQ ID NO: 2386 - DNA, 20 bp, human
gctgctactggcggcgacag

SEQ ID NO: 2387 - DNA, 20 bp, human
gtgctggcgaaggctgctac

SEQ ID NO: 2388 - DNA, 20 bp, human
gcggcaggcagagcgggtcg

SEQ ID NO: 2389 - DNA, 20 bp, human
gtcggctccgggctctgaac

SEQ ID NO: 2390 - DNA, 20 bp, human
gccacgcacactgaactagg

SEQ ID NO: 2391 - DNA, 20 bp, human
ggtgcggccgttgcgaggtg

SEQ ID NO: 2392 - DNA, 20 bp, human
ggtgcgcgcgtgctagggtc

SEQ ID NO: 2393 - DNA, 20 bp, human
gtccgggcgcgcacgggagg

SEQ ID NO: 2394 - DNA, 20 bp, human
gtcccgtgcgcgcccggaac

SEQ ID NO: 2395 - DNA, 20 bp, human
gctactccctccccacgcca

SEQ ID NO: 2396 - DNA, 20 bp, human
gcttcgcgcggctcctctcg

SEQ ID NO: 2397 - DNA, 20 bp, human
gccaggcgtgtcgccccgag

SEQ ID NO: 2398 - DNA, 20 bp, human
gtcgggcgaagcaccagctc

SEQ ID NO: 2399 - DNA, 20 bp, human
gtgactggcaaacggaccca

SEQ ID NO: 2400 - DNA, 20 bp, human
ggcgagagggcgctttgtgg

SEQ ID NO: 2401 - DNA, 20 bp, human
gctggcaaacggacccacgg

SEQ ID NO: 2402 - DNA, 20 bp, human
gtaggaaagaggacacgtcc

SEQ ID NO: 2403 - DNA, 20 bp, human
ggcaaacggacccacggagg

SEQ ID NO: 2404 - DNA, 20 bp, human
gtgtgccctcgcagccccgg

SEQ ID NO: 2405 - DNA, 20 bp, human
ggagtacatgatccaggagg

SEQ ID NO: 2406 - DNA, 20 bp, human
gtgggaggagcctccagggt

SEQ ID NO: 2407 - DNA, 20 bp, human
gatgcagcccgagggtctgg

SEQ ID NO: 2408 - DNA, 20 bp, human
gggaggcgctcggaatcccg

SEQ ID NO: 2409 - DNA, 20 bp, human
gggggctccgacgggatggg

SEQ ID NO: 2410 - DNA, 20 bp, human
gggctctgagccagctggat

SEQ ID NO: 2411 - DNA, 20 bp, human
ggccaacggaccagcagtgg

SEQ ID NO: 2412 - DNA, 20 bp, human
ggggcatctcagcagtgcag

SEQ ID NO: 2413 - DNA, 20 bp, human
gtggagcccggataacgccg

SEQ ID NO: 2414 - DNA, 20 bp, human
ggggcgggtcaatcactccg

SEQ ID NO: 2415 - DNA, 20 bp, human
gggcagggctattaatatcg

SEQ ID NO: 2416 - DNA, 20 bp, human
ggaatcgccgagctagagga

SEQ ID NO: 2417 - DNA, 20 bp, human
gagctgaggcgggagcggac

SEQ ID NO: 2418 - DNA, 20 bp, human
gcgggctgaagcagctgaag

SEQ ID NO: 2419 - DNA, 20 bp, human
gggaggaatcgccgagctag

SEQ ID NO: 2420 - DNA, 20 bp, human
ggaattggcgggtccgggaa

SEQ ID NO: 2421 - DNA, 20 bp, human
ggaagggaattggagtcctg

SEQ ID NO: 2422 - DNA, 20 bp, human
gaggctggtgggcgagcgag

SEQ ID NO: 2423 - DNA, 20 bp, human
gggtcccgagaaggaattgg

SEQ ID NO: 2424 - DNA, 20 bp, human
gagctcggcgattcctcctc

SEQ ID NO: 2425 - DNA, 20 bp, human
ggtctgtgatgggaacgggg

SEQ ID NO: 2426 - DNA, 20 bp, human
gaagagggtcgcagtctccg

SEQ ID NO: 2427 - DNA, 20 bp, human
ggtagagcggcatggtagta

SEQ ID NO: 2428 - DNA, 20 bp, human
gtccccaggccctcgtagag

SEQ ID NO: 2429 - DNA, 20 bp, human
gctccgcggccaacaagtct

SEQ ID NO: 2430 - DNA, 20 bp, human
ggagtcggcgatgaggaccc

SEQ ID NO: 2431 - DNA, 20 bp, human
gcgcgagcgccgagacttgt

SEQ ID NO: 2432 - DNA, 20 bp, human
gttggggtgatgacaagggg

SEQ ID NO: 2433 - DNA, 20 bp, human
ggtaagcggggtctaggtca

SEQ ID NO: 2434 - DNA, 20 bp, human
gcctacacagatgatcccaa

SEQ ID NO: 2435 - DNA, 20 bp, human
gaggccctcgtagagcggca

SEQ ID NO: 2436 - DNA, 20 bp, human
gtgcgtgtcagtggcgctag

SEQ ID NO: 2437 - DNA, 20 bp, human
gcgacgggaatctcacacag

SEQ ID NO: 2438 - DNA, 20 bp, human
gatagagcgatcggaaatgg

SEQ ID NO: 2439 - DNA, 20 bp, human
ggactgcgcatgcgtgtcag

SEQ ID NO: 2440 - DNA, 20 bp, human
gatccggcaaggctaagagg

SEQ ID NO: 2441 - DNA, 20 bp, human
ggtgtcagtggcgctagcgg

SEQ ID NO: 2442 - DNA, 20 bp, human
gggctaagaggcggtatcat

SEQ ID NO: 2443 - DNA, 20 bp, human
gtggttggcgatcacatcgt

SEQ ID NO: 2444 - DNA, 20 bp, human
ggcagaggcctagcctcatc

SEQ ID NO: 2445 - DNA, 20 bp, human
gcctcgccgccctgaaccgg

SEQ ID NO: 2446 - DNA, 20 bp, human
ggctgcaggaggcaccggat

SEQ ID NO: 2447 - DNA, 20 bp, human
gacggcggcggctcccgacg

SEQ ID NO: 2448 - DNA, 20 bp, human
ggtaggctgcaggctcgggg

SEQ ID NO: 2449 - DNA, 20 bp, human
ggagccagggccgaaggacg

SEQ ID NO: 2450 - DNA, 20 bp, human
gagggcagcggcgccgcgtc

SEQ ID NO: 2451 - DNA, 20 bp, human
gtcgcgtaggctgcaggctc

SEQ ID NO: 2452 - DNA, 20 bp, human
ggaacttccccgcccgactc

SEQ ID NO: 2453 - DNA, 20 bp, human
ggcgacggccacgcagtgag

SEQ ID NO: 2454 - DNA, 20 bp, human
ggcaggaggcaccggatggg

SEQ ID NO: 2455 - DNA, 20 bp, human
ggcgccctcttggccttgta

SEQ ID NO: 2456 - DNA, 20 bp, human
gggggccgggaagacgcaag

SEQ ID NO: 2457 - DNA, 20 bp, human
gtccctgccgggcggtcagt

SEQ ID NO: 2458 - DNA, 20 bp, human
gaaaagttgggccgaaggag

SEQ ID NO: 2459 - DNA, 20 bp, human
ggcgagaccggcactggaca

SEQ ID NO: 2460 - DNA, 20 bp, human
gcccacccggaagggtgagg

SEQ ID NO: 2461 - DNA, 20 bp, human
gctgctccgcgctaatgcgg

SEQ ID NO: 2462 - DNA, 20 bp, human
ggggtggcaggctaaatggg

SEQ ID NO: 2463 - DNA, 20 bp, human
gcttcgccccgagggcccgg

SEQ ID NO: 2464 - DNA, 20 bp, human
ggcaattgggctaaagcgga

SEQ ID NO: 2465 - DNA, 20 bp, human
gtgggggcggcgggcgagac

SEQ ID NO: 2466 - DNA, 20 bp, human
gagacccgccggccagcgag

SEQ ID NO: 2467 - DNA, 20 bp, human
ggattggcggcgggagacaa

SEQ ID NO: 2468 - DNA, 20 bp, human
gtcccaggagggagaaacga

SEQ ID NO: 2469 - DNA, 20 bp, human
ggaggaggccgggaaatgaa

SEQ ID NO: 2470 - DNA, 20 bp, human
gggccgggaaatgaatggtg

SEQ ID NO: 2471 - DNA, 20 bp, human
gtaggactgacagccggcgg

SEQ ID NO: 2472 - DNA, 20 bp, human
gagaaagccgctgggagggt

SEQ ID NO: 2473 - DNA, 20 bp, human
gaccccccggacggtgaagg

SEQ ID NO: 2474 - DNA, 20 bp, human
gagaaagcagcaggctcggt

SEQ ID NO: 2475 - DNA, 20 bp, human
ggtctaggactgacagccgg

SEQ ID NO: 2476 - DNA, 20 bp, human
gcgccgggctcgctcagagt

SEQ ID NO: 2477 - DNA, 20 bp, human
gtccaggggcccggccacgt

SEQ ID NO: 2478 - DNA, 20 bp, human
gagccgggctgcgggtccag

SEQ ID NO: 2479 - DNA, 20 bp, human
ggcgctcccggtgtccctca

SEQ ID NO: 2480 - DNA, 20 bp, human
gtccctcagggtgtccaccc

SEQ ID NO: 2481 - DNA, 20 bp, human
gggcggagcggacggcgacg

SEQ ID NO: 2482 - DNA, 20 bp, human
gaggaaaagcacggagggta

SEQ ID NO: 2483 - DNA, 20 bp, human
gacggcgacggggcgctctc

SEQ ID NO: 2484 - DNA, 20 bp, human
gcacaagaggaaaagcacgg

SEQ ID NO: 2485 - DNA, 20 bp, human
gcaggcgaggtggacgccag

SEQ ID NO: 2486 - DNA, 20 bp, human
gggtgcggccggaagcgaag

SEQ ID NO: 2487 - DNA, 20 bp, human
gtgcctgagtgcgcaggcgt

SEQ ID NO: 2488 - DNA, 20 bp, human
ggaatccagagcgcccacta

SEQ ID NO: 2489 - DNA, 20 bp, human
gcgagtccgggaggaaatct

SEQ ID NO: 2490 - DNA, 20 bp, human
gcagtccccgcttacctgag

SEQ ID NO: 2491 - DNA, 20 bp, human
ggacttcccagcttggccag

SEQ ID NO: 2492 - DNA, 20 bp, human
gcgccgaggttcagggaagg

SEQ ID NO: 2493 - DNA, 20 bp, human
gctgcgcactcaggcaccgc

SEQ ID NO: 2494 - DNA, 20 bp, human
gctcaggcaccgcaggtagg

SEQ ID NO: 2495 - DNA, 20 bp, human
ggcttggccagtggctccgc

SEQ ID NO: 2496 - DNA, 20 bp, human
gactgggtccggtgcggcac

SEQ ID NO: 2497 - DNA, 20 bp, human
gggcacgggcgtcgcggaac

SEQ ID NO: 2498 - DNA, 20 bp, human
ggacgcgcgctccaagatgg

SEQ ID NO: 2499 - DNA, 20 bp, human
gtccagcactgggtccggtg

SEQ ID NO: 2500 - DNA, 20 bp, human
gctggacgcgcgctccaaga

SEQ ID NO: 2501 - DNA, 20 bp, human
gcacaggtgaagggcggagt

SEQ ID NO: 2502 - DNA, 20 bp, human
gcacctgggtgtctcctcac

SEQ ID NO: 2503 - DNA, 20 bp, human
ggccgcaccggacccagtgc

SEQ ID NO: 2504 - DNA, 20 bp, human
ggtgtctcctcacaggtgaa

SEQ ID NO: 2505 - DNA, 20 bp, human
gtgtccagcaccagcggtac

SEQ ID NO: 2506 - DNA, 20 bp, human
gacagagcgagactccggca

SEQ ID NO: 2507 - DNA, 20 bp, human
gcggaaagggaaaacaacta

SEQ ID NO: 2508 - DNA, 20 bp, human
gtccaaccagggaatccctc

SEQ ID NO: 2509 - DNA, 20 bp, human
gactacggctgcggtgtggt

SEQ ID NO: 2510 - DNA, 20 bp, human
gctaagtcagggccgcgcgg

SEQ ID NO: 2511 - DNA, 20 bp, human
ggctccattatccagcacta

SEQ ID NO: 2512 - DNA, 20 bp, human
gcgaccttagtgctggataa

SEQ ID NO: 2513 - DNA, 20 bp, human
gaaagctcgagcagaggggt

SEQ ID NO: 2514 - DNA, 20 bp, human
gaacaactacggctgcggtg

SEQ ID NO: 2515 - DNA, 20 bp, human
gacccacccagctccaacca

SEQ ID NO: 2516 - DNA, 20 bp, human
gtctccggccataatgaccc

SEQ ID NO: 2517 - DNA, 20 bp, human
gagtcgtggctgcagcgctg

SEQ ID NO: 2518 - DNA, 20 bp, human
ggctgaggcgagaggttggt

SEQ ID NO: 2519 - DNA, 20 bp, human
gcagcggaggacccaagcaa

SEQ ID NO: 2520 - DNA, 20 bp, human
gcacgactgccgggatggaa

SEQ ID NO: 2521 - DNA, 20 bp, human
ggcgcacacaaccagacggt

SEQ ID NO: 2522 - DNA, 20 bp, human
gcggagcggtgtccctgcgg

SEQ ID NO: 2523 - DNA, 20 bp, human
gcagcctgggtcattatggc

SEQ ID NO: 2524 - DNA, 20 bp, human
gtccgcactccccccaccag

SEQ ID NO: 2525 - DNA, 20 bp, human
gcgcggtggcccttccatcc

SEQ ID NO: 2526 - DNA, 20 bp, human
gtagcctactagctgtacat

SEQ ID NO: 2527 - DNA, 20 bp, human
gtaccagtccacgctcaatg

SEQ ID NO: 2528 - DNA, 20 bp, human
ggggtgtcctggtggactga

SEQ ID NO: 2529 - DNA, 20 bp, human
ggaagccctgtacaagtatg

SEQ ID NO: 2530 - DNA, 20 bp, human
gaggctaccttcagtccacc

SEQ ID NO: 2531 - DNA, 20 bp, human
gcgtggactggtaacaggat

SEQ ID NO: 2532 - DNA, 20 bp, human
gagggcctcatacttgtaca

SEQ ID NO: 2533 - DNA, 20 bp, human
gatggggtagtgcaaatgta

SEQ ID NO: 2534 - DNA, 20 bp, human
ggtaacaggatgggatgaca

SEQ ID NO: 2535 - DNA, 20 bp, human
gagattcagaggttgaggat

SEQ ID NO: 2536 - DNA, 20 bp, human
gctgaggatgcagggctccc

SEQ ID NO: 2537 - DNA, 20 bp, human
gcagctctcggggtgtctca

SEQ ID NO: 2538 - DNA, 20 bp, human
gcgtggcctgatcacagggt

SEQ ID NO: 2539 - DNA, 20 bp, human
gatcaggccacgctcgaaag

SEQ ID NO: 2540 - DNA, 20 bp, human
gtcgagcgtggcctgatcac

SEQ ID NO: 2541 - DNA, 20 bp, human
gagggctccgttgcaagcag

SEQ ID NO: 2542 - DNA, 20 bp, human
gccctggaagaggcctcagc

SEQ ID NO: 2543 - DNA, 20 bp, human
gcagggctagcaccgtgccc

SEQ ID NO: 2544 - DNA, 20 bp, human
ggagagcagacctgcggctg

SEQ ID NO: 2545 - DNA, 20 bp, human
gtacctaggagacaaccccc

SEQ ID NO: 2546 - DNA, 20 bp, human
gagagcggctcagagacagg

SEQ ID NO: 2547 - DNA, 20 bp, human
gtaccggtggtgatcgacaa

SEQ ID NO: 2548 - DNA, 20 bp, human
ggctagagcggctcagagac

SEQ ID NO: 2549 - DNA, 20 bp, human
ggccgagcccgtagctagag

SEQ ID NO: 2550 - DNA, 20 bp, human
gagccgttgtcgatcaccac

SEQ ID NO: 2551 - DNA, 20 bp, human
gcaccaccggtagctggcag

SEQ ID NO: 2552 - DNA, 20 bp, human
gcaggaaaggaccccaaagg

SEQ ID NO: 2553 - DNA, 20 bp, human
gaaccactgccagctaccgg

SEQ ID NO: 2554 - DNA, 20 bp, human
gatgaaccactgccagctac

SEQ ID NO: 2555 - DNA, 20 bp, human
gccccaaaggaggtgcgcaa

SEQ ID NO: 2556 - DNA, 20 bp, human
gggtagcctagcgggagaag

SEQ ID NO: 2557 - DNA, 20 bp, human
gctggagccgggaggactga

SEQ ID NO: 2558 - DNA, 20 bp, human
gtgcggtggctgcagcggag

SEQ ID NO: 2559 - DNA, 20 bp, human
ggtggcagggtgggcgtctg

SEQ ID NO: 2560 - DNA, 20 bp, human
gactgctggtgggatatggg

SEQ ID NO: 2561 - DNA, 20 bp, human
gcggcagcggcagccacccg

SEQ ID NO: 2562 - DNA, 20 bp, human
ggaaaggaatgaaagcgagg

SEQ ID NO: 2563 - DNA, 20 bp, human
ggagaggggatcaagcttgg

SEQ ID NO: 2564 - DNA, 20 bp, human
gaggaatgaaagcgaggggg

SEQ ID NO: 2565 - DNA, 20 bp, human
ggatcaagcttgggggagaa

SEQ ID NO: 2566 - DNA, 20 bp, human
ggcgagcaggaggacaacaa

SEQ ID NO: 2567 - DNA, 20 bp, human
ggcggcggcggtggttacta

SEQ ID NO: 2568 - DNA, 20 bp, human
gtcccctctctggaacacga

SEQ ID NO: 2569 - DNA, 20 bp, human
gaggctcagactcccctctc

SEQ ID NO: 2570 - DNA, 20 bp, human
ggccctcgtgttccagagag

SEQ ID NO: 2571 - DNA, 20 bp, human
gacagggctcgggtccccag

SEQ ID NO: 2572 - DNA, 20 bp, human
ggcggcggtggttactatgg

SEQ ID NO: 2573 - DNA, 20 bp, human
gcggtgaagggcagaaacca

SEQ ID NO: 2574 - DNA, 20 bp, human
gcgcccctggacacggtgaa

SEQ ID NO: 2575 - DNA, 20 bp, human
gacccgagccctgttccagg

SEQ ID NO: 2576 - DNA, 20 bp, human
gagcgccagtcggattgagg

SEQ ID NO: 2577 - DNA, 20 bp, human
gggttggctctagtcagtgt

SEQ ID NO: 2578 - DNA, 20 bp, human
ggcgcaccgccagccgcagg

SEQ ID NO: 2579 - DNA, 20 bp, human
gtgacgtctggcagccgtag

SEQ ID NO: 2580 - DNA, 20 bp, human
gagcgtgggcacctgacgtc

SEQ ID NO: 2581 - DNA, 20 bp, human
ggcgggatagggtgcagcgt

SEQ ID NO: 2582 - DNA, 20 bp, human
gagcaaactgaccttcgggg

SEQ ID NO: 2583 - DNA, 20 bp, human
gcgcccggctgcggggccag

SEQ ID NO: 2584 - DNA, 20 bp, human
ggtacctggcgagagctcgg

SEQ ID NO: 2585 - DNA, 20 bp, human
gcgccagccgcagggggcgt

SEQ ID NO: 2586 - DNA, 20 bp, human
gggccaggagaccgaaaacg

SEQ ID NO: 2587 - DNA, 20 bp, human
gtgtctccgaggaagaccca

SEQ ID NO: 2588 - DNA, 20 bp, human
gccaggctgaggcgacgaag

SEQ ID NO: 2589 - DNA, 20 bp, human
gggctgaggcgacgaagagg

SEQ ID NO: 2590 - DNA, 20 bp, human
gggacagtctgggaactgac

SEQ ID NO: 2591 - DNA, 20 bp, human
gtcctcggagacaaacctcc

SEQ ID NO: 2592 - DNA, 20 bp, human
gagttcccagactgtccggg

SEQ ID NO: 2593 - DNA, 20 bp, human
gccggaaccggaagtttggg

SEQ ID NO: 2594 - DNA, 20 bp, human
gttgttccgagagacgggag

SEQ ID NO: 2595 - DNA, 20 bp, human
gactgactgggtccgatgtc

SEQ ID NO: 2596 - DNA, 20 bp, human
gtggatacaaagaggcgggc

SEQ ID NO: 2597 - DNA, 20 bp, human
ggccgggctcagggccgctg

SEQ ID NO: 2598 - DNA, 20 bp, human
ggcggcgccgcggaacatga

SEQ ID NO: 2599 - DNA, 20 bp, human
gggcgcacagcgatccccag

SEQ ID NO: 2600 - DNA, 20 bp, human
gccggaggggccatgaacgg

SEQ ID NO: 2601 - DNA, 20 bp, human
ggcgcagggaacgagaccga

SEQ ID NO: 2602 - DNA, 20 bp, human
gacgagaccgaaggaaggag

SEQ ID NO: 2603 - DNA, 20 bp, human
gctgtgcgccggtaagaact

SEQ ID NO: 2604 - DNA, 20 bp, human
gcatgaacggggggaggggt

SEQ ID NO: 2605 - DNA, 20 bp, human
gactcaggcatagcgcggcg

SEQ ID NO: 2606 - DNA, 20 bp, human
gggacccccgggctgagggt

SEQ ID NO: 2607 - DNA, 20 bp, human
gaggaggcttgcagcaatga

SEQ ID NO: 2608 - DNA, 20 bp, human
gcgggggtcctcggtctagg

SEQ ID NO: 2609 - DNA, 20 bp, human
ggaggggaggccgccctgag

SEQ ID NO: 2610 - DNA, 20 bp, human
gggaaggggccaccgaggaa

SEQ ID NO: 2611 - DNA, 20 bp, human
ggagctgggcaataaggaaa

SEQ ID NO: 2612 - DNA, 20 bp, human
gacccgcagagcgggcccag

SEQ ID NO: 2613 - DNA, 20 bp, human
ggcctcccgcgaccactctg

SEQ ID NO: 2614 - DNA, 20 bp, human
gcgagactgtaggcaacgtc

SEQ ID NO: 2615 - DNA, 20 bp, human
gccgaggacccccgggctga

SEQ ID NO: 2616 - DNA, 20 bp, human
gctcgctggaccctaagtcc

SEQ ID NO: 2617 - DNA, 20 bp, human
gaatgggtgctccttaatgg

SEQ ID NO: 2618 - DNA, 20 bp, human
gacacagcctgtccccacgg

SEQ ID NO: 2619 - DNA, 20 bp, human
gtgactgtggcctggactta

SEQ ID NO: 2620 - DNA, 20 bp, human
gcccagcgcctgaaacagaa

SEQ ID NO: 2621 - DNA, 20 bp, human
gggccctggggagggataga

SEQ ID NO: 2622 - DNA, 20 bp, human
gcggctcccggacttcccac

SEQ ID NO: 2623 - DNA, 20 bp, human
gtgaaagccgggcaactggg

SEQ ID NO: 2624 - DNA, 20 bp, human
ggaagtccgggagccgccgt

SEQ ID NO: 2625 - DNA, 20 bp, human
gtaatgggggctccgaaaca

SEQ ID NO: 2626 - DNA, 20 bp, human
gcgccctacccccgaaacag

SEQ ID NO: 2627 - DNA, 20 bp, human
gggcggagtgacagccccac

SEQ ID NO: 2628 - DNA, 20 bp, human
gctgggaggcatgatctaat

SEQ ID NO: 2629 - DNA, 20 bp, human
gtgtgtgggtaacaaaactc

SEQ ID NO: 2630 - DNA, 20 bp, human
gatcccagtcggccccatct

SEQ ID NO: 2631 - DNA, 20 bp, human
gtgcttgctgcgtggcccgt

SEQ ID NO: 2632 - DNA, 20 bp, human
ggttctgtgctgctccttca

SEQ ID NO: 2633 - DNA, 20 bp, human
gaactctggcgacccagatg

SEQ ID NO: 2634 - DNA, 20 bp, human
gaacagcggaagcagctgcc

SEQ ID NO: 2635 - DNA, 20 bp, human
gtagtgagcctcaagaagtt

SEQ ID NO: 2636 - DNA, 20 bp, human
gcagctggtgcaggggtctc

SEQ ID NO: 2637 - DNA, 20 bp, human
gaagcccagatccgcatcag

SEQ ID NO: 2638 - DNA, 20 bp, human
ggaccctggccccgatgcaa

SEQ ID NO: 2639 - DNA, 20 bp, human
gagttagacgccagtcctgg

SEQ ID NO: 2640 - DNA, 20 bp, human
gtcagggcaaggatggcggt

SEQ ID NO: 2641 - DNA, 20 bp, human
gcaggaagatgggttcacca

SEQ ID NO: 2642 - DNA, 20 bp, human
gtcagagaaagggccactgg

SEQ ID NO: 2643 - DNA, 20 bp, human
ggcgagttagacgccagtcc

SEQ ID NO: 2644 - DNA, 20 bp, human
gacgccagtcctggtggccc

SEQ ID NO: 2645 - DNA, 20 bp, human
gtgcaagggatctgggctca

SEQ ID NO: 2646 - DNA, 20 bp, human
gccacgccaacggctcacca

SEQ ID NO: 2647 - DNA, 20 bp, human
gtccgggaccaccacgccaa

SEQ ID NO: 2648 - DNA, 20 bp, human
gcggctgccaggatcactcc

SEQ ID NO: 2649 - DNA, 20 bp, human
ggcagccggtggggaagaca

SEQ ID NO: 2650 - DNA, 20 bp, human
gggtggtcccggagtgatcc

SEQ ID NO: 2651 - DNA, 20 bp, human
ggtgatcctggcagccggtg

SEQ ID NO: 2652 - DNA, 20 bp, human
gtccccagaagaggcttcag

SEQ ID NO: 2653 - DNA, 20 bp, human
gggaaacaccctgatatcag

SEQ ID NO: 2654 - DNA, 20 bp, human
gaatggttaaggatggacag

SEQ ID NO: 2655 - DNA, 20 bp, human
ggggaccgggcatggatgta

SEQ ID NO: 2656 - DNA, 20 bp, human
gctggaccgagctgcagagt

SEQ ID NO: 2657 - DNA, 20 bp, human
gcctgggccctaagtagaga

SEQ ID NO: 2658 - DNA, 20 bp, human
gggcggacgccggcatcctg

SEQ ID NO: 2659 - DNA, 20 bp, human
ggagttggccggacactgac

SEQ ID NO: 2660 - DNA, 20 bp, human
gaccgagctgcagagttggc

SEQ ID NO: 2661 - DNA, 20 bp, human
ggctgggcgggccccaggta

SEQ ID NO: 2662 - DNA, 20 bp, human
ggactgggtcaagtgacctt

SEQ ID NO: 2663 - DNA, 20 bp, human
gtactgcgtagcaaaaacgt

SEQ ID NO: 2664 - DNA, 20 bp, human
gtccggccaactctgcagct

SEQ ID NO: 2665 - DNA, 20 bp, human
gggacgccggcatcctgcgg

SEQ ID NO: 2666 - DNA, 20 bp, human
gtgctgggtgcgggagtaag

SEQ ID NO: 2667 - DNA, 20 bp, human
gctctccggctcctcaacag

SEQ ID NO: 2668 - DNA, 20 bp, human
ggctgaggaccagaagtggg

SEQ ID NO: 2669 - DNA, 20 bp, human
ggactgggcggtagacatgg

SEQ ID NO: 2670 - DNA, 20 bp, human
ggactgctgaggaccagaag

SEQ ID NO: 2671 - DNA, 20 bp, human
gagtgactgggcggtagaca

SEQ ID NO: 2672 - DNA, 20 bp, human
ggcgggagtaagcggcacgg

SEQ ID NO: 2673 - DNA, 20 bp, human
gcaagcccaggtagcttcag

SEQ ID NO: 2674 - DNA, 20 bp, human
gcggggcgcagcgactgcgg

SEQ ID NO: 2675 - DNA, 20 bp, human
gcggcggctgcgagagggag

SEQ ID NO: 2676 - DNA, 20 bp, human
gccggcagagacccaccgag

SEQ ID NO: 2677 - DNA, 20 bp, human
gcccagaggggtcaagtcag

SEQ ID NO: 2678 - DNA, 20 bp, human
ggcagagacccaccgagcgg

SEQ ID NO: 2679 - DNA, 20 bp, human
gagccgagcggccaccgagc

SEQ ID NO: 2680 - DNA, 20 bp, human
gggccccagggaaagccgag

SEQ ID NO: 2681 - DNA, 20 bp, human
gaggcccacacagcgctcag

SEQ ID NO: 2682 - DNA, 20 bp, human
gtgggtctctgccggctcgg

SEQ ID NO: 2683 - DNA, 20 bp, human
gggccgctcggctttccctg

SEQ ID NO: 2684 - DNA, 20 bp, human
gccctccgccgccgctcggt

SEQ ID NO: 2685 - DNA, 20 bp, human
gaaaccctgggaacgaacgg

SEQ ID NO: 2686 - DNA, 20 bp, human
gcagagcggcctgaagcgag

SEQ ID NO: 2687 - DNA, 20 bp, human
gtgggaggtgggagcaacgg

SEQ ID NO: 2688 - DNA, 20 bp, human
ggaggtgggagcaacggcgg

SEQ ID NO: 2689 - DNA, 20 bp, human
gggcctgaagcgagaggttg

SEQ ID NO: 2690 - DNA, 20 bp, human
ggccctctatgtgggaagac

SEQ ID NO: 2691 - DNA, 20 bp, human
ggctctgcgcgaggttcaca

SEQ ID NO: 2692 - DNA, 20 bp, human
gcatttatggaaataatggg

SEQ ID NO: 2693 - DNA, 20 bp, human
gccctaggtgacgcaagacg

SEQ ID NO: 2694 - DNA, 20 bp, human
gcgcgaggttcacagggtca

SEQ ID NO: 2695 - DNA, 20 bp, human
ggtcgtgagatcagttcaag

SEQ ID NO: 2696 - DNA, 20 bp, human
gggccgccaacgaagatctg

SEQ ID NO: 2697 - DNA, 20 bp, human
gctcagggcgctgacgacga

SEQ ID NO: 2698 - DNA, 20 bp, human
gtgacgacgacggcagtcgt

SEQ ID NO: 2699 - DNA, 20 bp, human
ggcgagagcagcgcgagata

SEQ ID NO: 2700 - DNA, 20 bp, human
gtactccgtgagcaaggaca

SEQ ID NO: 2701 - DNA, 20 bp, human
gtagcgcctcagatcttcgt

SEQ ID NO: 2702 - DNA, 20 bp, human
ggaggaccagccaccaggtg

SEQ ID NO: 2703 - DNA, 20 bp, human
gccctgagaagccgaagcca

SEQ ID NO: 2704 - DNA, 20 bp, human
gctcggtgttgagggacagt

SEQ ID NO: 2705 - DNA, 20 bp, human
gatcttcctgctcttccggg

SEQ ID NO: 2706 - DNA, 20 bp, human
gccaagaagggtcggcacca

SEQ ID NO: 2707 - DNA, 20 bp, human
gttccttggaccgccaagga

SEQ ID NO: 2708 - DNA, 20 bp, human
gcgccaaggaagggtctggt

SEQ ID NO: 2709 - DNA, 20 bp, human
gggaccgccaaggaagggtc

SEQ ID NO: 2710 - DNA, 20 bp, human
ggtctggtaggagccaagaa

SEQ ID NO: 2711 - DNA, 20 bp, human
gccgcaagcgaacttagcac

SEQ ID NO: 2712 - DNA, 20 bp, human
ggcgcaccgctcattcaccg

SEQ ID NO: 2713 - DNA, 20 bp, human
gggcaccacggaccttcagt

SEQ ID NO: 2714 - DNA, 20 bp, human
ggcgcccggaaccagcaacg

SEQ ID NO: 2715 - DNA, 20 bp, human
ggaccgtattctgggacaaa

SEQ ID NO: 2716 - DNA, 20 bp, human
gtcctcggcccgccaccgaa

SEQ ID NO: 2717 - DNA, 20 bp, human
gcatccccgccgcccaggag

SEQ ID NO: 2718 - DNA, 20 bp, human
ggcccgccgagcagactgga

SEQ ID NO: 2719 - DNA, 20 bp, human
ggcgttgccggcccctgaag

SEQ ID NO: 2720 - DNA, 20 bp, human
gagtcagcccagccggccag

SEQ ID NO: 2721 - DNA, 20 bp, human
gcccctgaagtggagcgaga

SEQ ID NO: 2722 - DNA, 20 bp, human
gcaccgaagggaaagcggtc

SEQ ID NO: 2723 - DNA, 20 bp, human
ggagaccgccagcctcgctg

SEQ ID NO: 2724 - DNA, 20 bp, human
gcttggtccggagcctccac

SEQ ID NO: 2725 - DNA, 20 bp, human
gctgctgttaacccgtgagg

SEQ ID NO: 2726 - DNA, 20 bp, human
gcggccagctggggacaggt

SEQ ID NO: 2727 - DNA, 20 bp, human
gtgcagagctggccggtcgg

SEQ ID NO: 2728 - DNA, 20 bp, human
gaccctcccgcgctccggac

SEQ ID NO: 2729 - DNA, 20 bp, human
ggccctagggcgatccgggt

SEQ ID NO: 2730 - DNA, 20 bp, human
ggaggaatgagcgagccatg

SEQ ID NO: 2731 - DNA, 20 bp, human
gccccgagcactgcaggaaa

SEQ ID NO: 2732 - DNA, 20 bp, human
gtggagccctagggcgatcc

SEQ ID NO: 2733 - DNA, 20 bp, human
gccggccgcggccatcccgg

SEQ ID NO: 2734 - DNA, 20 bp, human
gtcccacccggatcgcccta

SEQ ID NO: 2735 - DNA, 20 bp, human
gctcggggtgacagccggtc

SEQ ID NO: 2736 - DNA, 20 bp, human
ggaggtaagtcgccgaacta

SEQ ID NO: 2737 - DNA, 20 bp, human
ggaagagcgttagtgagaga

SEQ ID NO: 2738 - DNA, 20 bp, human
ggtaagtcgccgaactaggg

SEQ ID NO: 2739 - DNA, 20 bp, human
ggcagcgagccgccctagtt

SEQ ID NO: 2740 - DNA, 20 bp, human
gcagcgtgcggtgccctcgg

SEQ ID NO: 2741 - DNA, 20 bp, human
gccgagttggcccggggact

SEQ ID NO: 2742 - DNA, 20 bp, human
ggcgagcagagcaccggcca

SEQ ID NO: 2743 - DNA, 20 bp, human
gaactgtccgagttggcccg

SEQ ID NO: 2744 - DNA, 20 bp, human
gccggccagggcgagcagga

SEQ ID NO: 2745 - DNA, 20 bp, human
gtcgctgcccgccccgccga

SEQ ID NO: 2746 - DNA, 20 bp, human
ggaccgcgcagaggatgacc

SEQ ID NO: 2747 - DNA, 20 bp, human
gtcaggtaccaggtaccgag

SEQ ID NO: 2748 - DNA, 20 bp, human
gtccagcgtccggcacacgt

SEQ ID NO: 2749 - DNA, 20 bp, human
gggcctcgcagtccagcgtc

SEQ ID NO: 2750 - DNA, 20 bp, human
ggacccacgtgaagcgtaca

SEQ ID NO: 2751 - DNA, 20 bp, human
gacgcctcttcaccccgcgt

SEQ ID NO: 2752 - DNA, 20 bp, human
gcgtaggactcgggcgtctc

SEQ ID NO: 2753 - DNA, 20 bp, human
ggtcgtgctgggacgacatg

SEQ ID NO: 2754 - DNA, 20 bp, human
gccggagcgccgctgccatg

SEQ ID NO: 2755 - DNA, 20 bp, human
gtggcagcggcgctccgggc

SEQ ID NO: 2756 - DNA, 20 bp, human
ggtgcaggtggcgttaccaa

SEQ ID NO: 2757 - DNA, 20 bp, human
ggagggaaaagaggattgag

SEQ ID NO: 2758 - DNA, 20 bp, human
ggcggtagaatcttcccagt

SEQ ID NO: 2759 - DNA, 20 bp, human
gctgggggcgtcgagcctgg

SEQ ID NO: 2760 - DNA, 20 bp, human
gaggtggcgttaccaaaggc

SEQ ID NO: 2761 - DNA, 20 bp, human
gtagcggggccgggaacatg

SEQ ID NO: 2762 - DNA, 20 bp, human
ggatgggcctgtctctgagt

SEQ ID NO: 2763 - DNA, 20 bp, human
gtagggagcaaacccctctc

SEQ ID NO: 2764 - DNA, 20 bp, human
gtcgtttgagggaagagcag

SEQ ID NO: 2765 - DNA, 20 bp, human
gtgggaaagggctactggac

SEQ ID NO: 2766 - DNA, 20 bp, human
ggaagactgcaagcccacga

SEQ ID NO: 2767 - DNA, 20 bp, human
gggatcccagaagggagagg

SEQ ID NO: 2768 - DNA, 20 bp, human
gcagtcttccaagctcagtg

SEQ ID NO: 2769 - DNA, 20 bp, human
gggctgtggctcctgcgctc

SEQ ID NO: 2770 - DNA, 20 bp, human
gttgcttcctcaggactctg

SEQ ID NO: 2771 - DNA, 20 bp, human
gcccctggcctggcgtggaa

SEQ ID NO: 2772 - DNA, 20 bp, human
gactctgaggagttcgctga

SEQ ID NO: 2773 - DNA, 20 bp, human
ggattctaaaagggaaccag

SEQ ID NO: 2774 - DNA, 20 bp, human
gcccacgaaggtaagtccat

SEQ ID NO: 2775 - DNA, 20 bp, human
gccaggccagggggaactaa

SEQ ID NO: 2776 - DNA, 20 bp, human
ggccgggcagtgggcaggta

SEQ ID NO: 2777 - DNA, 20 bp, human
gggaggataagccccgagaa

SEQ ID NO: 2778 - DNA, 20 bp, human
gggataagccccgagaacgg

SEQ ID NO: 2779 - DNA, 20 bp, human
gctcccagggcgcagaacgt

SEQ ID NO: 2780 - DNA, 20 bp, human
gagggaccgtgagaaaacgg

SEQ ID NO: 2781 - DNA, 20 bp, human
gctgggtggcccggagacct

SEQ ID NO: 2782 - DNA, 20 bp, human
gaaacagccggtccgctcac

SEQ ID NO: 2783 - DNA, 20 bp, human
ggccagcaagcagagccggg

SEQ ID NO: 2784 - DNA, 20 bp, human
ggccgccgccaccatgccag

SEQ ID NO: 2785 - DNA, 20 bp, human
gagtgggcaggtatggctga

SEQ ID NO: 2786 - DNA, 20 bp, human
gtgggtcccagccggaataa

SEQ ID NO: 2787 - DNA, 20 bp, human
gtcccaaaaggccagaggag

SEQ ID NO: 2788 - DNA, 20 bp, human
gggagtattgccctgtaggt

SEQ ID NO: 2789 - DNA, 20 bp, human
ggcttgaacctattgaccca

SEQ ID NO: 2790 - DNA, 20 bp, human
gtagcgctgagggtcccaaa

SEQ ID NO: 2791 - DNA, 20 bp, human
gatggcagttggtggttaca

SEQ ID NO: 2792 - DNA, 20 bp, human
ggcgtcttgtttctgctcag

SEQ ID NO: 2793 - DNA, 20 bp, human
gggaggtcctaggccttaag

SEQ ID NO: 2794 - DNA, 20 bp, human
gactagagagtacagaagtt

SEQ ID NO: 2795 - DNA, 20 bp, human
gagaaacaagacgcgccaca

SEQ ID NO: 2796 - DNA, 20 bp, human
ggggaatctgagattgatgt

SEQ ID NO: 2797 - DNA, 20 bp, human
gagcagtgtgtttaagacta

SEQ ID NO: 2798 - DNA, 20 bp, human
gctgctgaactcccatccaa

SEQ ID NO: 2799 - DNA, 20 bp, human
gcagaatgattccacttacg

SEQ ID NO: 2800 - DNA, 20 bp, human
gagacacaagacttggtact

SEQ ID NO: 2801 - DNA, 20 bp, human
gtccctaatccctcagcacc

SEQ ID NO: 2802 - DNA, 20 bp, human
gagaggtaagatttgctaga

SEQ ID NO: 2803 - DNA, 20 bp, human
gatgccattctccattggat

SEQ ID NO: 2804 - DNA, 20 bp, human
gtattgacagacacaagact

SEQ ID NO: 2805 - DNA, 20 bp, human
ggttagttgccaggtgctga

SEQ ID NO: 2806 - DNA, 20 bp, human
gagctgaggccacagaacaa

SEQ ID NO: 2807 - DNA, 20 bp, human
gacaaaccattgataaagca

SEQ ID NO: 2808 - DNA, 20 bp, human
gggtatccagagtagtccac

SEQ ID NO: 2809 - DNA, 20 bp, human
ggagacttcacattatccag

SEQ ID NO: 2810 - DNA, 20 bp, human
gattatccagtggactactc

SEQ ID NO: 2811 - DNA, 20 bp, human
gatggccatttctgtctaga

SEQ ID NO: 2812 - DNA, 20 bp, human
ggtaagtcattcataaagtt

SEQ ID NO: 2813 - DNA, 20 bp, human
gttaaaaatgaaaacacgcc

SEQ ID NO: 2814 - DNA, 20 bp, human
ggaagaaacagtagtttcca

SEQ ID NO: 2815 - DNA, 20 bp, human
gtaaaccatctagacagaaa

SEQ ID NO: 2816 - DNA, 20 bp, human
gggcgctgcaacctccaccg

SEQ ID NO: 2817 - DNA, 20 bp, human
gcagcactgagccgcggtgg

SEQ ID NO: 2818 - DNA, 20 bp, human
gctcaggcgtattgaaaagg

SEQ ID NO: 2819 - DNA, 20 bp, human
gtggaggcgcgcagatgcac

SEQ ID NO: 2820 - DNA, 20 bp, human
gcccgcgcactcgggaaatg

SEQ ID NO: 2821 - DNA, 20 bp, human
gccagccccggccggtgctg

SEQ ID NO: 2822 - DNA, 20 bp, human
ggagcgagtgctgcattggg

SEQ ID NO: 2823 - DNA, 20 bp, human
ggcgagggaaacggactcgg

SEQ ID NO: 2824 - DNA, 20 bp, human
ggtatggcccaaaggcacag

SEQ ID NO: 2825 - DNA, 20 bp, human
gggacgcttccgctggcggg

SEQ ID NO: 2826 - DNA, 20 bp, human
ggccgcttcagcgactgcgg

SEQ ID NO: 2827 - DNA, 20 bp, human
gcaaggctgcagcccgccag

SEQ ID NO: 2828 - DNA, 20 bp, human
ggcgccgcctcagcatcctc

SEQ ID NO: 2829 - DNA, 20 bp, human
ggcccccgcagtcgctgaag

SEQ ID NO: 2830 - DNA, 20 bp, human
gggacgagaagcaggcggca

SEQ ID NO: 2831 - DNA, 20 bp, human
gggctactccctcccccggc

SEQ ID NO: 2832 - DNA, 20 bp, human
gcgggacgcagaggagtcca

SEQ ID NO: 2833 - DNA, 20 bp, human
gcgctggggaggctccaagt

SEQ ID NO: 2834 - DNA, 20 bp, human
gggctgcagcccgccagggg

SEQ ID NO: 2835 - DNA, 20 bp, human
ggccttgccggcgcttcctg

SEQ ID NO: 2836 - DNA, 20 bp, human
gcgctcaggtgggtgctgct

SEQ ID NO: 2837 - DNA, 20 bp, human
gtgtacctgcaacagagagg

SEQ ID NO: 2838 - DNA, 20 bp, human
gggagaccttgcaacatgct

SEQ ID NO: 2839 - DNA, 20 bp, human
gtctgctcttctcgctcagg

SEQ ID NO: 2840 - DNA, 20 bp, human
gcaacatgctgggtgattcc

SEQ ID NO: 2841 - DNA, 20 bp, human
gtcaatcttactaaccagtt

SEQ ID NO: 2842 - DNA, 20 bp, human
ggaggaggagactgactggc

SEQ ID NO: 2843 - DNA, 20 bp, human
gagagcagacaccgtgctcc

SEQ ID NO: 2844 - DNA, 20 bp, human
gagatgagatgcatacatat

SEQ ID NO: 2845 - DNA, 20 bp, human
gaggttaaaaccagcccaac

SEQ ID NO: 2846 - DNA, 20 bp, human
gtgtgtaaagagtacaggta

SEQ ID NO: 2847 - DNA, 20 bp, human
gtgtgatcgagggcgtcctc

SEQ ID NO: 2848 - DNA, 20 bp, human
gatccactaaccaaatgggg

SEQ ID NO: 2849 - DNA, 20 bp, human
gataacctgcttgtgatcga

SEQ ID NO: 2850 - DNA, 20 bp, human
gtgttcctgcacatttcctg

SEQ ID NO: 2851 - DNA, 20 bp, human
ggacgccctcgatcacaagc

SEQ ID NO: 2852 - DNA, 20 bp, human
ggagggtatggggcaagttt

SEQ ID NO: 2853 - DNA, 20 bp, human
gagtggatgtgatgtcacaa

SEQ ID NO: 2854 - DNA, 20 bp, human
gcttggttttagagggtatg

SEQ ID NO: 2855 - DNA, 20 bp, human
gggatgtgatgtcacaaagg

SEQ ID NO: 2856 - DNA, 20 bp, human
gaccgagccctgggaggcta

SEQ ID NO: 2857 - DNA, 20 bp, human
gcccctggcagggtttccgg

SEQ ID NO: 2858 - DNA, 20 bp, human
ggccagctagaccgagccct

SEQ ID NO: 2859 - DNA, 20 bp, human
ggctcaaaacccggctcccc

SEQ ID NO: 2860 - DNA, 20 bp, human
gtgagctcaggcgcctctag

SEQ ID NO: 2861 - DNA, 20 bp, human
gcaaaggactgcaactacat

SEQ ID NO: 2862 - DNA, 20 bp, human
gagaaaacgcgcagatgtcg

SEQ ID NO: 2863 - DNA, 20 bp, human
gtctcttgggccacaaatgg

SEQ ID NO: 2864 - DNA, 20 bp, human
gtcccagggctcggtctagc

SEQ ID NO: 2865 - DNA, 20 bp, human
gaaacccggctcccctggca

SEQ ID NO: 2866 - DNA, 20 bp, human
gcggatggagaagcgactca

SEQ ID NO: 2867 - DNA, 20 bp, human
gggccagcagcaaccagagg

SEQ ID NO: 2868 - DNA, 20 bp, human
gccagaggcggaacatggtg

SEQ ID NO: 2869 - DNA, 20 bp, human
ggcaattcccgacttcccaa

SEQ ID NO: 2870 - DNA, 20 bp, human
gttagcgtccggaacacgaa

SEQ ID NO: 2871 - DNA, 20 bp, human
gagcaaccagaggcggaaca

SEQ ID NO: 2872 - DNA, 20 bp, human
ggcctcctggcgtcaagacc

SEQ ID NO: 2873 - DNA, 20 bp, human
gagcctcggggcgcacgctg

SEQ ID NO: 2874 - DNA, 20 bp, human
ggtcgcttctccatccggac

SEQ ID NO: 2875 - DNA, 20 bp, human
gtccggaggccccggagacg

SEQ ID NO: 2876 - DNA, 20 bp, human
ggggtcccccgagctctccg

SEQ ID NO: 2877 - DNA, 20 bp, human
ggcaggagcgggtcacacgg

SEQ ID NO: 2878 - DNA, 20 bp, human
gatggctccctccccctcgg

SEQ ID NO: 2879 - DNA, 20 bp, human
gggagctcacagctatgggc

SEQ ID NO: 2880 - DNA, 20 bp, human
gggagcaggagcgggtcaca

SEQ ID NO: 2881 - DNA, 20 bp, human
ggccgaggagctcacagcta

SEQ ID NO: 2882 - DNA, 20 bp, human
gggaggccccggagagctcg

SEQ ID NO: 2883 - DNA, 20 bp, human
gtgtgagctcctcggcctct

SEQ ID NO: 2884 - DNA, 20 bp, human
gggctgggctgcccccgagg

SEQ ID NO: 2885 - DNA, 20 bp, human
gactccgctggcaaagcaga

SEQ ID NO: 2886 - DNA, 20 bp, human
gccctgcagtggaagtgagg

SEQ ID NO: 2887 - DNA, 20 bp, human
gcatccctgcagtggaagtg

SEQ ID NO: 2888 - DNA, 20 bp, human
gaagcacctcacagataggt

SEQ ID NO: 2889 - DNA, 20 bp, human
ggatgaagcacctcacagat

SEQ ID NO: 2890 - DNA, 20 bp, human
gttctgagtgattctggtag

SEQ ID NO: 2891 - DNA, 20 bp, human
gtaacatacaaagcagctaa

SEQ ID NO: 2892 - DNA, 20 bp, human
gaactgcccacctatctgtg

SEQ ID NO: 2893 - DNA, 20 bp, human
gtcatcaagaatatacaccc

SEQ ID NO: 2894 - DNA, 20 bp, human
ggaagcattctgagtgattc

SEQ ID NO: 2895 - DNA, 20 bp, human
gattctgacccacagtgagg

SEQ ID NO: 2896 - DNA, 20 bp, human
gctcctcggctaaatagtgg

SEQ ID NO: 2897 - DNA, 20 bp, human
gaggccgcgcatggccgggt

SEQ ID NO: 2898 - DNA, 20 bp, human
gagccccgcgggacacggtc

SEQ ID NO: 2899 - DNA, 20 bp, human
gtccccgacccggccatgcg

SEQ ID NO: 2900 - DNA, 20 bp, human
gtccctcctcggctaaatag

SEQ ID NO: 2901 - DNA, 20 bp, human
gcagagcccgaggccgcgca

SEQ ID NO: 2902 - DNA, 20 bp, human
gaccccactaacaagctcag

SEQ ID NO: 2903 - DNA, 20 bp, human
ggtgacagccccgcgggaca

SEQ ID NO: 2904 - DNA, 20 bp, human
gcgggccatcaggtgcacag

SEQ ID NO: 2905 - DNA, 20 bp, human
gggaaccagaccgtgtcccg

SEQ ID NO: 2906 - DNA, 20 bp, human
gtccatcgaacaggacacgg

SEQ ID NO: 2907 - DNA, 20 bp, human
ggcgcttcccggccagactt

SEQ ID NO: 2908 - DNA, 20 bp, human
gcctgccggggccccaagtc

SEQ ID NO: 2909 - DNA, 20 bp, human
ggtgggcccagtcctcggtg

SEQ ID NO: 2910 - DNA, 20 bp, human
gcggcagggttggaaaatga

SEQ ID NO: 2911 - DNA, 20 bp, human
gggctccatcgaacaggaca

SEQ ID NO: 2912 - DNA, 20 bp, human
gtagggaaaaatccagtccc

SEQ ID NO: 2913 - DNA, 20 bp, human
gacacggaggaagcggtgcc

SEQ ID NO: 2914 - DNA, 20 bp, human
ggaggcgaccgagtgctgag

SEQ ID NO: 2915 - DNA, 20 bp, human
gagcgcagctaggcgatgtc

SEQ ID NO: 2916 - DNA, 20 bp, human
gggcagcaggacccaagaca

SEQ ID NO: 2917 - DNA, 20 bp, human
ggaacaatgagccaaagtac

SEQ ID NO: 2918 - DNA, 20 bp, human
gagcaggacccaagacatgg

SEQ ID NO: 2919 - DNA, 20 bp, human
gaagataaaactggacactg

SEQ ID NO: 2920 - DNA, 20 bp, human
gggtcctgctgcctgtactt

SEQ ID NO: 2921 - DNA, 20 bp, human
ggcagtggccaccatgtctt

SEQ ID NO: 2922 - DNA, 20 bp, human
gccacaacttcatgctgcgt

SEQ ID NO: 2923 - DNA, 20 bp, human
ggagccaaagtacaggcagc

SEQ ID NO: 2924 - DNA, 20 bp, human
gatagttcgcttttgcagag

SEQ ID NO: 2925 - DNA, 20 bp, human
ggaatccatgtttcatatag

SEQ ID NO: 2926 - DNA, 20 bp, human
ggccagggtgcgctaccgga

SEQ ID NO: 2927 - DNA, 20 bp, human
ggaaagcggctccgagccag

SEQ ID NO: 2928 - DNA, 20 bp, human
gctacgagcggtgtctcctg

SEQ ID NO: 2929 - DNA, 20 bp, human
gggtgcgctaccggacggag

SEQ ID NO: 2930 - DNA, 20 bp, human
gtgcgccttccgaacccctc

SEQ ID NO: 2931 - DNA, 20 bp, human
gtcttgcactcgctggaaag

SEQ ID NO: 2932 - DNA, 20 bp, human
gtccagcgagtgcaagaacc

SEQ ID NO: 2933 - DNA, 20 bp, human
gcaaggcggaggccgaagag

SEQ ID NO: 2934 - DNA, 20 bp, human
gctccgtgcgctgctacgag

SEQ ID NO: 2935 - DNA, 20 bp, human
ggcagcgagctgtgcccgag

SEQ ID NO: 2936 - DNA, 20 bp, human
gcagtggtcgccgcaggacc

SEQ ID NO: 2937 - DNA, 20 bp, human
gactgagggcgaggacgaag

SEQ ID NO: 2938 - DNA, 20 bp, human
gacccggcactgcaaggcgt

SEQ ID NO: 2939 - DNA, 20 bp, human
ggagcgcaggatgcacgcac

SEQ ID NO: 2940 - DNA, 20 bp, human
gcttgcagtgccgggtcctg

SEQ ID NO: 2941 - DNA, 20 bp, human
gacgaggacgaagggactga

SEQ ID NO: 2942 - DNA, 20 bp, human
gggatagataaagtgaggag

SEQ ID NO: 2943 - DNA, 20 bp, human
gtagataaagtgaggagagg

SEQ ID NO: 2944 - DNA, 20 bp, human
ggcgtgggatagataaagtg

SEQ ID NO: 2945 - DNA, 20 bp, human
ggtctaccctgaagtcgcgt

SEQ ID NO: 2946 - DNA, 20 bp, human
ggcgcggggcggcgagacag

SEQ ID NO: 2947 - DNA, 20 bp, human
gccgggcgcggcgcaggtag

SEQ ID NO: 2948 - DNA, 20 bp, human
gcaaccccgggcgtgatcag

SEQ ID NO: 2949 - DNA, 20 bp, human
gcggggcggcgagacagcgg

SEQ ID NO: 2950 - DNA, 20 bp, human
gcgccccgcgcgcgcaggaa

SEQ ID NO: 2951 - DNA, 20 bp, human
gtatgtgcgcgcagatctgg

SEQ ID NO: 2952 - DNA, 20 bp, human
gggatgccctcccccatcca

SEQ ID NO: 2953 - DNA, 20 bp, human
ggcgacggcgcggaggcccc

SEQ ID NO: 2954 - DNA, 20 bp, human
gggacagtgtgtgcgcatag

SEQ ID NO: 2955 - DNA, 20 bp, human
gacaaacccacggcaacccc

SEQ ID NO: 2956 - DNA, 20 bp, human
gtgcatggtcaggcgcgaga

SEQ ID NO: 2957 - DNA, 20 bp, human
gaaaagcacagggagatcgc

SEQ ID NO: 2958 - DNA, 20 bp, human
ggagaaagcctaggctcctg

SEQ ID NO: 2959 - DNA, 20 bp, human
gggttcgcttcccggacagg

SEQ ID NO: 2960 - DNA, 20 bp, human
ggaaataaagcgctcgcctg

SEQ ID NO: 2961 - DNA, 20 bp, human
gtcatccctgtaaaagagtg

SEQ ID NO: 2962 - DNA, 20 bp, human
gcgctcgcctgtggcccagc

SEQ ID NO: 2963 - DNA, 20 bp, human
ggctgcgttgtaaggaaatc

SEQ ID NO: 2964 - DNA, 20 bp, human
gtggcttgcaaacctttccg

SEQ ID NO: 2965 - DNA, 20 bp, human
ggttcagttctgccgggtgg

SEQ ID NO: 2966 - DNA, 20 bp, human
gcctcgggctggctctcctg

SEQ ID NO: 2967 - DNA, 20 bp, human
ggtgacgctggtgcatcctc

SEQ ID NO: 2968 - DNA, 20 bp, human
gcagcccaggagaaagccac

SEQ ID NO: 2969 - DNA, 20 bp, human
ggacaggcctgctcactact

SEQ ID NO: 2970 - DNA, 20 bp, human
gtccgctccactcctcgggc

SEQ ID NO: 2971 - DNA, 20 bp, human
ggccaaccaagaaggagagg

SEQ ID NO: 2972 - DNA, 20 bp, human
ggagtggagcggagtgagag

SEQ ID NO: 2973 - DNA, 20 bp, human
gaggcctgctcactactggg

SEQ ID NO: 2974 - DNA, 20 bp, human
gctcactccgctccactcct

SEQ ID NO: 2975 - DNA, 20 bp, human
gaaggattccggccacacag

SEQ ID NO: 2976 - DNA, 20 bp, human
ggtgccaactgccggctggt

SEQ ID NO: 2977 - DNA, 20 bp, human
gggcgggctgaccgaccagc

SEQ ID NO: 2978 - DNA, 20 bp, human
gtgaccgaccagccggcagt

SEQ ID NO: 2979 - DNA, 20 bp, human
gcgcagagcgcacagtgcaa

SEQ ID NO: 2980 - DNA, 20 bp, human
ggtcccggagcgtcactgcg

SEQ ID NO: 2981 - DNA, 20 bp, human
gaaccctgcccgggtggctg

SEQ ID NO: 2982 - DNA, 20 bp, human
gtgacgctccgggactccgc

SEQ ID NO: 2983 - DNA, 20 bp, human
gacccgcgggaaccctgccc

SEQ ID NO: 2984 - DNA, 20 bp, human
ggcgtgcaccccggacccca

SEQ ID NO: 2985 - DNA, 20 bp, human
gcccggctcccgcggagtcc

SEQ ID NO: 2986 - DNA, 20 bp, human
ggggaccccgccagtagtag

SEQ ID NO: 2987 - DNA, 20 bp, human
gaccccgccagtagtagcgg

SEQ ID NO: 2988 - DNA, 20 bp, human
ggcagccgagaactagcgga

SEQ ID NO: 2989 - DNA, 20 bp, human
gtgtccgggtccagtcggat

SEQ ID NO: 2990 - DNA, 20 bp, human
ggactggacccggacattaa

SEQ ID NO: 2991 - DNA, 20 bp, human
ggaacgactacctcccgctc

SEQ ID NO: 2992 - DNA, 20 bp, human
gtaacggccgccgctactac

SEQ ID NO: 2993 - DNA, 20 bp, human
gtcgctgccggagcctccag

SEQ ID NO: 2994 - DNA, 20 bp, human
ggcggcggccgttaatgtcc

SEQ ID NO: 2995 - DNA, 20 bp, human
gcggccgccgctactactgg

SEQ ID NO: 2996 - DNA, 20 bp, human
gaggtgaagagactcaacct

SEQ ID NO: 2997 - DNA, 20 bp, human
ggagactcaacctcggacac

SEQ ID NO: 2998 - DNA, 20 bp, human
gtccatgtggaagtcgtgcc

SEQ ID NO: 2999 - DNA, 20 bp, human
gccttcggctgaaaggctcc

SEQ ID NO: 3000 - DNA, 20 bp, human
gacagcgcaagccccaggta

SEQ ID NO: 3001 - DNA, 20 bp, human
gagagcagtgcccgtgtccg

SEQ ID NO: 3002 - DNA, 20 bp, human
gggaagtcctcagatccatg

SEQ ID NO: 3003 - DNA, 20 bp, human
gctcttcaccttcggctgaa

SEQ ID NO: 3004 - DNA, 20 bp, human
gtccaggcacgacttccaca

SEQ ID NO: 3005 - DNA, 20 bp, human
gcgacttccacatggatctg

SEQ ID NO: 3006 - DNA, 20 bp, human
gggcagggaggacccgaccc

SEQ ID NO: 3007 - DNA, 20 bp, human
ggagattacgagctgctaaa

SEQ ID NO: 3008 - DNA, 20 bp, human
gcccgacccaggcagagcgc

SEQ ID NO: 3009 - DNA, 20 bp, human
gaggtgcctgcggaaaacag

SEQ ID NO: 3010 - DNA, 20 bp, human
gcggccggcagcgtgcgagc

SEQ ID NO: 3011 - DNA, 20 bp, human
gaaagggcggtaagtccgtg

SEQ ID NO: 3012 - DNA, 20 bp, human
gcggtaagtccgtgaggtgg

SEQ ID NO: 3013 - DNA, 20 bp, human
gtcctcctccacccgcggag

SEQ ID NO: 3014 - DNA, 20 bp, human
gggagcttcagtaataaccc

SEQ ID NO: 3015 - DNA, 20 bp, human
gagcgtgcgagcgggcaggg

SEQ ID NO: 3016 - DNA, 20 bp, human
ggcaggagcgcgctaggcgg

SEQ ID NO: 3017 - DNA, 20 bp, human
gcacacatggtacccgggac

SEQ ID NO: 3018 - DNA, 20 bp, human
ggaagcaggagcgcgctagg

SEQ ID NO: 3019 - DNA, 20 bp, human
ggcagcacgggcaggacgag

SEQ ID NO: 3020 - DNA, 20 bp, human
gtcgccgccacggtccgggg

SEQ ID NO: 3021 - DNA, 20 bp, human
ggcgcgagcacctcccggaa

SEQ ID NO: 3022 - DNA, 20 bp, human
gagcagggcgccgtcacaca

SEQ ID NO: 3023 - DNA, 20 bp, human
ggcacgggcaggacgagcgg

SEQ ID NO: 3024 - DNA, 20 bp, human
gccgggaccggcagcccccc

SEQ ID NO: 3025 - DNA, 20 bp, human
gggacgccgcgagaacgcag

SEQ ID NO: 3026 - DNA, 20 bp, human
ggacagacgcacagacgggc

SEQ ID NO: 3027 - DNA, 20 bp, human
ggactggagcgcaaacggtt

SEQ ID NO: 3028 - DNA, 20 bp, human
gcccgctgcgatgtgaacgg

SEQ ID NO: 3029 - DNA, 20 bp, human
gctctcggagctccgctcgg

SEQ ID NO: 3030 - DNA, 20 bp, human
ggcggagctccgagagcggg

SEQ ID NO: 3031 - DNA, 20 bp, human
gcaaacggttgggagactgt

SEQ ID NO: 3032 - DNA, 20 bp, human
ggcaccccagagggtacggg

SEQ ID NO: 3033 - DNA, 20 bp, human
ggccgggactggagcgcaaa

SEQ ID NO: 3034 - DNA, 20 bp, human
gggactggggcgcgtggcca

SEQ ID NO: 3035 - DNA, 20 bp, human
ggagccccccgtaccctctg

SEQ ID NO: 3036 - DNA, 20 bp, human
gtccagcgcgatccactccg

SEQ ID NO: 3037 - DNA, 20 bp, human
ggatccactccggggcgcag

SEQ ID NO: 3038 - DNA, 20 bp, human
gccggcctcctagcgctccg

SEQ ID NO: 3039 - DNA, 20 bp, human
gagaccgcgaacgtacgggt

SEQ ID NO: 3040 - DNA, 20 bp, human
ggccgcgggagcgcagtatg

SEQ ID NO: 3041 - DNA, 20 bp, human
ggcctccccggagcgctagg

SEQ ID NO: 3042 - DNA, 20 bp, human
ggccccggagtggatcgcgc

SEQ ID NO: 3043 - DNA, 20 bp, human
gtgcgccgggcgagaagccg

SEQ ID NO: 3044 - DNA, 20 bp, human
ggaaccccagctggtaaagg

SEQ ID NO: 3045 - DNA, 20 bp, human
gaaaggaagcgagaaagtca

SEQ ID NO: 3046 - DNA, 20 bp, human
ggccgcccagcccacatctg

SEQ ID NO: 3047 - DNA, 20 bp, human
gccgcagctgcagcaccgca

SEQ ID NO: 3048 - DNA, 20 bp, human
gcccggcccaaggcgctcgg

SEQ ID NO: 3049 - DNA, 20 bp, human
ggcgtcgtccagcctgactt

SEQ ID NO: 3050 - DNA, 20 bp, human
gcgccgccgaccccccaggt

SEQ ID NO: 3051 - DNA, 20 bp, human
gggcccaaggcgctcggggg

SEQ ID NO: 3052 - DNA, 20 bp, human
ggggagcctcggagcactgg

SEQ ID NO: 3053 - DNA, 20 bp, human
gctgcccccagatgtgggct

SEQ ID NO: 3054 - DNA, 20 bp, human
gaccaacccggccccgaagt

SEQ ID NO: 3055 - DNA, 20 bp, human
ggccccctgcgcgaccaacc

SEQ ID NO: 3056 - DNA, 20 bp, human
gtgcaggtcgcggggacgag

SEQ ID NO: 3057 - DNA, 20 bp, human
ggccttcagcggctaagtgg

SEQ ID NO: 3058 - DNA, 20 bp, human
gccccagggtggaaccatgt

SEQ ID NO: 3059 - DNA, 20 bp, human
gcaccgcgagacgccttcag

SEQ ID NO: 3060 - DNA, 20 bp, human
gcctcagaaactctctgctc

SEQ ID NO: 3061 - DNA, 20 bp, human
ggagtttctgagggcagcgc

SEQ ID NO: 3062 - DNA, 20 bp, human
gagggccagcgttccccaac

SEQ ID NO: 3063 - DNA, 20 bp, human
ggagtgggacatgcaggtcg

SEQ ID NO: 3064 - DNA, 20 bp, human
gctgcagtgcgatgaagcag

SEQ ID NO: 3065 - DNA, 20 bp, human
gaccctggggaccccgatcg

SEQ ID NO: 3066 - DNA, 20 bp, human
gggttccccggagcacagca

SEQ ID NO: 3067 - DNA, 20 bp, human
ggttagcgcggagaatgctt

SEQ ID NO: 3068 - DNA, 20 bp, human
gagcgagagagacgagcgag

SEQ ID NO: 3069 - DNA, 20 bp, human
gggagaatgcttgggttccc

SEQ ID NO: 3070 - DNA, 20 bp, human
ggactccgccgcacacgcag

SEQ ID NO: 3071 - DNA, 20 bp, human
ggccgcacacgcagaggtgg

SEQ ID NO: 3072 - DNA, 20 bp, human
ggtcctaacctctaccagag

SEQ ID NO: 3073 - DNA, 20 bp, human
gcgctaaccttagggaccaa

SEQ ID NO: 3074 - DNA, 20 bp, human
gcgagcaccattggtcccta

SEQ ID NO: 3075 - DNA, 20 bp, human
gatagcagccgctctggtag

SEQ ID NO: 3076 - DNA, 20 bp, human
ggagggactgaggccgtcta

SEQ ID NO: 3077 - DNA, 20 bp, human
gaggctggggagaacccaca

SEQ ID NO: 3078 - DNA, 20 bp, human
gtgtctgtgggtctccctgt

SEQ ID NO: 3079 - DNA, 20 bp, human
gtgcgagcctgtctgggaca

SEQ ID NO: 3080 - DNA, 20 bp, human
ggcttgggagaggtgcccag

SEQ ID NO: 3081 - DNA, 20 bp, human
gccagacaggctcgcatccc

SEQ ID NO: 3082 - DNA, 20 bp, human
ggctggcgcggagagaggct

SEQ ID NO: 3083 - DNA, 20 bp, human
gggactcctgccaaggtcag

SEQ ID NO: 3084 - DNA, 20 bp, human
gtggcactggtactgcagct

SEQ ID NO: 3085 - DNA, 20 bp, human
ggacaggctcgcatcccggg

SEQ ID NO: 3086 - DNA, 20 bp, human
ggcccgccgtcatccccagt

SEQ ID NO: 3087 - DNA, 20 bp, human
gcgtgctccagaaagaggtg

SEQ ID NO: 3088 - DNA, 20 bp, human
ggcgctgtgaagatgcgagg

SEQ ID NO: 3089 - DNA, 20 bp, human
gcgctcgcagctgccgactg

SEQ ID NO: 3090 - DNA, 20 bp, human
gagctgccgactggggatga

SEQ ID NO: 3091 - DNA, 20 bp, human
ggccgactggggatgacggc

SEQ ID NO: 3092 - DNA, 20 bp, human
ggtggagattcagcaaatac

SEQ ID NO: 3093 - DNA, 20 bp, human
ggcggcatgccatcctgcaa

SEQ ID NO: 3094 - DNA, 20 bp, human
gcttgtccagcgcagcgcgg

SEQ ID NO: 3095 - DNA, 20 bp, human
gctggacaagccggctgtgg

SEQ ID NO: 3096 - DNA, 20 bp, human
ggggccggtagtgagatcta

SEQ ID NO: 3097 - DNA, 20 bp, human
gacatgtgcagagcatcaaa

SEQ ID NO: 3098 - DNA, 20 bp, human
gtagccctagatctcactac

SEQ ID NO: 3099 - DNA, 20 bp, human
gtggctgcagaataactggc

SEQ ID NO: 3100 - DNA, 20 bp, human
gccgggttagccagaccata

SEQ ID NO: 3101 - DNA, 20 bp, human
gctcctgctgcaattcaagt

SEQ ID NO: 3102 - DNA, 20 bp, human
gcagagcatcaaaaggtatc

SEQ ID NO: 3103 - DNA, 20 bp, human
ggatagcctagatgtattga

SEQ ID NO: 3104 - DNA, 20 bp, human
gctgcaattcaagttggctg

SEQ ID NO: 3105 - DNA, 20 bp, human
gcagacaatagagattgcac

SEQ ID NO: 3106 - DNA, 20 bp, human
gctcggtccgcgggcaacaa

SEQ ID NO: 3107 - DNA, 20 bp, human
ggccggcgcggggtccacaa

SEQ ID NO: 3108 - DNA, 20 bp, human
gggaagacgcgaccaactcc

SEQ ID NO: 3109 - DNA, 20 bp, human
ggggacaaaaccgagactgg

SEQ ID NO: 3110 - DNA, 20 bp, human
ggcgcagccgaacggagtcg

SEQ ID NO: 3111 - DNA, 20 bp, human
ggaccaggcagcgaccggac

SEQ ID NO: 3112 - DNA, 20 bp, human
gacccggccccgactccgtt

SEQ ID NO: 3113 - DNA, 20 bp, human
ggctccgctgtgcctggagt

SEQ ID NO: 3114 - DNA, 20 bp, human
gtcggctgcgctcggtccgc

SEQ ID NO: 3115 - DNA, 20 bp, human
gccccggacccgcaccaggt

SEQ ID NO: 3116 - DNA, 20 bp, human
gcgctgccgggcaaccgcgt

SEQ ID NO: 3117 - DNA, 20 bp, human
gaccccgggaagcaccgagt

SEQ ID NO: 3118 - DNA, 20 bp, human
ggcccactcggtgcttcccg

SEQ ID NO: 3119 - DNA, 20 bp, human
ggcgctaggaagctgtcgtc

SEQ ID NO: 3120 - DNA, 20 bp, human
gcaggagcggaggccaccgg

SEQ ID NO: 3121 - DNA, 20 bp, human
gggcgctcgatcttgaactc

SEQ ID NO: 3122 - DNA, 20 bp, human
gctgctcgcgctcggctcgg

SEQ ID NO: 3123 - DNA, 20 bp, human
ggcgggggcggggagcatgg

SEQ ID NO: 3124 - DNA, 20 bp, human
gcttgccgaaggcggacagg

SEQ ID NO: 3125 - DNA, 20 bp, human
ggcccttgccgaaggcggac

SEQ ID NO: 3126 - DNA, 20 bp, human
gcacggccgccgcggcgtct

SEQ ID NO: 3127 - DNA, 20 bp, human
ggcgtctgggctccccatct

SEQ ID NO: 3128 - DNA, 20 bp, human
gggcggccgtgcgcaaggac

SEQ ID NO: 3129 - DNA, 20 bp, human
gctgcccaggagcgaggacc

SEQ ID NO: 3130 - DNA, 20 bp, human
gcgcataatgcccagcgagc

SEQ ID NO: 3131 - DNA, 20 bp, human
gatggggagcccagacgccg

SEQ ID NO: 3132 - DNA, 20 bp, human
gtaatgcccagcgagcgggc

SEQ ID NO: 3133 - DNA, 20 bp, human
gttgctagggagggacacta

SEQ ID NO: 3134 - DNA, 20 bp, human
ggctggccgggatagctgag

SEQ ID NO: 3135 - DNA, 20 bp, human
gagctatcccggccagcaca

SEQ ID NO: 3136 - DNA, 20 bp, human
gtccttgccggaatcagaat

SEQ ID NO: 3137 - DNA, 20 bp, human
gggagtgttagcaccagtac

SEQ ID NO: 3138 - DNA, 20 bp, human
gctgctgtcacatccagtac

SEQ ID NO: 3139 - DNA, 20 bp, human
ggagctgaggactgtatata

SEQ ID NO: 3140 - DNA, 20 bp, human
gcaacagcacccagactcaa

SEQ ID NO: 3141 - DNA, 20 bp, human
gctgaggactgtatatatgg

SEQ ID NO: 3142 - DNA, 20 bp, human
gagcatggaatgctgccgtc

SEQ ID NO: 3143 - DNA, 20 bp, human
gtccatgcttggatccttgc

SEQ ID NO: 3144 - DNA, 20 bp, human
ggctgccgtcgggcaactcc

SEQ ID NO: 3145 - DNA, 20 bp, human
gtccggcaaggatccaagca

SEQ ID NO: 3146 - DNA, 20 bp, human
gtcccgggaaccccctctct

SEQ ID NO: 3147 - DNA, 20 bp, human
gtccaagagagggggttccc

SEQ ID NO: 3148 - DNA, 20 bp, human
ggtctgcctgacagctataa

SEQ ID NO: 3149 - DNA, 20 bp, human
ggcggctggcggcagcagag

SEQ ID NO: 3150 - DNA, 20 bp, human
gacagagctccgggcgcaca

SEQ ID NO: 3151 - DNA, 20 bp, human
gtgcctgacagctataaagg

SEQ ID NO: 3152 - DNA, 20 bp, human
ggctccgggcgcacaaggct

SEQ ID NO: 3153 - DNA, 20 bp, human
gtgctgacccgaagccaggt

SEQ ID NO: 3154 - DNA, 20 bp, human
gccgctgcttttggacccca

SEQ ID NO: 3155 - DNA, 20 bp, human
ggcccggagctctgtgtgca

SEQ ID NO: 3156 - DNA, 20 bp, human
ggcgcagggcggcccctcag

SEQ ID NO: 3157 - DNA, 20 bp, human
gcaacacctcgtgcggaatc

SEQ ID NO: 3158 - DNA, 20 bp, human
gttccgcacgaggtgttgac

SEQ ID NO: 3159 - DNA, 20 bp, human
gcgcacgaggtgttgacggg

SEQ ID NO: 3160 - DNA, 20 bp, human
gccccagagggagtaagact

SEQ ID NO: 3161 - DNA, 20 bp, human
gattatgggggaactccaca

SEQ ID NO: 3162 - DNA, 20 bp, human
gtggaggccggcgtcgggga

SEQ ID NO: 3163 - DNA, 20 bp, human
gtgccgtcccggaaggttca

SEQ ID NO: 3164 - DNA, 20 bp, human
gctccctgaaccttccggga

SEQ ID NO: 3165 - DNA, 20 bp, human
gccaggaccttccccgacgc

SEQ ID NO: 3166 - DNA, 20 bp, human
ggagcaccctcctagagaga

SEQ ID NO: 3167 - DNA, 20 bp, human
gttgcctggagagagcgcct

SEQ ID NO: 3168 - DNA, 20 bp, human
ggcgcccaggcgctctctcc

SEQ ID NO: 3169 - DNA, 20 bp, human
gctgctctgcgagcccccgg

SEQ ID NO: 3170 - DNA, 20 bp, human
gaggcaacctcgctccgcgg

SEQ ID NO: 3171 - DNA, 20 bp, human
gagggttaacgggccaccgg

SEQ ID NO: 3172 - DNA, 20 bp, human
gctcctgccctctctctagg

SEQ ID NO: 3173 - DNA, 20 bp, human
gtccaggcaacctcgctccg

SEQ ID NO: 3174 - DNA, 20 bp, human
gggccgcgcggggaggtcat

SEQ ID NO: 3175 - DNA, 20 bp, human
gtgggcgcagaagggttaac

SEQ ID NO: 3176 - DNA, 20 bp, human
gccggagaaagtgggaggat

SEQ ID NO: 3177 - DNA, 20 bp, human
gttcccccggagaaagtggg

SEQ ID NO: 3178 - DNA, 20 bp, human
gtaccggctgcgcggagccc

SEQ ID NO: 3179 - DNA, 20 bp, human
ggataggcagatggacttac

SEQ ID NO: 3180 - DNA, 20 bp, human
gggctccctgagcggcccca

SEQ ID NO: 3181 - DNA, 20 bp, human
gctcgccctggggccgctca

SEQ ID NO: 3182 - DNA, 20 bp, human
ggcagggcccattgaggagg

SEQ ID NO: 3183 - DNA, 20 bp, human
gggctctcccctccccgtgt

SEQ ID NO: 3184 - DNA, 20 bp, human
ggtctaggtggtgaaaagtg

SEQ ID NO: 3185 - DNA, 20 bp, human
gagtttcccccggagaaagt

SEQ ID NO: 3186 - DNA, 20 bp, human
gaccgcggcggagacacgag

SEQ ID NO: 3187 - DNA, 20 bp, human
ggcggcggagacacgagcgg

SEQ ID NO: 3188 - DNA, 20 bp, human
ggcggagacacgagcggcgg

SEQ ID NO: 3189 - DNA, 20 bp, human
gccggcccgggaagacgtcc

SEQ ID NO: 3190 - DNA, 20 bp, human
gccagagggcggcgggaatg

SEQ ID NO: 3191 - DNA, 20 bp, human
ggcccctgcgccatcccggg

SEQ ID NO: 3192 - DNA, 20 bp, human
ggctgaacaccgggccggat

SEQ ID NO: 3193 - DNA, 20 bp, human
gccggatcggcgctcggatg

SEQ ID NO: 3194 - DNA, 20 bp, human
ggggtggcggcgctgaacac

SEQ ID NO: 3195 - DNA, 20 bp, human
ggcggcgctgaacaccgggc

SEQ ID NO: 3196 - DNA, 20 bp, human
ggaagagagcgggactggaa

SEQ ID NO: 3197 - DNA, 20 bp, human
gggcggagcgcacgggccat

SEQ ID NO: 3198 - DNA, 20 bp, human
gtgtccgggtccaagcacgt

SEQ ID NO: 3199 - DNA, 20 bp, human
gtggacccggacacgagagc

SEQ ID NO: 3200 - DNA, 20 bp, human
ggcagagcctgggctcgtag

SEQ ID NO: 3201 - DNA, 20 bp, human
ggccggcccggcgggctcag

SEQ ID NO: 3202 - DNA, 20 bp, human
gtcgcgagcgcaacaagaag

SEQ ID NO: 3203 - DNA, 20 bp, human
gagcccgccgggccggccat

SEQ ID NO: 3204 - DNA, 20 bp, human
gcctggccagggaagagagc

SEQ ID NO: 3205 - DNA, 20 bp, human
gccagggaagagagcgggac

SEQ ID NO: 3206 - DNA, 20 bp, human
gctgcgcgccgggcccaaga

SEQ ID NO: 3207 - DNA, 20 bp, human
gcgcactggaagtggccccg

SEQ ID NO: 3208 - DNA, 20 bp, human
gtcggcacgggaaactccgc

SEQ ID NO: 3209 - DNA, 20 bp, human
gggaagtggccccggggcgt

SEQ ID NO: 3210 - DNA, 20 bp, human
gattgaaccggagccatctt

SEQ ID NO: 3211 - DNA, 20 bp, human
ggccgggcccaagatggctc

SEQ ID NO: 3212 - DNA, 20 bp, human
gcgcgggcgcaatgaatccg

SEQ ID NO: 3213 - DNA, 20 bp, human
gcgctactccgcactggaag

SEQ ID NO: 3214 - DNA, 20 bp, human
gtgtaaacgaacccagacgg

SEQ ID NO: 3215 - DNA, 20 bp, human
gttcccgtgccgacgccccg

SEQ ID NO: 3216 - DNA, 20 bp, human
gggtagagaaggctacgtgg

SEQ ID NO: 3217 - DNA, 20 bp, human
gtcccgactgaaggtagaga

SEQ ID NO: 3218 - DNA, 20 bp, human
ggccggcgagagggaaacaa

SEQ ID NO: 3219 - DNA, 20 bp, human
ggaaggtagagaaggctacg

SEQ ID NO: 3220 - DNA, 20 bp, human
gaccttcagtcgggaatcaa

SEQ ID NO: 3221 - DNA, 20 bp, human
gagagaaggctacgtggtgg

SEQ ID NO: 3222 - DNA, 20 bp, human
ggccttctctaccttcagtc

SEQ ID NO: 3223 - DNA, 20 bp, human
gcagtcgggaatcaatggtc

SEQ ID NO: 3224 - DNA, 20 bp, human
ggtgtagccgagaaggacag

SEQ ID NO: 3225 - DNA, 20 bp, human
ggtggggacgcagctggtag

SEQ ID NO: 3226 - DNA, 20 bp, human
ggcagacgggcgacccagga

SEQ ID NO: 3227 - DNA, 20 bp, human
ggccgagcgccggagcagac

SEQ ID NO: 3228 - DNA, 20 bp, human
gtctcccggagtctacagtg

SEQ ID NO: 3229 - DNA, 20 bp, human
gagtctacagtgaggatgac

SEQ ID NO: 3230 - DNA, 20 bp, human
gtgtagactccgggagaacc

SEQ ID NO: 3231 - DNA, 20 bp, human
ggccccgcgtcccctcccga

SEQ ID NO: 3232 - DNA, 20 bp, human
ggcctcgcacccaccctcct

SEQ ID NO: 3233 - DNA, 20 bp, human
ggctgcggctgaggtgaggg

SEQ ID NO: 3234 - DNA, 20 bp, human
ggtgcggactaaacaggaga

SEQ ID NO: 3235 - DNA, 20 bp, human
gcggagcagacgggcgaccc

SEQ ID NO: 3236 - DNA, 20 bp, human
gggtgccaaacaactagcag

SEQ ID NO: 3237 - DNA, 20 bp, human
gcaaatgcaagtccaagagg

SEQ ID NO: 3238 - DNA, 20 bp, human
ggaggttgcaaacccgggag

SEQ ID NO: 3239 - DNA, 20 bp, human
gggcggaggtccaagcggaa

SEQ ID NO: 3240 - DNA, 20 bp, human
ggaggaggcggaggtccaag

SEQ ID NO: 3241 - DNA, 20 bp, human
gagcccggagaccccatgag

SEQ ID NO: 3242 - DNA, 20 bp, human
gagcttgaggttgcaaaccc

SEQ ID NO: 3243 - DNA, 20 bp, human
gctgggctcccagcgcaggg

SEQ ID NO: 3244 - DNA, 20 bp, human
ggagaccccatgagaggccg

SEQ ID NO: 3245 - DNA, 20 bp, human
gaggtccaagcggaaaggta

SEQ ID NO: 3246 - DNA, 20 bp, human
gtcggctgccaggggagaaa

SEQ ID NO: 3247 - DNA, 20 bp, human
gcgtttcctgaaggtgggag

SEQ ID NO: 3248 - DNA, 20 bp, human
gtggcagccgcaggacccaa

SEQ ID NO: 3249 - DNA, 20 bp, human
ggtcacgtccgccttaccgg

SEQ ID NO: 3250 - DNA, 20 bp, human
gaaaggaagtcggctgccag

SEQ ID NO: 3251 - DNA, 20 bp, human
gtcagcgatgcttggaggaa

SEQ ID NO: 3252 - DNA, 20 bp, human
gcgacggggcaggtttatcc

SEQ ID NO: 3253 - DNA, 20 bp, human
gttctaggcgcgtttcctga

SEQ ID NO: 3254 - DNA, 20 bp, human
gaggcttcagcgatgcttgg

SEQ ID NO: 3255 - DNA, 20 bp, human
gcgagcttaatccgccggta

SEQ ID NO: 3256 - DNA, 20 bp, human
gtggctgggtatggaggcga

SEQ ID NO: 3257 - DNA, 20 bp, human
gctgggtatggaggcgaagg

SEQ ID NO: 3258 - DNA, 20 bp, human
gcactcagctacagagcccg

SEQ ID NO: 3259 - DNA, 20 bp, human
gagagtgtgtgaccacagaa

SEQ ID NO: 3260 - DNA, 20 bp, human
gagcggcgcgtgctcggtgt

SEQ ID NO: 3261 - DNA, 20 bp, human
ggagcgcgggcagcggaacg

SEQ ID NO: 3262 - DNA, 20 bp, human
ggtggctctgggcgaaggaa

SEQ ID NO: 3263 - DNA, 20 bp, human
gccagagccactgtgagaat

SEQ ID NO: 3264 - DNA, 20 bp, human
gccagccctcaacccgaccc

SEQ ID NO: 3265 - DNA, 20 bp, human
gtctgctggacatgttccaa

SEQ ID NO: 3266 - DNA, 20 bp, human
gtggagaacccgagacctcg

SEQ ID NO: 3267 - DNA, 20 bp, human
ggcgcttacctgagggatcc

SEQ ID NO: 3268 - DNA, 20 bp, human
ggctcgcgcccggatccctc

SEQ ID NO: 3269 - DNA, 20 bp, human
ggggccgcgcgcttacctga

SEQ ID NO: 3270 - DNA, 20 bp, human
gcgggccggttgctaagact

SEQ ID NO: 3271 - DNA, 20 bp, human
gtcgcgagagcgcggttcag

SEQ ID NO: 3272 - DNA, 20 bp, human
ggactgcgggacatgacctg

SEQ ID NO: 3273 - DNA, 20 bp, human
gctggggaggaaggacgcga

SEQ ID NO: 3274 - DNA, 20 bp, human
gtaaaggcgaatcagagctg

SEQ ID NO: 3275 - DNA, 20 bp, human
ggaagcagctggaggatacg

SEQ ID NO: 3276 - DNA, 20 bp, human
gaacaaacgacccagagagg

SEQ ID NO: 3277 - DNA, 20 bp, human
gcggcagctgcctcctctct

SEQ ID NO: 3278 - DNA, 20 bp, human
ggaccaggcagtgcatgtcg

SEQ ID NO: 3279 - DNA, 20 bp, human
gcatctgtggggcgccccgg

SEQ ID NO: 3280 - DNA, 20 bp, human
gggcccgccgcgcccttgga

SEQ ID NO: 3281 - DNA, 20 bp, human
gcagaggttgtactcttgga

SEQ ID NO: 3282 - DNA, 20 bp, human
ggcagctgccgggacactgc

SEQ ID NO: 3283 - DNA, 20 bp, human
gaaaaacaaacgacccagag

SEQ ID NO: 3284 - DNA, 20 bp, human
gactcttggagggacaagcg

SEQ ID NO: 3285 - DNA, 20 bp, human
gcagcagccagtggaactcc

SEQ ID NO: 3286 - DNA, 20 bp, human
ggcccggggaagcgagagag

SEQ ID NO: 3287 - DNA, 20 bp, human
gcggggaagcgagagagcgg

SEQ ID NO: 3288 - DNA, 20 bp, human
gcgaggcctctgctgacagg

SEQ ID NO: 3289 - DNA, 20 bp, human
gcggcccataggtctcccca

SEQ ID NO: 3290 - DNA, 20 bp, human
gagggagtgaatcggatcct

SEQ ID NO: 3291 - DNA, 20 bp, human
gcttgtgcaacaccccgagg

SEQ ID NO: 3292 - DNA, 20 bp, human
ggtctccccagggagtgaat

SEQ ID NO: 3293 - DNA, 20 bp, human
ggggaggcaggtcagcacca

SEQ ID NO: 3294 - DNA, 20 bp, human
gaggcaggtcagcaccaggg

SEQ ID NO: 3295 - DNA, 20 bp, human
gagccgaggcctctgctgac

SEQ ID NO: 3296 - DNA, 20 bp, human
gggtggccctgtgagttccg

SEQ ID NO: 3297 - DNA, 20 bp, human
gcttccctcggggtgagtag

SEQ ID NO: 3298 - DNA, 20 bp, human
ggtcttgcaggcacccgagt

SEQ ID NO: 3299 - DNA, 20 bp, human
ggctgcccctactcaccccg

SEQ ID NO: 3300 - DNA, 20 bp, human
gccgcggctctgcttccctc

SEQ ID NO: 3301 - DNA, 20 bp, human
ggtggtctgggcaagagcag

SEQ ID NO: 3302 - DNA, 20 bp, human
gagacgccttcaccccctgg

SEQ ID NO: 3303 - DNA, 20 bp, human
gcttctgcctcggaactcac

SEQ ID NO: 3304 - DNA, 20 bp, human
gtgtgacctgtccacttcag

SEQ ID NO: 3305 - DNA, 20 bp, human
gtccggccgcaacccggtag

SEQ ID NO: 3306 - DNA, 20 bp, human
gggccagtatgagatcgctg

SEQ ID NO: 3307 - DNA, 20 bp, human
gtgcgacaggcaaaccctga

SEQ ID NO: 3308 - DNA, 20 bp, human
gccctggcgcgtctccgtca

SEQ ID NO: 3309 - DNA, 20 bp, human
gcccgagcgggacctctggg

SEQ ID NO: 3310 - DNA, 20 bp, human
gggcccgccctccacttcag

SEQ ID NO: 3311 - DNA, 20 bp, human
gcgggcgcctctgaagtgga

SEQ ID NO: 3312 - DNA, 20 bp, human
gggtgcttcgagctcagaca

SEQ ID NO: 3313 - DNA, 20 bp, human
gagggtcaccgtgcgcccag

SEQ ID NO: 3314 - DNA, 20 bp, human
ggcagagcctggcatcgcga

SEQ ID NO: 3315 - DNA, 20 bp, human
ggcactcggagggcctcagg

SEQ ID NO: 3316 - DNA, 20 bp, human
gcggcagcgggaaggcggtc

SEQ ID NO: 3317 - DNA, 20 bp, human
gggcggctagaaggtgaccg

SEQ ID NO: 3318 - DNA, 20 bp, human
gcgcggtggccagcgcgcag

SEQ ID NO: 3319 - DNA, 20 bp, human
gcccactgcgtccggacctg

SEQ ID NO: 3320 - DNA, 20 bp, human
gcagcgcgcagaggcgggcg

SEQ ID NO: 3321 - DNA, 20 bp, human
ggcgagttggtaaacagatc

SEQ ID NO: 3322 - DNA, 20 bp, human
gtggccgcgagcctcaggtc

SEQ ID NO: 3323 - DNA, 20 bp, human
gtacctggctgcaggaagct

SEQ ID NO: 3324 - DNA, 20 bp, human
gcagatccggagcgcgtggc

SEQ ID NO: 3325 - DNA, 20 bp, human
gggcgggtggcagccttacc

SEQ ID NO: 3326 - DNA, 20 bp, human
ggcggccaggtatgcatcta

SEQ ID NO: 3327 - DNA, 20 bp, human
gggtgccctagatgcatacc

SEQ ID NO: 3328 - DNA, 20 bp, human
gccgcgcttcggatgctcag

SEQ ID NO: 3329 - DNA, 20 bp, human
ggagggtggtttagtcacag

SEQ ID NO: 3330 - DNA, 20 bp, human
gagctgcaagcaaagggtag

SEQ ID NO: 3331 - DNA, 20 bp, human
gctgaacaatagggatgcca

SEQ ID NO: 3332 - DNA, 20 bp, human
gtgcatacctggccgcgctt

SEQ ID NO: 3333 - DNA, 20 bp, human
gtctccaaggctgaacaata

SEQ ID NO: 3334 - DNA, 20 bp, human
ggccccgtagctgcaagcaa

SEQ ID NO: 3335 - DNA, 20 bp, human
gaaagacttggagttcccac

SEQ ID NO: 3336 - DNA, 20 bp, human
ggggccgggagagtcctcac

SEQ ID NO: 3337 - DNA, 20 bp, human
ggctaagtgacagggaccaa

SEQ ID NO: 3338 - DNA, 20 bp, human
gggagcagtggtcggagatg

SEQ ID NO: 3339 - DNA, 20 bp, human
gagaagagcggagcagtggt

SEQ ID NO: 3340 - DNA, 20 bp, human
gcctgggaaggtctccccat

SEQ ID NO: 3341 - DNA, 20 bp, human
gcacagtagctgaaagtggg

SEQ ID NO: 3342 - DNA, 20 bp, human
ggtcatcttggccctcacac

SEQ ID NO: 3343 - DNA, 20 bp, human
gcccggtgcaggcggcgtca

SEQ ID NO: 3344 - DNA, 20 bp, human
gggagatgtggcgaccggtg

SEQ ID NO: 3345 - DNA, 20 bp, human
gtgggctgcgagacgctaag

SEQ ID NO: 3346 - DNA, 20 bp, human
ggaacagcgcctccagctct

SEQ ID NO: 3347 - DNA, 20 bp, human
gagcaaggcataggacacga

SEQ ID NO: 3348 - DNA, 20 bp, human
gtggccagcaggctgcgcac

SEQ ID NO: 3349 - DNA, 20 bp, human
gggaagaggacgcagtgcac

SEQ ID NO: 3350 - DNA, 20 bp, human
ggccagcgaccgccgaacaa

SEQ ID NO: 3351 - DNA, 20 bp, human
gtaccgtcctccagagacgt

SEQ ID NO: 3352 - DNA, 20 bp, human
ggcggccccggcggaacccc

SEQ ID NO: 3353 - DNA, 20 bp, human
gagctggaggcgctgttccg

SEQ ID NO: 3354 - DNA, 20 bp, human
gcgcacgggcagcaaggcat

SEQ ID NO: 3355 - DNA, 20 bp, human
gcccggcgcgcccagcagct

SEQ ID NO: 3356 - DNA, 20 bp, human
gggtcagctatagacagaca

SEQ ID NO: 3357 - DNA, 20 bp, human
gagagcccccttcaagaggt

SEQ ID NO: 3358 - DNA, 20 bp, human
gtgccagagcccccttcaag

SEQ ID NO: 3359 - DNA, 20 bp, human
gatgtaagggactgacacag

SEQ ID NO: 3360 - DNA, 20 bp, human
gccttcaagaggtaggcact

SEQ ID NO: 3361 - DNA, 20 bp, human
gttgttgactgataaaaagg

SEQ ID NO: 3362 - DNA, 20 bp, human
gcatccaggttgagaaggtg

SEQ ID NO: 3363 - DNA, 20 bp, human
gctagtccctaactgaggtc

SEQ ID NO: 3364 - DNA, 20 bp, human
gaagacctagtccctaactg

SEQ ID NO: 3365 - DNA, 20 bp, human
gcatacctccacttcatcca

SEQ ID NO: 3366 - DNA, 20 bp, human
gcctgtgagcggccccgatg

SEQ ID NO: 3367 - DNA, 20 bp, human
gtcctgctgctcatcgtcat

SEQ ID NO: 3368 - DNA, 20 bp, human
gagcccgagcgcgaagaaga

SEQ ID NO: 3369 - DNA, 20 bp, human
ggctggccgggctcctctca

SEQ ID NO: 3370 - DNA, 20 bp, human
ggcagcaggaagacgatgag

SEQ ID NO: 3371 - DNA, 20 bp, human
gctgcgggaccgctccgagg

SEQ ID NO: 3372 - DNA, 20 bp, human
gggagcggtcccgcaggtag

SEQ ID NO: 3373 - DNA, 20 bp, human
ggatgtggcaggaggcgatg

SEQ ID NO: 3374 - DNA, 20 bp, human
gctggtgagtggcctccccg

SEQ ID NO: 3375 - DNA, 20 bp, human
gagagccagtcccgggaccg

SEQ ID NO: 3376 - DNA, 20 bp, human
gagccgagccagccgagtcc

SEQ ID NO: 3377 - DNA, 20 bp, human
gtcaggcccgggatccgacc

SEQ ID NO: 3378 - DNA, 20 bp, human
gccctggggctgaggctcag

SEQ ID NO: 3379 - DNA, 20 bp, human
gggcgcccgcggatgctgag

SEQ ID NO: 3380 - DNA, 20 bp, human
gagccagccgagtccgggct

SEQ ID NO: 3381 - DNA, 20 bp, human
gcggatcccgggcctgacgg

SEQ ID NO: 3382 - DNA, 20 bp, human
gcgagggctgggagatccgt

SEQ ID NO: 3383 - DNA, 20 bp, human
ggccctgcgcctctcccggt

SEQ ID NO: 3384 - DNA, 20 bp, human
ggagagctcggcgcgcccga

SEQ ID NO: 3385 - DNA, 20 bp, human
ggcccagcgcgcccgccctg

SEQ ID NO: 3386 - DNA, 20 bp, human
gcagcggagtgggctaggtc

SEQ ID NO: 3387 - DNA, 20 bp, human
gggcgctggcgcagcggagt

SEQ ID NO: 3388 - DNA, 20 bp, human
ggagtgggctaggtccgggg

SEQ ID NO: 3389 - DNA, 20 bp, human
gcgggccgaaggaggtaacc

SEQ ID NO: 3390 - DNA, 20 bp, human
ggctcccagctggcgatgag

SEQ ID NO: 3391 - DNA, 20 bp, human
ggactccgccatcaggtccc

SEQ ID NO: 3392 - DNA, 20 bp, human
gaggaggaggaaaggactga

SEQ ID NO: 3393 - DNA, 20 bp, human
ggggcggccgggggctgaag

SEQ ID NO: 3394 - DNA, 20 bp, human
gcgctctggctcagagtccc

SEQ ID NO: 3395 - DNA, 20 bp, human
gagaagaggtcttcgctggg

SEQ ID NO: 3396 - DNA, 20 bp, human
gcggccggcgcggaacgact

SEQ ID NO: 3397 - DNA, 20 bp, human
gctgcgtcggggcagaaccg

SEQ ID NO: 3398 - DNA, 20 bp, human
ggatgcggagggctctccgg

SEQ ID NO: 3399 - DNA, 20 bp, human
gggcggcgagcgggcgagaa

SEQ ID NO: 3400 - DNA, 20 bp, human
gccggcgcggaacgactagg

SEQ ID NO: 3401 - DNA, 20 bp, human
gcggggtccgggtcagggac

SEQ ID NO: 3402 - DNA, 20 bp, human
gaagggaggagcggcgcgag

SEQ ID NO: 3403 - DNA, 20 bp, human
gcaggagccggtccctgacc

SEQ ID NO: 3404 - DNA, 20 bp, human
ggcagggcccgaagcgtgca

SEQ ID NO: 3405 - DNA, 20 bp, human
gcgcaggcaggcttctcccg

SEQ ID NO: 3406 - DNA, 20 bp, human
gcccggaggccaggaggatc

SEQ ID NO: 3407 - DNA, 20 bp, human
ggaactcgccccgtggaggg

SEQ ID NO: 3408 - DNA, 20 bp, human
gctggaactcgccccgtgga

SEQ ID NO: 3409 - DNA, 20 bp, human
gtgcgctggacagctcggga

SEQ ID NO: 3410 - DNA, 20 bp, human
gcagcctggaactcgccccg

SEQ ID NO: 3411 - DNA, 20 bp, human
ggatcgaggactcctaggtc

SEQ ID NO: 3412 - DNA, 20 bp, human
gggattggaacgcacccgag

SEQ ID NO: 3413 - DNA, 20 bp, human
gaggatctggcacgtactgg

SEQ ID NO: 3414 - DNA, 20 bp, human
gagtgggatcgaggactcct

SEQ ID NO: 3415 - DNA, 20 bp, human
gcgggacggccaggacgcgc

SEQ ID NO: 3416 - DNA, 20 bp, human
gcccaggctcacccatccga

SEQ ID NO: 3417 - DNA, 20 bp, human
gcctgggcgcgtctgaggaa

SEQ ID NO: 3418 - DNA, 20 bp, human
ggtggaaggagccttcggat

SEQ ID NO: 3419 - DNA, 20 bp, human
ggtgagcctgggcgcgtctg

SEQ ID NO: 3420 - DNA, 20 bp, human
ggtagcgtggaaggagcctt

SEQ ID NO: 3421 - DNA, 20 bp, human
gacggggctggacagtgggt

SEQ ID NO: 3422 - DNA, 20 bp, human
ggatgtgactcactctcatt

SEQ ID NO: 3423 - DNA, 20 bp, human
gtctcattaggtagcgtgga

SEQ ID NO: 3424 - DNA, 20 bp, human
gacaccctcgagaaggagtg

SEQ ID NO: 3425 - DNA, 20 bp, human
ggcctggcctgggagtgcac

SEQ ID NO: 3426 - DNA, 20 bp, human
gcctggccggcggtgaccgg

SEQ ID NO: 3427 - DNA, 20 bp, human
gggtgaccggcggcagcgat

SEQ ID NO: 3428 - DNA, 20 bp, human
ggcgcagcttgggtacgcag

SEQ ID NO: 3429 - DNA, 20 bp, human
gcctgcagccgcggagcagt

SEQ ID NO: 3430 - DNA, 20 bp, human
ggcgcagggctcctgcaacg

SEQ ID NO: 3431 - DNA, 20 bp, human
gtacagggagccctagcgca

SEQ ID NO: 3432 - DNA, 20 bp, human
gggggttcctaaagactcaa

SEQ ID NO: 3433 - DNA, 20 bp, human
gaagggcacctggaagatcg

SEQ ID NO: 3434 - DNA, 20 bp, human
gcgctgccgccggtcaccgc

SEQ ID NO: 3435 - DNA, 20 bp, human
gcgcaatggagttctccgaa

SEQ ID NO: 3436 - DNA, 20 bp, human
gcgcggccgctgcctcatgt

SEQ ID NO: 3437 - DNA, 20 bp, human
ggcgcgtctgtcagtgacag

SEQ ID NO: 3438 - DNA, 20 bp, human
gcggcagctcttccgacatg

SEQ ID NO: 3439 - DNA, 20 bp, human
ggaccgagcgcgtggaacca

SEQ ID NO: 3440 - DNA, 20 bp, human
ggacccggagcagcgagctt

SEQ ID NO: 3441 - DNA, 20 bp, human
ggagcggcggcgcactcggg

SEQ ID NO: 3442 - DNA, 20 bp, human
gctgtcagtgacagcgggcg

SEQ ID NO: 3443 - DNA, 20 bp, human
gcgctccgatgcgtcaaagg

SEQ ID NO: 3444 - DNA, 20 bp, human
gctcttccgacatgaggcag

SEQ ID NO: 3445 - DNA, 20 bp, human
gcggagcagcgagcttcggc

SEQ ID NO: 3446 - DNA, 20 bp, human
ggaagggggcgcagagagag

SEQ ID NO: 3447 - DNA, 20 bp, human
gaccaggagggagcgtgaca

SEQ ID NO: 3448 - DNA, 20 bp, human
gtggcccgcggctcctacaa

SEQ ID NO: 3449 - DNA, 20 bp, human
ggctggagtcaccacccgag

SEQ ID NO: 3450 - DNA, 20 bp, human
gtggccgtaagtccacccgg

SEQ ID NO: 3451 - DNA, 20 bp, human
ggcagaagccgcagcttcag

SEQ ID NO: 3452 - DNA, 20 bp, human
gaggcagatgttgacaaaga

SEQ ID NO: 3453 - DNA, 20 bp, human
ggtacttaaaggcaacaggc

SEQ ID NO: 3454 - DNA, 20 bp, human
gtagacgcgcagaaccagga

SEQ ID NO: 3455 - DNA, 20 bp, human
ggaggcagccggagagacct

SEQ ID NO: 3456 - DNA, 20 bp, human
gagacggccgaggcgtggag

SEQ ID NO: 3457 - DNA, 20 bp, human
gagaccgccaagccagagga

SEQ ID NO: 3458 - DNA, 20 bp, human
gctgggcgaaggttctggag

SEQ ID NO: 3459 - DNA, 20 bp, human
gccccgcagtgagcaggtaa

SEQ ID NO: 3460 - DNA, 20 bp, human
ggccctcgcccgctctccgt

SEQ ID NO: 3461 - DNA, 20 bp, human
gaggaggggatccgaggtcc

SEQ ID NO: 3462 - DNA, 20 bp, human
gacgcgcaggaagggcgcag

SEQ ID NO: 3463 - DNA, 20 bp, human
ggctaggtcgacccccaccc

SEQ ID NO: 3464 - DNA, 20 bp, human
gtctccgtcggtggaggtcg

SEQ ID NO: 3465 - DNA, 20 bp, human
gcggcgcctctcccgcagga

SEQ ID NO: 3466 - DNA, 20 bp, human
gcaagccggccaggaacgag

SEQ ID NO: 3467 - DNA, 20 bp, human
gtcatcgggataggaccccg

SEQ ID NO: 3468 - DNA, 20 bp, human
gcgcaggccgcacccaggtc

SEQ ID NO: 3469 - DNA, 20 bp, human
gcggagccggagccgacggg

SEQ ID NO: 3470 - DNA, 20 bp, human
gcacccaggtcgggcggtgg

SEQ ID NO: 3471 - DNA, 20 bp, human
gaggccgcacccaggtcggg

SEQ ID NO: 3472 - DNA, 20 bp, human
gcacctcagaagcgaatcgt

SEQ ID NO: 3473 - DNA, 20 bp, human
gagccggagccggagccgac

SEQ ID NO: 3474 - DNA, 20 bp, human
ggccggcttgtgggctgcag

SEQ ID NO: 3475 - DNA, 20 bp, human
gaggtgaggctagctagcgg

SEQ ID NO: 3476 - DNA, 20 bp, human
gcagggctgtgagggactag

SEQ ID NO: 3477 - DNA, 20 bp, human
gcccagcctcgtgcgggaaa

SEQ ID NO: 3478 - DNA, 20 bp, human
gaacacaccgctgccggcca

SEQ ID NO: 3479 - DNA, 20 bp, human
gcgagcgcgggctgcagcat

SEQ ID NO: 3480 - DNA, 20 bp, human
ggatgccgcgcaggaggtaa

SEQ ID NO: 3481 - DNA, 20 bp, human
ggcccggccgagggatgcca

SEQ ID NO: 3482 - DNA, 20 bp, human
gccaggagaccagcgacccc

SEQ ID NO: 3483 - DNA, 20 bp, human
gcaacagacgcgccccacct

SEQ ID NO: 3484 - DNA, 20 bp, human
ggaaatggctttaattctga

SEQ ID NO: 3485 - DNA, 20 bp, human
gaccctggcatccctcggcc

SEQ ID NO: 3486 - DNA, 20 bp, human
gcgcagagccccagagggta

SEQ ID NO: 3487 - DNA, 20 bp, human
ggcgagccgccagcccgtaa

SEQ ID NO: 3488 - DNA, 20 bp, human
gtaacggtcgccagtgtgag

SEQ ID NO: 3489 - DNA, 20 bp, human
ggccagtgtgaggggcggga

SEQ ID NO: 3490 - DNA, 20 bp, human
gaagcgtcgggcccacccgg

SEQ ID NO: 3491 - DNA, 20 bp, human
gggccaaggggacttctcat

SEQ ID NO: 3492 - DNA, 20 bp, human
gccggaaaagggttcacctg

SEQ ID NO: 3493 - DNA, 20 bp, human
ggccgcagcggcggatccgg

SEQ ID NO: 3494 - DNA, 20 bp, human
gccgcaggtacgctcccctc

SEQ ID NO: 3495 - DNA, 20 bp, human
gcggctgccgagaaggaggg

SEQ ID NO: 3496 - DNA, 20 bp, human
ggcagaagccgatctatgta

SEQ ID NO: 3497 - DNA, 20 bp, human
gcctgcagcaaactgtgcca

SEQ ID NO: 3498 - DNA, 20 bp, human
gctatgaagaagaggagggg

SEQ ID NO: 3499 - DNA, 20 bp, human
gcccaaagcaagaaaatcag

SEQ ID NO: 3500 - DNA, 20 bp, human
gtcttcttcatagccctctc

SEQ ID NO: 3501 - DNA, 20 bp, human
gttgggtgttcagctcccat

SEQ ID NO: 3502 - DNA, 20 bp, human
gaactagtggtgaggtcgag

SEQ ID NO: 3503 - DNA, 20 bp, human
ggatgagagcgagcacctcc

SEQ ID NO: 3504 - DNA, 20 bp, human
gtctcctggcaacgcagacg

SEQ ID NO: 3505 - DNA, 20 bp, human
gctctttcttaggaaagcta

SEQ ID NO: 3506 - DNA, 20 bp, human
gggagactggtgagtccttg

SEQ ID NO: 3507 - DNA, 20 bp, human
gtaaagcaggtgtattgcat

SEQ ID NO: 3508 - DNA, 20 bp, human
gtgctttatgcacttgagca

SEQ ID NO: 3509 - DNA, 20 bp, human
gaccgcaaatgtctttaatg

SEQ ID NO: 3510 - DNA, 20 bp, human
gtagtaatacatttaaatta

SEQ ID NO: 3511 - DNA, 20 bp, human
gtgaaagacatttctaactt

SEQ ID NO: 3512 - DNA, 20 bp, human
gagaagttttctttatatta

SEQ ID NO: 3513 - DNA, 20 bp, human
gcccacattaaagacatttg

SEQ ID NO: 3514 - DNA, 20 bp, human
gagcagggaagaaatccaca

SEQ ID NO: 3515 - DNA, 20 bp, human
gtctgtcttctctgcagacc

SEQ ID NO: 3516 - DNA, 20 bp, human
gacaaagactcacagtctgc

SEQ ID NO: 3517 - DNA, 20 bp, human
gctgacagaagtttgatgag

SEQ ID NO: 3518 - DNA, 20 bp, human
gtaataacacatttgaatta

SEQ ID NO: 3519 - DNA, 20 bp, human
gttctatacattcctgttaa

SEQ ID NO: 3520 - DNA, 20 bp, human
gcagtatacattacatattg

SEQ ID NO: 3521 - DNA, 20 bp, human
gattcttaagtacctttaac

SEQ ID NO: 3522 - DNA, 20 bp, human
gaagactcacagtctgctgg

SEQ ID NO: 3523 - DNA, 20 bp, human
gaagttagaaaagtctttaa

SEQ ID NO: 3524 - DNA, 20 bp, human
gaataaagactaatagacac

SEQ ID NO: 3525 - DNA, 20 bp, human
gtcatcaatataacaaagaa

SEQ ID NO: 3526 - DNA, 20 bp, human
gggaggctggtgagtacttg

SEQ ID NO: 3527 - DNA, 20 bp, human
gtaaagcaggtatgttgcac

SEQ ID NO: 3528 - DNA, 20 bp, human
gggaataaactatcacttta

SEQ ID NO: 3529 - DNA, 20 bp, human
gtaaagacttttctaacttt

SEQ ID NO: 3530 - DNA, 20 bp, human
gtaaattagaaatgatacac

SEQ ID NO: 3531 - DNA, 20 bp, human
ggtcttctctgcagaccagg

SEQ ID NO: 3532 - DNA, 20 bp, human
gctgcttgagtgcataaagc

SEQ ID NO: 3533 - DNA, 20 bp, human
gtctgtcttctctgcagacc

SEQ ID NO: 3534 - DNA, 20 bp, human
gcggcaaatttatttaatgt

SEQ ID NO: 3535 - DNA, 20 bp, human
ggaatcaatatgagcacagc

SEQ ID NO: 3536 - DNA, 20 bp, human
ggacacggaactccctgggt

SEQ ID NO: 3537 - DNA, 20 bp, human
gataggacacggaactccct

SEQ ID NO: 3538 - DNA, 20 bp, human
ggacagctcattataggaca

SEQ ID NO: 3539 - DNA, 20 bp, human
ggaataaattcctggcatag

SEQ ID NO: 3540 - DNA, 20 bp, human
gttcaaagacagctcattat

SEQ ID NO: 3541 - DNA, 20 bp, human
gcaaagaaaaatgggcacca

SEQ ID NO: 3542 - DNA, 20 bp, human
gtgcatcaaaagcataaagt

SEQ ID NO: 3543 - DNA, 20 bp, human
gaagcttcaaactcctaccc

SEQ ID NO: 3544 - DNA, 20 bp, human
gggacaatgtatcttatttg

SEQ ID NO: 3545 - DNA, 20 bp, human
gtatgagtgacccctatgcc

SEQ ID NO: 3546 - DNA, 20 bp, human
gcccagcgagcggctcagag

SEQ ID NO: 3547 - DNA, 20 bp, human
gcgaggtagggcccgttgag

SEQ ID NO: 3548 - DNA, 20 bp, human
gctcagggccctccgctcaa

SEQ ID NO: 3549 - DNA, 20 bp, human
ggggccctgagtccaaggga

SEQ ID NO: 3550 - DNA, 20 bp, human
gtccgtgaacatggcgaacg

SEQ ID NO: 3551 - DNA, 20 bp, human
ggaacatggcgaacgaggta

SEQ ID NO: 3552 - DNA, 20 bp, human
gggtagggcccgttgagcgg

SEQ ID NO: 3553 - DNA, 20 bp, human
ggtccaagggagggagtgca

SEQ ID NO: 3554 - DNA, 20 bp, human
gcgaccagaatccgtgaaca

SEQ ID NO: 3555 - DNA, 20 bp, human
gacctaggagttagaagcac

SEQ ID NO: 3556 - DNA, 20 bp, human
gaggcgactggtagatcaga

SEQ ID NO: 3557 - DNA, 20 bp, human
gctagtctctgggctcctaa

SEQ ID NO: 3558 - DNA, 20 bp, human
gtgtgtactacaggccaagt

SEQ ID NO: 3559 - DNA, 20 bp, human
gttcactgtagaaagtacaa

SEQ ID NO: 3560 - DNA, 20 bp, human
gagaaagtacaaaggtacac

SEQ ID NO: 3561 - DNA, 20 bp, human
gctgggctcctaaaggtgag

SEQ ID NO: 3562 - DNA, 20 bp, human
gcatcacccagctagtctct

SEQ ID NO: 3563 - DNA, 20 bp, human
gcccagaggtgataccgaag

SEQ ID NO: 3564 - DNA, 20 bp, human
gacaaaggtacacaggcgac

SEQ ID NO: 3565 - DNA, 20 bp, human
ggaactgagggaagtcaaaa

SEQ ID NO: 3566 - DNA, 20 bp, human
gagccagactatctatgtga

SEQ ID NO: 3567 - DNA, 20 bp, human
gtccaagacaaagacaggat

SEQ ID NO: 3568 - DNA, 20 bp, human
gtccaatgtcagcaagacat

SEQ ID NO: 3569 - DNA, 20 bp, human
ggagcaattgcccagctatc

SEQ ID NO: 3570 - DNA, 20 bp, human
ggtagttcaatgggaaacca

SEQ ID NO: 3571 - DNA, 20 bp, human
ggtgagcaggcatacagtga

SEQ ID NO: 3572 - DNA, 20 bp, human
gcatacagtgagggaaacac

SEQ ID NO: 3573 - DNA, 20 bp, human
gtgccttcacatagatagtc

SEQ ID NO: 3574 - DNA, 20 bp, human
gagttggtctgcaaagggta

SEQ ID NO: 3575 - DNA, 20 bp, human
ggtgagggaaacactggata

SEQ ID NO: 3576 - DNA, 20 bp, human
gcggtgtagcgacccgagga

SEQ ID NO: 3577 - DNA, 20 bp, human
gccgggtcgcgtacttgctg

SEQ ID NO: 3578 - DNA, 20 bp, human
gcaagtacgcgacccgggct

SEQ ID NO: 3579 - DNA, 20 bp, human
gctccgccggccaatcacgg

SEQ ID NO: 3580 - DNA, 20 bp, human
gtagcaggcagtggagagct

SEQ ID NO: 3581 - DNA, 20 bp, human
gagcctctcagggcgcagtg

SEQ ID NO: 3582 - DNA, 20 bp, human
gggggcggtgtagcgacccg

SEQ ID NO: 3583 - DNA, 20 bp, human
gcccacatcgtagcaggcag

SEQ ID NO: 3584 - DNA, 20 bp, human
gcccctccgccggccaatca

SEQ ID NO: 3585 - DNA, 20 bp, human
gatacaaagatgaaaggctc

SEQ ID NO: 3586 - DNA, 20 bp, human
gcggcccctgggttcgaaca

SEQ ID NO: 3587 - DNA, 20 bp, human
ggtgccgtgttcgaacccag

SEQ ID NO: 3588 - DNA, 20 bp, human
ggcacccgcactgcgcgtca

SEQ ID NO: 3589 - DNA, 20 bp, human
ggccgctgcccggcacctgg

SEQ ID NO: 3590 - DNA, 20 bp, human
gggccgcgctcggagcccgt

SEQ ID NO: 3591 - DNA, 20 bp, human
gagcacaccacaggcgctgg

SEQ ID NO: 3592 - DNA, 20 bp, human
gatggtgcaggcctggtata

SEQ ID NO: 3593 - DNA, 20 bp, human
gagcagcggcgttgaggggt

SEQ ID NO: 3594 - DNA, 20 bp, human
gggggcgtcgtccatatacc

SEQ ID NO: 3595 - DNA, 20 bp, human
gagcggcgttgaggggtcgg

SEQ ID NO: 3596 - DNA, 20 bp, human
gatgtgaggtcgttcaccag

SEQ ID NO: 3597 - DNA, 20 bp, human
gcgttcaccagcggcatcaa

SEQ ID NO: 3598 - DNA, 20 bp, human
gggcatcaaagggtacttca

SEQ ID NO: 3599 - DNA, 20 bp, human
ggtacttcatggcgcatgtg

SEQ ID NO: 3600 - DNA, 20 bp, human
gcttgcaccccagctgaaag

SEQ ID NO: 3601 - DNA, 20 bp, human
gcccagcctgccaggtccca

SEQ ID NO: 3602 - DNA, 20 bp, human
gctgccccatgggacctggc

SEQ ID NO: 3603 - DNA, 20 bp, human
gcggggtaagaagctcacct

SEQ ID NO: 3604 - DNA, 20 bp, human
gggaccctaatcctggagct

SEQ ID NO: 3605 - DNA, 20 bp, human
gtccaggcagatgaacttcc

SEQ ID NO: 3606 - DNA, 20 bp, human
gttgctcttaccctctggta

SEQ ID NO: 3607 - DNA, 20 bp, human
ggcttgaccaggtagggcaa

SEQ ID NO: 3608 - DNA, 20 bp, human
gaacagcctggtactcacgg

SEQ ID NO: 3609 - DNA, 20 bp, human
gggttctgattccataccag

SEQ ID NO: 3610 - DNA, 20 bp, human
gccacagactgcagtcagaa

SEQ ID NO: 3611 - DNA, 20 bp, human
gcagaattgctcttaccctc

SEQ ID NO: 3612 - DNA, 20 bp, human
ggaagttccaggctgggtgg

SEQ ID NO: 3613 - DNA, 20 bp, human
ggtggaggcagatatgcact

SEQ ID NO: 3614 - DNA, 20 bp, human
gtagggtcagtaaggtggaa

SEQ ID NO: 3615 - DNA, 20 bp, human
gctcccacactactacggac

SEQ ID NO: 3616 - DNA, 20 bp, human
ggggagggcgctgaagatcg

SEQ ID NO: 3617 - DNA, 20 bp, human
gccacggggtggagatgcat

SEQ ID NO: 3618 - DNA, 20 bp, human
ggctctctggtcccgatctg

SEQ ID NO: 3619 - DNA, 20 bp, human
gctacatcccgcggcgctgg

SEQ ID NO: 3620 - DNA, 20 bp, human
gcgccgcgcgtggggaggga

SEQ ID NO: 3621 - DNA, 20 bp, human
gctaaaggcgcagcactcac

SEQ ID NO: 3622 - DNA, 20 bp, human
gctccgaggcggcctaggtg

SEQ ID NO: 3623 - DNA, 20 bp, human
gcaggactgccgggagtcgg

SEQ ID NO: 3624 - DNA, 20 bp, human
ggccctccccgcgccggaag

SEQ ID NO: 3625 - DNA, 20 bp, human
ggccccctggcaagtcggag

SEQ ID NO: 3626 - DNA, 20 bp, human
ggagagcgcgattccagaag

SEQ ID NO: 3627 - DNA, 20 bp, human
gcagcggcggcggctacacc

SEQ ID NO: 3628 - DNA, 20 bp, human
ggattccagaagcggcatcg

SEQ ID NO: 3629 - DNA, 20 bp, human
gcgccggactcctccgacag

SEQ ID NO: 3630 - DNA, 20 bp, human
gagaagcggcatcgcggcgg

SEQ ID NO: 3631 - DNA, 20 bp, human
gctggagcaactgcacccga

SEQ ID NO: 3632 - DNA, 20 bp, human
gccgacagcggtcgcaagga

SEQ ID NO: 3633 - DNA, 20 bp, human
gacagcggtcgcaaggaggg

SEQ ID NO: 3634 - DNA, 20 bp, human
gccctccgccgcgaaaggcg

SEQ ID NO: 3635 - DNA, 20 bp, human
ggcggcggcggtcgctgtcg

SEQ ID NO: 3636 - DNA, 20 bp, human
gccgaagccatggcaagcaa

SEQ ID NO: 3637 - DNA, 20 bp, human
gtcctccactgagacgcagg

SEQ ID NO: 3638 - DNA, 20 bp, human
ggagggtgaaggtccaggac

SEQ ID NO: 3639 - DNA, 20 bp, human
gaccgaaccagggaccgaag

SEQ ID NO: 3640 - DNA, 20 bp, human
gcagggaggcagcggaacag

SEQ ID NO: 3641 - DNA, 20 bp, human
gcgcttggcatcgccactct

SEQ ID NO: 3642 - DNA, 20 bp, human
gcatggcttcggggtatctg

SEQ ID NO: 3643 - DNA, 20 bp, human
gagagcagctggagcgacgt

SEQ ID NO: 3644 - DNA, 20 bp, human
gacagatggtgcccgcaggg

SEQ ID NO: 3645 - DNA, 20 bp, human
gggtccgcaagttcctggac

SEQ ID NO: 3646 - DNA, 20 bp, human
gcgatgctctacgtccgctc

SEQ ID NO: 3647 - DNA, 20 bp, human
gccaacacgagggggaccag

SEQ ID NO: 3648 - DNA, 20 bp, human
ggctcaggcactcagcgact

SEQ ID NO: 3649 - DNA, 20 bp, human
ggtacctgctgctgcccgag

SEQ ID NO: 3650 - DNA, 20 bp, human
gtaccacagcaactgcttcc

SEQ ID NO: 3651 - DNA, 20 bp, human
gagcaactgcttcccggctc

SEQ ID NO: 3652 - DNA, 20 bp, human
gggacgtagagcatcggacg

SEQ ID NO: 3653 - DNA, 20 bp, human
ggaccctcgcccaaattcca

SEQ ID NO: 3654 - DNA, 20 bp, human
gcagggttgcaagcgttctt

SEQ ID NO: 3655 - DNA, 20 bp, human
gagggaacccccaacacgag

SEQ ID NO: 3656 - DNA, 20 bp, human
gtgggctgtagagccaaagt

SEQ ID NO: 3657 - DNA, 20 bp, human
gctgtagagccaaagtgggg

SEQ ID NO: 3658 - DNA, 20 bp, human
ggccatcccccgggaagaga

SEQ ID NO: 3659 - DNA, 20 bp, human
gggaccggagcagcgtctgt

SEQ ID NO: 3660 - DNA, 20 bp, human
ggctccggtccgaccctccg

SEQ ID NO: 3661 - DNA, 20 bp, human
gaagcggtgatgcgaagagg

SEQ ID NO: 3662 - DNA, 20 bp, human
gtggtgcgaccccggagggt

SEQ ID NO: 3663 - DNA, 20 bp, human
gtcgcgctcccaccccactt

SEQ ID NO: 3664 - DNA, 20 bp, human
gtggggtgggagcgcgaaga

SEQ ID NO: 3665 - DNA, 20 bp, human
ggccacctgcgagcaagccc

SEQ ID NO: 3666 - DNA, 20 bp, human
gagcgaacccaggtacatca

SEQ ID NO: 3667 - DNA, 20 bp, human
gtgagaagcccgaagtggca

SEQ ID NO: 3668 - DNA, 20 bp, human
gggtgcagcggcctcccctg

SEQ ID NO: 3669 - DNA, 20 bp, human
gtaggaaggcgagcgaaccc

SEQ ID NO: 3670 - DNA, 20 bp, human
ggcggtgtcagcgcctagga

SEQ ID NO: 3671 - DNA, 20 bp, human
ggacgcgacatccaaccgag

SEQ ID NO: 3672 - DNA, 20 bp, human
gtcaccaagaaaccactgag

SEQ ID NO: 3673 - DNA, 20 bp, human
gacggaaaccagcttcatcc

SEQ ID NO: 3674 - DNA, 20 bp, human
gcggcgcgtgcaaacgcctc

SEQ ID NO: 3675 - DNA, 20 bp, human
gtatctccctccgcgcagag

SEQ ID NO: 3676 - DNA, 20 bp, human
gcgggccgcgactccgctcc

SEQ ID NO: 3677 - DNA, 20 bp, human
gcctgcctggagcggagtcg

SEQ ID NO: 3678 - DNA, 20 bp, human
gaggaggctgatgcaaccca

SEQ ID NO: 3679 - DNA, 20 bp, human
gggtgagccgggcacgtcgg

SEQ ID NO: 3680 - DNA, 20 bp, human
ggagtcctagcagcaggtgg

SEQ ID NO: 3681 - DNA, 20 bp, human
gggttggctggcccaagacc

SEQ ID NO: 3682 - DNA, 20 bp, human
ggtcaaacccaggtgagtcc

SEQ ID NO: 3683 - DNA, 20 bp, human
ggctccgccccttgctggaa

SEQ ID NO: 3684 - DNA, 20 bp, human
gtagcctttccagcaagggg

SEQ ID NO: 3685 - DNA, 20 bp, human
gtccggggcgcaaggcggag

SEQ ID NO: 3686 - DNA, 20 bp, human
gccgagaaggaaccaaggaa

SEQ ID NO: 3687 - DNA, 20 bp, human
gggaccccgagaaggaacca

SEQ ID NO: 3688 - DNA, 20 bp, human
gaccccagctgaggatttat

SEQ ID NO: 3689 - DNA, 20 bp, human
ggcaagaggcctagagacgg

SEQ ID NO: 3690 - DNA, 20 bp, human
ggccaataaatcctcagctg

SEQ ID NO: 3691 - DNA, 20 bp, human
gggacacgggtaccgcagag

SEQ ID NO: 3692 - DNA, 20 bp, human
gcccctactaggcaggacac

SEQ ID NO: 3693 - DNA, 20 bp, human
gggcacagttgggccttgaa

SEQ ID NO: 3694 - DNA, 20 bp, human
ggccacccccatcccctact

SEQ ID NO: 3695 - DNA, 20 bp, human
gcagagggctgggcacagtt

SEQ ID NO: 3696 - DNA, 20 bp, human
ggtgggagaggcggcttcac

SEQ ID NO: 3697 - DNA, 20 bp, human
gcgtcgagcggtgcagacaa

SEQ ID NO: 3698 - DNA, 20 bp, human
gcagcagcggggaccgagag

SEQ ID NO: 3699 - DNA, 20 bp, human
gtgtctgctgaggggagacg

SEQ ID NO: 3700 - DNA, 20 bp, human
gcctgccctagccaaaatgg

SEQ ID NO: 3701 - DNA, 20 bp, human
ggcgggcgcagcagagcggc

SEQ ID NO: 3702 - DNA, 20 bp, human
ggcgcctcgaggccgagtca

SEQ ID NO: 3703 - DNA, 20 bp, human
ggcagacaatacaagcgcct

SEQ ID NO: 3704 - DNA, 20 bp, human
ggggaggagacggagggtgt

SEQ ID NO: 3705 - DNA, 20 bp, human
gcctcccgcaggcagcgcta

SEQ ID NO: 3706 - DNA, 20 bp, human
gctcggaggggaccagactg

SEQ ID NO: 3707 - DNA, 20 bp, human
ggaccagtcgcgctgggggt

SEQ ID NO: 3708 - DNA, 20 bp, human
ggaatcccgggacgttctca

SEQ ID NO: 3709 - DNA, 20 bp, human
ggccggtcacgtgggagcgg

SEQ ID NO: 3710 - DNA, 20 bp, human
ggcccccgctcccacgtgac

SEQ ID NO: 3711 - DNA, 20 bp, human
ggggcgccaagcggtaggta

SEQ ID NO: 3712 - DNA, 20 bp, human
ggaggggaccagtcgcgctg

SEQ ID NO: 3713 - DNA, 20 bp, human
gccccgggagggcggagaag

SEQ ID NO: 3714 - DNA, 20 bp, human
ggaacgtcccgggattcccg

SEQ ID NO: 3715 - DNA, 20 bp, human
gggggacctgaggggagagt

SEQ ID NO: 3716 - DNA, 20 bp, human
gaccgcaaggggcggaggaa

SEQ ID NO: 3717 - DNA, 20 bp, human
gtgactggcggcaggttggg

SEQ ID NO: 3718 - DNA, 20 bp, human
ggcgtgttcctgctcaagag

SEQ ID NO: 3719 - DNA, 20 bp, human
ggcgcgtgcgcgctcagagg

SEQ ID NO: 3720 - DNA, 20 bp, human
gtgtgcatgtaggtgactgg

SEQ ID NO: 3721 - DNA, 20 bp, human
gacgctccgggagcagatag

SEQ ID NO: 3722 - DNA, 20 bp, human
ggtctcgtagatgtgcatgt

SEQ ID NO: 3723 - DNA, 20 bp, human
ggcatgctcaaggtgctgta

SEQ ID NO: 3724 - DNA, 20 bp, human
gagatgtgcatgtaggtgac

SEQ ID NO: 3725 - DNA, 20 bp, human
gcccccagcccgggtcgagg

SEQ ID NO: 3726 - DNA, 20 bp, human
gggccgcgcgcggtagggct

SEQ ID NO: 3727 - DNA, 20 bp, human
ggctggctgggactcgactc

SEQ ID NO: 3728 - DNA, 20 bp, human
gggcagtgcccaaagttcca

SEQ ID NO: 3729 - DNA, 20 bp, human
gctgggctctggacaacgcg

SEQ ID NO: 3730 - DNA, 20 bp, human
gcaggaatccctggagctag

SEQ ID NO: 3731 - DNA, 20 bp, human
gtcagcagacgggcaccaag

SEQ ID NO: 3732 - DNA, 20 bp, human
gacaagtgggacacatcaca

SEQ ID NO: 3733 - DNA, 20 bp, human
gtgaaggcgtcgaggtgtgg

SEQ ID NO: 3734 - DNA, 20 bp, human
ggtgcccctccagcctgggt

SEQ ID NO: 3735 - DNA, 20 bp, human
ggcacttggacagaacagtc

SEQ ID NO: 3736 - DNA, 20 bp, human
ggccggagccggagacccag

SEQ ID NO: 3737 - DNA, 20 bp, human
gccagcggccgccgagacag

SEQ ID NO: 3738 - DNA, 20 bp, human
gcggggagggaaggcaagtg

SEQ ID NO: 3739 - DNA, 20 bp, human
gtcagccggggtgctaggtc

SEQ ID NO: 3740 - DNA, 20 bp, human
ggctccccgcccgctacctg

SEQ ID NO: 3741 - DNA, 20 bp, human
gcacgccagacctagcaccc

SEQ ID NO: 3742 - DNA, 20 bp, human
gggcccgaggactcctggaa

SEQ ID NO: 3743 - DNA, 20 bp, human
gctgtgcctgggcccttcac

SEQ ID NO: 3744 - DNA, 20 bp, human
ggcgggaaaggaaccctgag

SEQ ID NO: 3745 - DNA, 20 bp, human
gccggaaggcgcgcaggggt

SEQ ID NO: 3746 - DNA, 20 bp, human
ggcccccgagggaggaaccc

SEQ ID NO: 3747 - DNA, 20 bp, human
ggcttctgcactgacttcta

SEQ ID NO: 3748 - DNA, 20 bp, human
gagggacaccaggaagtagt

SEQ ID NO: 3749 - DNA, 20 bp, human
gccccgtcggagctccgaaa

SEQ ID NO: 3750 - DNA, 20 bp, human
gtgctggtgtgcgccgcggt

SEQ ID NO: 3751 - DNA, 20 bp, human
ggtgttcgccgtgcccaccg

SEQ ID NO: 3752 - DNA, 20 bp, human
gcgtctggggcccccgaggg

SEQ ID NO: 3753 - DNA, 20 bp, human
gcccccagcctggcccgtct

SEQ ID NO: 3754 - DNA, 20 bp, human
gacacaggacgcgctgtacg

SEQ ID NO: 3755 - DNA, 20 bp, human
gacaccaggaagtagttggt

SEQ ID NO: 3756 - DNA, 20 bp, human
ggcctgaccaaagaggacac

SEQ ID NO: 3757 - DNA, 20 bp, human
ggtactggtgtggcatccag

SEQ ID NO: 3758 - DNA, 20 bp, human
ggaccaaagaggacacgggc

SEQ ID NO: 3759 - DNA, 20 bp, human
gaccttagaagaggctgaca

SEQ ID NO: 3760 - DNA, 20 bp, human
gatgtcctgcctgaccaaag

SEQ ID NO: 3761 - DNA, 20 bp, human
gggagggtgtctgcgccctg

SEQ ID NO: 3762 - DNA, 20 bp, human
gggtttaaggaccttagaag

SEQ ID NO: 3763 - DNA, 20 bp, human
gtaccagcccgtgtcctctt

SEQ ID NO: 3764 - DNA, 20 bp, human
gggatgtaacccacagccat

SEQ ID NO: 3765 - DNA, 20 bp, human
gatccctggcaaagtcccgc

SEQ ID NO: 3766 - DNA, 20 bp, human
ggctgtaggacagctctata

SEQ ID NO: 3767 - DNA, 20 bp, human
gttggactctgcgccatagt

SEQ ID NO: 3768 - DNA, 20 bp, human
gcaccccaccagaaaagggt

SEQ ID NO: 3769 - DNA, 20 bp, human
gggacctctgggaagacgtc

SEQ ID NO: 3770 - DNA, 20 bp, human
ggcgttgaggacatctgttt

SEQ ID NO: 3771 - DNA, 20 bp, human
gggatgtgcggtgcataaag

SEQ ID NO: 3772 - DNA, 20 bp, human
gtcccaggggaacctccaca

SEQ ID NO: 3773 - DNA, 20 bp, human
gtcactgcacatggacctct

SEQ ID NO: 3774 - DNA, 20 bp, human
gcttagaaagggctcatcac

SEQ ID NO: 3775 - DNA, 20 bp, human
ggataagcaaccctcttcag

SEQ ID NO: 3776 - DNA, 20 bp, human
ggcggagccgcgcagaaaca

SEQ ID NO: 3777 - DNA, 20 bp, human
gcgcgggctaggaaaggagt

SEQ ID NO: 3778 - DNA, 20 bp, human
gcgcgcgccgagcccggaag

SEQ ID NO: 3779 - DNA, 20 bp, human
gaagaggcgcgggctaggaa

SEQ ID NO: 3780 - DNA, 20 bp, human
gagagcagcggtgacgaacc

SEQ ID NO: 3781 - DNA, 20 bp, human
ggccccttggcgagaagtgt

SEQ ID NO: 3782 - DNA, 20 bp, human
gtcctaccgggatgagagaa

SEQ ID NO: 3783 - DNA, 20 bp, human
gcctccaaggccgacctcgg

SEQ ID NO: 3784 - DNA, 20 bp, human
ggaagtgtcggacgtctgag

SEQ ID NO: 3785 - DNA, 20 bp, human
gggatgagagaaaggcgcag

SEQ ID NO: 3786 - DNA, 20 bp, human
ggcgctgagtgagctaatct

SEQ ID NO: 3787 - DNA, 20 bp, human
gcctggtgcccggaatgtgg

SEQ ID NO: 3788 - DNA, 20 bp, human
gggctgctgcgggtggacga

SEQ ID NO: 3789 - DNA, 20 bp, human
gactggaacgcgcgagcgac

SEQ ID NO: 3790 - DNA, 20 bp, human
gcacactcggagagcgccag

SEQ ID NO: 3791 - DNA, 20 bp, human
gacagaagcacacattaggg

SEQ ID NO: 3792 - DNA, 20 bp, human
gttgagagggagggtatggg

SEQ ID NO: 3793 - DNA, 20 bp, human
gccggctttggaaagaaacg

SEQ ID NO: 3794 - DNA, 20 bp, human
gaacgcgcgagcgacgggcg

SEQ ID NO: 3795 - DNA, 20 bp, human
gttcacagaagcacacatta

SEQ ID NO: 3796 - DNA, 20 bp, human
gcgaggccctcaccacaggt

SEQ ID NO: 3797 - DNA, 20 bp, human
gccgccgaggccctcaccac

SEQ ID NO: 3798 - DNA, 20 bp, human
gaggcagtgcggtccttcag

SEQ ID NO: 3799 - DNA, 20 bp, human
gctgataccgctgctaaaag

SEQ ID NO: 3800 - DNA, 20 bp, human
gggacgctccgcagctgttg

SEQ ID NO: 3801 - DNA, 20 bp, human
gtcaccctcagagaaaccac

SEQ ID NO: 3802 - DNA, 20 bp, human
gcctgggatggagaaattta

SEQ ID NO: 3803 - DNA, 20 bp, human
gaaagtcaggcgggctgagg

SEQ ID NO: 3804 - DNA, 20 bp, human
gtccgcagctgttggggaag

SEQ ID NO: 3805 - DNA, 20 bp, human
gtcctggcgagagtacgagg

SEQ ID NO: 3806 - DNA, 20 bp, human
ggttggctgagtgagcctca

SEQ ID NO: 3807 - DNA, 20 bp, human
gtcttgtagagcgctagaca

SEQ ID NO: 3808 - DNA, 20 bp, human
gtcctgctgggccctgaagt

SEQ ID NO: 3809 - DNA, 20 bp, human
gagcgctctacaagacacat

SEQ ID NO: 3810 - DNA, 20 bp, human
ggctagacacggctacttcc

SEQ ID NO: 3811 - DNA, 20 bp, human
gcgagagcagactctgaacc

SEQ ID NO: 3812 - DNA, 20 bp, human
gtctacaagacacataggag

SEQ ID NO: 3813 - DNA, 20 bp, human
gccactccctgggaaaactg

SEQ ID NO: 3814 - DNA, 20 bp, human
ggagcaaccagcaaagtgtg

SEQ ID NO: 3815 - DNA, 20 bp, human
ggctcactcagccaacttca

SEQ ID NO: 3816 - DNA, 20 bp, human
gtcggaagcgcgagagggag

SEQ ID NO: 3817 - DNA, 20 bp, human
gataaggccggagatcgcac

SEQ ID NO: 3818 - DNA, 20 bp, human
gtcggggcgagacgtctata

SEQ ID NO: 3819 - DNA, 20 bp, human
gcggcacgcccgggagtgag

SEQ ID NO: 3820 - DNA, 20 bp, human
gcccgagcacgggatgttcg

SEQ ID NO: 3821 - DNA, 20 bp, human
ggctgccgccatcgccgctg

SEQ ID NO: 3822 - DNA, 20 bp, human
ggcctcaaccgtgcagggtg

SEQ ID NO: 3823 - DNA, 20 bp, human
ggctgccacgccccgagcac

SEQ ID NO: 3824 - DNA, 20 bp, human
ggcagcctcggaagcgcgag

SEQ ID NO: 3825 - DNA, 20 bp, human
gcggatggccgcagcggcga

SEQ ID NO: 3826 - DNA, 20 bp, human
ggctgaaaggcctctgacta

SEQ ID NO: 3827 - DNA, 20 bp, human
gtaacagcgccaccaacgag

SEQ ID NO: 3828 - DNA, 20 bp, human
gccaggggccggcgcacggt

SEQ ID NO: 3829 - DNA, 20 bp, human
gttacatagcccgtagtcag

SEQ ID NO: 3830 - DNA, 20 bp, human
gcgccggcccctgggctgaa

SEQ ID NO: 3831 - DNA, 20 bp, human
gctgcggctggaggcgggtc

SEQ ID NO: 3832 - DNA, 20 bp, human
gtgacaaagtcggccagaca

SEQ ID NO: 3833 - DNA, 20 bp, human
gcggcgcgaggagctagctg

SEQ ID NO: 3834 - DNA, 20 bp, human
ggcgccaccaacgagcggga

SEQ ID NO: 3835 - DNA, 20 bp, human
gcacactgcctagagaccca

SEQ ID NO: 3836 - DNA, 20 bp, human
gggaggcgctgggaaaagtg

SEQ ID NO: 3837 - DNA, 20 bp, human
gcgcagggccgagtgggtga

SEQ ID NO: 3838 - DNA, 20 bp, human
ggaagatgtaagggaatcgg

SEQ ID NO: 3839 - DNA, 20 bp, human
gacctggtggaaaaagcggg

SEQ ID NO: 3840 - DNA, 20 bp, human
ggaggggccggtataaaacc

SEQ ID NO: 3841 - DNA, 20 bp, human
ggctctcgctgacgtaactc

SEQ ID NO: 3842 - DNA, 20 bp, human
ggggccggtataaaacctgg

SEQ ID NO: 3843 - DNA, 20 bp, human
gacaccagaaaagaatagca

SEQ ID NO: 3844 - DNA, 20 bp, human
gcagcgggtgcaaaaggaca

SEQ ID NO: 3845 - DNA, 20 bp, human
gggcgtcccgcagggccgag

SEQ ID NO: 3846 - DNA, 20 bp, human
ggcccagcgagcgccgaaga

SEQ ID NO: 3847 - DNA, 20 bp, human
gcctctagggccgctgagaa

SEQ ID NO: 3848 - DNA, 20 bp, human
gcgtgcagtcagcccagaag

SEQ ID NO: 3849 - DNA, 20 bp, human
gcagtagccgagcacctcta

SEQ ID NO: 3850 - DNA, 20 bp, human
gtcatccccctggctatgga

SEQ ID NO: 3851 - DNA, 20 bp, human
gtgtggccggtgtccaggtc

SEQ ID NO: 3852 - DNA, 20 bp, human
ggcgaggagtcatctccccc

SEQ ID NO: 3853 - DNA, 20 bp, human
gtcgctcgctcgcctgtcag

SEQ ID NO: 3854 - DNA, 20 bp, human
gtgaatcccgacctggacac

SEQ ID NO: 3855 - DNA, 20 bp, human
ggtccgccctccatagccag

SEQ ID NO: 3856 - DNA, 20 bp, human
gccaccgccgggccctccga

SEQ ID NO: 3857 - DNA, 20 bp, human
ggtgcaggcagcggccactg

SEQ ID NO: 3858 - DNA, 20 bp, human
ggcggttgcaggccactgag

SEQ ID NO: 3859 - DNA, 20 bp, human
ggccgagaagggcagtacgg

SEQ ID NO: 3860 - DNA, 20 bp, human
ggcggcgcggccccctcgga

SEQ ID NO: 3861 - DNA, 20 bp, human
ggctcttcggtgctactcca

SEQ ID NO: 3862 - DNA, 20 bp, human
gtgaccacgatgaccgccat

SEQ ID NO: 3863 - DNA, 20 bp, human
ggagtagcaccgaagagccg

SEQ ID NO: 3864 - DNA, 20 bp, human
gcgagttgggagcgccgcag

SEQ ID NO: 3865 - DNA, 20 bp, human
ggagcgcggctgtccgagag

SEQ ID NO: 3866 - DNA, 20 bp, human
ggatgtaaggcgacagacat

SEQ ID NO: 3867 - DNA, 20 bp, human
gtaatcgcttcggggatgta

SEQ ID NO: 3868 - DNA, 20 bp, human
gctgggggaagccagagagt

SEQ ID NO: 3869 - DNA, 20 bp, human
gccagaaccgcagcgtctgg

SEQ ID NO: 3870 - DNA, 20 bp, human
gagtctcgcggcgctccgag

SEQ ID NO: 3871 - DNA, 20 bp, human
gtgctccgctgcgctcacgg

SEQ ID NO: 3872 - DNA, 20 bp, human
gctcgcggcgctccgagagg

SEQ ID NO: 3873 - DNA, 20 bp, human
ggaagcgattaccgactctc

SEQ ID NO: 3874 - DNA, 20 bp, human
gtctccaggagccgcgacgg

SEQ ID NO: 3875 - DNA, 20 bp, human
gaccccgggaggcagccgaa

SEQ ID NO: 3876 - DNA, 20 bp, human
gctgggccggttcttaaagg

SEQ ID NO: 3877 - DNA, 20 bp, human
ggtcctggtggtccatgacg

SEQ ID NO: 3878 - DNA, 20 bp, human
gcaggccacagcggccatag

SEQ ID NO: 3879 - DNA, 20 bp, human
gtgtggcctgcacggagtag

SEQ ID NO: 3880 - DNA, 20 bp, human
ggggctgggccggttcttaa

SEQ ID NO: 3881 - DNA, 20 bp, human
gctgcacggagtaggggtcc

SEQ ID NO: 3882 - DNA, 20 bp, human
gcgaaagcctgcgagctgag

SEQ ID NO: 3883 - DNA, 20 bp, human
gccggttcttaaaggaggcg

SEQ ID NO: 3884 - DNA, 20 bp, human
gcgggcagcgctgtcgtcca

SEQ ID NO: 3885 - DNA, 20 bp, human
ggttcttaaaggaggcgcgg

SEQ ID NO: 3886 - DNA, 20 bp, human
ggcagctccggcgagcgagg

SEQ ID NO: 3887 - DNA, 20 bp, human
gcccggagcgagcggcgacg

SEQ ID NO: 3888 - DNA, 20 bp, human
gaggaggcgcccggagcgag

SEQ ID NO: 3889 - DNA, 20 bp, human
gcgtgtaagtgcagagcagg

SEQ ID NO: 3890 - DNA, 20 bp, human
gccctagccggccggatggg

SEQ ID NO: 3891 - DNA, 20 bp, human
ggctccggcgagcgaggcgg

SEQ ID NO: 3892 - DNA, 20 bp, human
ggagccctagccggccggat

SEQ ID NO: 3893 - DNA, 20 bp, human
gcgcactcgcgcccagcgca

SEQ ID NO: 3894 - DNA, 20 bp, human
gccgcccgggaaagtaaagt

SEQ ID NO: 3895 - DNA, 20 bp, human
gggcgccgccgcgagtcctc

SEQ ID NO: 3896 - DNA, 20 bp, human
gcgagccgctgtctcagcag

SEQ ID NO: 3897 - DNA, 20 bp, human
gagcagtggacagcgggcat

SEQ ID NO: 3898 - DNA, 20 bp, human
gtgtctcagcagtggacagc

SEQ ID NO: 3899 - DNA, 20 bp, human
ggaggcagcaacgaggcggg

SEQ ID NO: 3900 - DNA, 20 bp, human
gggcctccgcagctcggcat

SEQ ID NO: 3901 - DNA, 20 bp, human
gccgctgctggaagagccgc

SEQ ID NO: 3902 - DNA, 20 bp, human
gcggccgcaccgctccccga

SEQ ID NO: 3903 - DNA, 20 bp, human
gacgaggcgggcggcgacgc

SEQ ID NO: 3904 - DNA, 20 bp, human
gggaggtcgcggccgggtca

SEQ ID NO: 3905 - DNA, 20 bp, human
ggagcccggtaacctgtcgt

SEQ ID NO: 3906 - DNA, 20 bp, human
gggcagaacgcactgcgaag

SEQ ID NO: 3907 - DNA, 20 bp, human
gtcagcttgtcgggtgctag

SEQ ID NO: 3908 - DNA, 20 bp, human
ggcttcttcagagcacgggc

SEQ ID NO: 3909 - DNA, 20 bp, human
gccatggggcaacccgggaa

SEQ ID NO: 3910 - DNA, 20 bp, human
ggtcgggtgctaggggctcg

SEQ ID NO: 3911 - DNA, 20 bp, human
gcctgtgctgatctggtcat

SEQ ID NO: 3912 - DNA, 20 bp, human
ggtctgcagacgctcgaact

SEQ ID NO: 3913 - DNA, 20 bp, human
ggtctggcaggtgagcgcac

SEQ ID NO: 3914 - DNA, 20 bp, human
gccattgggtgccagcaaga

SEQ ID NO: 3915 - DNA, 20 bp, human
gagacgctcgaacttggcaa

SEQ ID NO: 3916 - DNA, 20 bp, human
gctcgacgggtaggtaaccg

SEQ ID NO: 3917 - DNA, 20 bp, human
ggcagcggcacagaagacgg

SEQ ID NO: 3918 - DNA, 20 bp, human
ggtccacagctcgcagccag

SEQ ID NO: 3919 - DNA, 20 bp, human
gaggagtcccatcaccaggt

SEQ ID NO: 3920 - DNA, 20 bp, human
gaggaggacagcagcacgta

SEQ ID NO: 3921 - DNA, 20 bp, human
gacagcagcgcgggttggag

SEQ ID NO: 3922 - DNA, 20 bp, human
gaccggggcagagggaccgg

SEQ ID NO: 3923 - DNA, 20 bp, human
gccgcagccgacctggtgat

SEQ ID NO: 3924 - DNA, 20 bp, human
gcgggcccgggactagagag

SEQ ID NO: 3925 - DNA, 20 bp, human
ggcataacctagccagttca

SEQ ID NO: 3926 - DNA, 20 bp, human
ggggccggtggagcacgata

SEQ ID NO: 3927 - DNA, 20 bp, human
ggccccgactgcagtcccgg

SEQ ID NO: 3928 - DNA, 20 bp, human
gcccgccgggactgcagtcg

SEQ ID NO: 3929 - DNA, 20 bp, human
gccgagccggcgccatgggg

SEQ ID NO: 3930 - DNA, 20 bp, human
ggccatcaggtagctcacgt

SEQ ID NO: 3931 - DNA, 20 bp, human
gggcgccccgactgcagtcc

SEQ ID NO: 3932 - DNA, 20 bp, human
gcacaggcggcgccgcccca

SEQ ID NO: 3933 - DNA, 20 bp, human
gactgcagtcccggcgggag

SEQ ID NO: 3934 - DNA, 20 bp, human
gctgggtccggggaccgatg

SEQ ID NO: 3935 - DNA, 20 bp, human
gtgctgcccgagcccaggtg

SEQ ID NO: 3936 - DNA, 20 bp, human
gccctcgtggccaccccgag

SEQ ID NO: 3937 - DNA, 20 bp, human
gtacggtcgccctcccctcg

SEQ ID NO: 3938 - DNA, 20 bp, human
ggcgcgcgcagagcgctagt

SEQ ID NO: 3939 - DNA, 20 bp, human
gtcgtggccaccccgagggg

SEQ ID NO: 3940 - DNA, 20 bp, human
gactgaggggcgctgaccgt

SEQ ID NO: 3941 - DNA, 20 bp, human
gcgcgcgtcccgtccaggtc

SEQ ID NO: 3942 - DNA, 20 bp, human
gccgaccctccaggaagcag

SEQ ID NO: 3943 - DNA, 20 bp, human
gggttactccggacctggac

SEQ ID NO: 3944 - DNA, 20 bp, human
gttcagagactggaacgacg

SEQ ID NO: 3945 - DNA, 20 bp, human
gggtcgccctcccctcgggg

SEQ ID NO: 3946 - DNA, 20 bp, human
gcccgccggaaacccgcgtt

SEQ ID NO: 3947 - DNA, 20 bp, human
gctgcgcccagagctgccta

SEQ ID NO: 3948 - DNA, 20 bp, human
ggcgcctctcgaacgagtgt

SEQ ID NO: 3949 - DNA, 20 bp, human
ggaggaagagcgagcccgga

SEQ ID NO: 3950 - DNA, 20 bp, human
ggacgggtagggtcctggaa

SEQ ID NO: 3951 - DNA, 20 bp, human
ggtccgggagggtagagcga

SEQ ID NO: 3952 - DNA, 20 bp, human
ggcctgagtcccagacgggt

SEQ ID NO: 3953 - DNA, 20 bp, human
gcacgcgtccgggagagcag

SEQ ID NO: 3954 - DNA, 20 bp, human
gtacgcatagaagtgaccat

SEQ ID NO: 3955 - DNA, 20 bp, human
gcgttcgagaggcgccgtcc

SEQ ID NO: 3956 - DNA, 20 bp, human
gccaccctggcggggtcgca

SEQ ID NO: 3957 - DNA, 20 bp, human
gcgagcaggtaacggatccc

SEQ ID NO: 3958 - DNA, 20 bp, human
gtggcggctggaggcgatca

SEQ ID NO: 3959 - DNA, 20 bp, human
gtaacggatcccgggctgag

SEQ ID NO: 3960 - DNA, 20 bp, human
gctcggactgagaacacgtg

SEQ ID NO: 3961 - DNA, 20 bp, human
gagaggtgagcggtagctgt

SEQ ID NO: 3962 - DNA, 20 bp, human
gtccgggctggcatagcggg

SEQ ID NO: 3963 - DNA, 20 bp, human
ggaacacgtgaggcaacagg

SEQ ID NO: 3964 - DNA, 20 bp, human
gtccgagagggttcgagacg

SEQ ID NO: 3965 - DNA, 20 bp, human
gcacgtgaggcaacaggtgg

SEQ ID NO: 3966 - DNA, 20 bp, human
gagcgaactgaactgctctg

SEQ ID NO: 3967 - DNA, 20 bp, human
gacaggaggagagagcctca

SEQ ID NO: 3968 - DNA, 20 bp, human
gggatccactggccaaaatg

SEQ ID NO: 3969 - DNA, 20 bp, human
gggcatcgcgcatctctcaa

SEQ ID NO: 3970 - DNA, 20 bp, human
gtggcagcggcacacgatgt

SEQ ID NO: 3971 - DNA, 20 bp, human
gcggctacgtggagaaatgg

SEQ ID NO: 3972 - DNA, 20 bp, human
gagcccgaaggagaggcggc

SEQ ID NO: 3973 - DNA, 20 bp, human
gctgcggctacgtggagaaa

SEQ ID NO: 3974 - DNA, 20 bp, human
gcacccgacgctccaggtca

SEQ ID NO: 3975 - DNA, 20 bp, human
gtacgtggagaaatggcggg

SEQ ID NO: 3976 - DNA, 20 bp, human
ggagccaagccagcatgtcg

SEQ ID NO: 3977 - DNA, 20 bp, human
gcctggccgggccagcgcag

SEQ ID NO: 3978 - DNA, 20 bp, human
ggaaggagggcggtgtgtgt

SEQ ID NO: 3979 - DNA, 20 bp, human
gtggcagcggctgatgatgt

SEQ ID NO: 3980 - DNA, 20 bp, human
gcccagcccgcacctggcag

SEQ ID NO: 3981 - DNA, 20 bp, human
ggctcgggtccccgacatgc

SEQ ID NO: 3982 - DNA, 20 bp, human
gcgcaggcggcgtcaagcgg

SEQ ID NO: 3983 - DNA, 20 bp, human
ggacccgagcctccaacgac

SEQ ID NO: 3984 - DNA, 20 bp, human
gctgccggggtggtggagta

SEQ ID NO: 3985 - DNA, 20 bp, human
gggccggtcgttggaggctc

SEQ ID NO: 3986 - DNA, 20 bp, human
gtcatggcgagtgctgaccg

SEQ ID NO: 3987 - DNA, 20 bp, human
gcatgtagaagtcttcgtca

SEQ ID NO: 3988 - DNA, 20 bp, human
gttaggctgtgacccacaga

SEQ ID NO: 3989 - DNA, 20 bp, human
gcaagacattcacggtgccc

SEQ ID NO: 3990 - DNA, 20 bp, human
gctttctggcgtccttctgt

SEQ ID NO: 3991 - DNA, 20 bp, human
gggttcctggtacggacata

SEQ ID NO: 3992 - DNA, 20 bp, human
gaatggatcggttcctggta

SEQ ID NO: 3993 - DNA, 20 bp, human
gaatccaaagatgatatgtg

SEQ ID NO: 3994 - DNA, 20 bp, human
gtcacaggaaggaaaagacg

SEQ ID NO: 3995 - DNA, 20 bp, human
ggaatgtcttgagtactttc

SEQ ID NO: 3996 - DNA, 20 bp, human
gcgtctgcgggcgccctcca

SEQ ID NO: 3997 - DNA, 20 bp, human
gcgaggtcctggcggctaat

SEQ ID NO: 3998 - DNA, 20 bp, human
ggcggagaggggatcgagac

SEQ ID NO: 3999 - DNA, 20 bp, human
gagatcgaggagttcctcga

SEQ ID NO: 4000 - DNA, 20 bp, human
gctctgacaggaagccctcg

SEQ ID NO: 4001 - DNA, 20 bp, human
gaggggctcaggggtggtcg

SEQ ID NO: 4002 - DNA, 20 bp, human
gtggcggctaataggcgctc

SEQ ID NO: 4003 - DNA, 20 bp, human
gcagggccagcaacgccagg

SEQ ID NO: 4004 - DNA, 20 bp, human
gtaggcgctccggccccgcg

SEQ ID NO: 4005 - DNA, 20 bp, human
gtggagacggctatccgcgc

SEQ ID NO: 4006 - DNA, 20 bp, human
ggccccgcgccgccgaaccc

SEQ ID NO: 4007 - DNA, 20 bp, human
gcgggagagctcctccaggt

SEQ ID NO: 4008 - DNA, 20 bp, human
ggtagcgccgagagcctggt

SEQ ID NO: 4009 - DNA, 20 bp, human
gggcgaggcagagacgatgt

SEQ ID NO: 4010 - DNA, 20 bp, human
gtcggccatgtcggtgatag

SEQ ID NO: 4011 - DNA, 20 bp, human
ggccgccgctatcaccgaca

SEQ ID NO: 4012 - DNA, 20 bp, human
gatcaccgacatggccgacc

SEQ ID NO: 4013 - DNA, 20 bp, human
gggaggagcaggcgccgcca

SEQ ID NO: 4014 - DNA, 20 bp, human
ggccatgtcggtgatagcgg

SEQ ID NO: 4015 - DNA, 20 bp, human
gagagagagtcgagagaggg

SEQ ID NO: 4016 - DNA, 20 bp, human
gagaccggaagagacacgcg

SEQ ID NO: 4017 - DNA, 20 bp, human
ggatccaggaccctgcaccg

SEQ ID NO: 4018 - DNA, 20 bp, human
gggacccccgagcagagcga

SEQ ID NO: 4019 - DNA, 20 bp, human
gccggacgccacgtgcagac

SEQ ID NO: 4020 - DNA, 20 bp, human
gcacgtggcgtccggaaagc

SEQ ID NO: 4021 - DNA, 20 bp, human
gtgtgctgctaaaaagtcca

SEQ ID NO: 4022 - DNA, 20 bp, human
gcgtccagcgagccaatagg

SEQ ID NO: 4023 - DNA, 20 bp, human
gcggcagctcccacatgccc

SEQ ID NO: 4024 - DNA, 20 bp, human
gctgggagaacgccagccgg

SEQ ID NO: 4025 - DNA, 20 bp, human
gcagccctcgctctgctcgg

SEQ ID NO: 4026 - DNA, 20 bp, human
gcaacccgccgggacagtca

SEQ ID NO: 4027 - DNA, 20 bp, human
gccggaggcaccgggcctgg

SEQ ID NO: 4028 - DNA, 20 bp, human
gcaccgctattgtctaatgg

SEQ ID NO: 4029 - DNA, 20 bp, human
gaggcccccaaaggatcccc

SEQ ID NO: 4030 - DNA, 20 bp, human
gggcgtagggcccggatccg

SEQ ID NO: 4031 - DNA, 20 bp, human
gggccccgggagctgccgat

SEQ ID NO: 4032 - DNA, 20 bp, human
gggacagtcagggcctcgga

SEQ ID NO: 4033 - DNA, 20 bp, human
gcgccgccattagacaatag

SEQ ID NO: 4034 - DNA, 20 bp, human
gccgatcggcgccgggacaa

SEQ ID NO: 4035 - DNA, 20 bp, human
gtgtctaatggcggcgacgc

SEQ ID NO: 4036 - DNA, 20 bp, human
ggatctcgagcggggtacac

SEQ ID NO: 4037 - DNA, 20 bp, human
gcggggtacacgggctgagg

SEQ ID NO: 4038 - DNA, 20 bp, human
ggccgcagccgccttaacaa

SEQ ID NO: 4039 - DNA, 20 bp, human
gccttaacaatggagccccg

SEQ ID NO: 4040 - DNA, 20 bp, human
gggtccgggtcaccaagagt

SEQ ID NO: 4041 - DNA, 20 bp, human
gtaacaatggagccccgggg

SEQ ID NO: 4042 - DNA, 20 bp, human
gggtgagacggcgcgactgg

SEQ ID NO: 4043 - DNA, 20 bp, human
gccccgctcgagatccggct

SEQ ID NO: 4044 - DNA, 20 bp, human
gcggcctcgggtggtaccgg

SEQ ID NO: 4045 - DNA, 20 bp, human
ggagcccccggtaccacccg

SEQ ID NO: 4046 - DNA, 20 bp, human
ggctccggcgcggctggtag

SEQ ID NO: 4047 - DNA, 20 bp, human
gcccctagggagaagctcta

SEQ ID NO: 4048 - DNA, 20 bp, human
ggtcctccggaaactagagg

SEQ ID NO: 4049 - DNA, 20 bp, human
ggctgtcctccggaaactag

SEQ ID NO: 4050 - DNA, 20 bp, human
gcggcgagcatcctgtctgg

SEQ ID NO: 4051 - DNA, 20 bp, human
gcgatctgaagccggagagg

SEQ ID NO: 4052 - DNA, 20 bp, human
gggctgaggaacgctcggag

SEQ ID NO: 4053 - DNA, 20 bp, human
gccctaggggctgcccacag

SEQ ID NO: 4054 - DNA, 20 bp, human
gctcccgaaacacccgctgt

SEQ ID NO: 4055 - DNA, 20 bp, human
gcctttagagtggaatgagg

SEQ ID NO: 4056 - DNA, 20 bp, human
gccacggagtgcgctcctcg

SEQ ID NO: 4057 - DNA, 20 bp, human
gaggaagccccgaagaaggt

SEQ ID NO: 4058 - DNA, 20 bp, human
gccccgatggagcggtacaa

SEQ ID NO: 4059 - DNA, 20 bp, human
gctccgtggccccgatggag

SEQ ID NO: 4060 - DNA, 20 bp, human
gcggacctgggcctaagagg

SEQ ID NO: 4061 - DNA, 20 bp, human
gatggagcggtacaaaggtg

SEQ ID NO: 4062 - DNA, 20 bp, human
ggccgaggaagccccgaaga

SEQ ID NO: 4063 - DNA, 20 bp, human
ggcgcactccgtggccccga

SEQ ID NO: 4064 - DNA, 20 bp, human
gtcgctgggcgaaagggagt

SEQ ID NO: 4065 - DNA, 20 bp, human
gccgcacaggaaagatgcct

SEQ ID NO: 4066 - DNA, 20 bp, human
ggcggcggccgagtgcgcag

SEQ ID NO: 4067 - DNA, 20 bp, human
gtgccgcgggatcgcaagta

SEQ ID NO: 4068 - DNA, 20 bp, human
ggtagcgcgtagaaaaacag

SEQ ID NO: 4069 - DNA, 20 bp, human
gccgggactagaggacggaa

SEQ ID NO: 4070 - DNA, 20 bp, human
ggggagccctcggggagaac

SEQ ID NO: 4071 - DNA, 20 bp, human
gcgcgggatcgcaagtaggg

SEQ ID NO: 4072 - DNA, 20 bp, human
gccgacccgggactagagga

SEQ ID NO: 4073 - DNA, 20 bp, human
gcagccagctagcgagcgac

SEQ ID NO: 4074 - DNA, 20 bp, human
gctcggctgcggaaccgcgg

SEQ ID NO: 4075 - DNA, 20 bp, human
gtctccccgagggctcccac

SEQ ID NO: 4076 - DNA, 20 bp, human
gcaggagactcgctcatcaa

SEQ ID NO: 4077 - DNA, 20 bp, human
gagtctcctggcgaagtctg

SEQ ID NO: 4078 - DNA, 20 bp, human
gactcgctcatcaaaggaga

SEQ ID NO: 4079 - DNA, 20 bp, human
gacccagcgacccgacgctg

SEQ ID NO: 4080 - DNA, 20 bp, human
gcagcgacccgacgctgcgg

SEQ ID NO: 4081 - DNA, 20 bp, human
ggaggagctgaagctgtcgt

SEQ ID NO: 4082 - DNA, 20 bp, human
gcttcagctcctcttaacaa

SEQ ID NO: 4083 - DNA, 20 bp, human
ggagctgaagctgtcgtggg

SEQ ID NO: 4084 - DNA, 20 bp, human
gggaccgagcggacccgagt

SEQ ID NO: 4085 - DNA, 20 bp, human
gaaaagtgtccgggccgcat

SEQ ID NO: 4086 - DNA, 20 bp, human
ggacgttcaacgacttactg

SEQ ID NO: 4087 - DNA, 20 bp, human
gaccagggcctggaccatct

SEQ ID NO: 4088 - DNA, 20 bp, human
gccagtctgtggccatgtca

SEQ ID NO: 4089 - DNA, 20 bp, human
ggccctgaccagcggagcat

SEQ ID NO: 4090 - DNA, 20 bp, human
gccaggcaaggcatcctaga

SEQ ID NO: 4091 - DNA, 20 bp, human
ggatgccttgcctggaagag

SEQ ID NO: 4092 - DNA, 20 bp, human
gatagctaatgagcaacatg

SEQ ID NO: 4093 - DNA, 20 bp, human
gccttcaggacacaaagtcg

SEQ ID NO: 4094 - DNA, 20 bp, human
ggaggtaagatcaaactgga

SEQ ID NO: 4095 - DNA, 20 bp, human
gcgctggcgagctttctgaa

SEQ ID NO: 4096 - DNA, 20 bp, human
ggggcgggttaacgaagacc

SEQ ID NO: 4097 - DNA, 20 bp, human
gtcgccgccgccagcggacg

SEQ ID NO: 4098 - DNA, 20 bp, human
gtccccgccccgtccgctgg

SEQ ID NO: 4099 - DNA, 20 bp, human
gccgccccgtccgctggcgg

SEQ ID NO: 4100 - DNA, 20 bp, human
gcggccctgggtcagtctgt

SEQ ID NO: 4101 - DNA, 20 bp, human
gagcccggagggtctccccg

SEQ ID NO: 4102 - DNA, 20 bp, human
gggatccccgccccgtccgc

SEQ ID NO: 4103 - DNA, 20 bp, human
gagcctcggggagaccctcc

SEQ ID NO: 4104 - DNA, 20 bp, human
gagggctgtgactgacgcag

SEQ ID NO: 4105 - DNA, 20 bp, human
ggccgggcctgcaccttcac

SEQ ID NO: 4106 - DNA, 20 bp, human
gggagcccaagctctcaacg

SEQ ID NO: 4107 - DNA, 20 bp, human
ggcgcgccggcggctcacgg

SEQ ID NO: 4108 - DNA, 20 bp, human
ggacgccgcgttgagagctt

SEQ ID NO: 4109 - DNA, 20 bp, human
ggaagcgcgccggcggctca

SEQ ID NO: 4110 - DNA, 20 bp, human
ggccccacagccgcaaacag

SEQ ID NO: 4111 - DNA, 20 bp, human
gaggcagcgaagcgcgccgg

SEQ ID NO: 4112 - DNA, 20 bp, human
gccggctgagagacagcgca

SEQ ID NO: 4113 - DNA, 20 bp, human
ggccaggcagcgaagcgcgc

SEQ ID NO: 4114 - DNA, 20 bp, human
ggcgggcaggcgacgactgg

SEQ ID NO: 4115 - DNA, 20 bp, human
ggagcagccctgcctccgga

SEQ ID NO: 4116 - DNA, 20 bp, human
gctatatcccgaggttgtgt

SEQ ID NO: 4117 - DNA, 20 bp, human
ggcctatgtaaattagtgag

SEQ ID NO: 4118 - DNA, 20 bp, human
gaaatatgttggacaaccaa

SEQ ID NO: 4119 - DNA, 20 bp, human
ggtatagtttatggtaacag

SEQ ID NO: 4120 - DNA, 20 bp, human
gtcccgaggttgtgtgggca

SEQ ID NO: 4121 - DNA, 20 bp, human
gcaggacagaaagtgttgct

SEQ ID NO: 4122 - DNA, 20 bp, human
gatatagttgggaaatatgt

SEQ ID NO: 4123 - DNA, 20 bp, human
gccctctcactaatttacat

SEQ ID NO: 4124 - DNA, 20 bp, human
gaaccctgcccacacaacct

SEQ ID NO: 4125 - DNA, 20 bp, human
gagctaaagcatgaccagtt

SEQ ID NO: 4126 - DNA, 20 bp, human
gtggaagaagatgtctgcag

SEQ ID NO: 4127 - DNA, 20 bp, human
gcttccaaggaaccttgctt

SEQ ID NO: 4128 - DNA, 20 bp, human
gacgccatgatggatgtgtc

SEQ ID NO: 4129 - DNA, 20 bp, human
ggctctggccatataaacag

SEQ ID NO: 4130 - DNA, 20 bp, human
gtgatggatgtgtctggtgt

SEQ ID NO: 4131 - DNA, 20 bp, human
ggattgcagggagggactaa

SEQ ID NO: 4132 - DNA, 20 bp, human
gagagggacgcacgcccatg

SEQ ID NO: 4133 - DNA, 20 bp, human
gggtaggtggattgcaggga

SEQ ID NO: 4134 - DNA, 20 bp, human
gatggcgtctacagccgcat

SEQ ID NO: 4135 - DNA, 20 bp, human
ggcggctgtagacgccatga

SEQ ID NO: 4136 - DNA, 20 bp, human
gctagcaaccatgaagtggg

SEQ ID NO: 4137 - DNA, 20 bp, human
gtaactagcaaccatgaagt

SEQ ID NO: 4138 - DNA, 20 bp, human
gcagtggtggaagcacaata

SEQ ID NO: 4139 - DNA, 20 bp, human
ggtctgagggagttatgtga

SEQ ID NO: 4140 - DNA, 20 bp, human
gatgtgaaggagcataattc

SEQ ID NO: 4141 - DNA, 20 bp, human
gggattcagtaaaatttagt

SEQ ID NO: 4142 - DNA, 20 bp, human
gattgattccacccacttca

SEQ ID NO: 4143 - DNA, 20 bp, human
gtcatttctatgcagtgttc

SEQ ID NO: 4144 - DNA, 20 bp, human
gaagttatagcagtgtttaa

SEQ ID NO: 4145 - DNA, 20 bp, human
ggttattttgttattggcag

SEQ ID NO: 4146 - DNA, 20 bp, human
gtccgacgaggtcagctggg

SEQ ID NO: 4147 - DNA, 20 bp, human
gatggccatcagctccgacg

SEQ ID NO: 4148 - DNA, 20 bp, human
gtcactgagttggcaacaag

SEQ ID NO: 4149 - DNA, 20 bp, human
gatgtagagatggccttagg

SEQ ID NO: 4150 - DNA, 20 bp, human
gagctccgacgaggtcagct

SEQ ID NO: 4151 - DNA, 20 bp, human
gctgacctcgtcggagctga

SEQ ID NO: 4152 - DNA, 20 bp, human
gtccctagaggggaattatg

SEQ ID NO: 4153 - DNA, 20 bp, human
gtgattagtcacggttggag

SEQ ID NO: 4154 - DNA, 20 bp, human
gtaatcaaacaagcctccta

SEQ ID NO: 4155 - DNA, 20 bp, human
ggcctcataattcccctcta

SEQ ID NO: 4156 - DNA, 20 bp, human
gcagcggtgaaactccgggt

SEQ ID NO: 4157 - DNA, 20 bp, human
ggcggcagcggtgaaactcc

SEQ ID NO: 4158 - DNA, 20 bp, human
gtagtgggatgggggtcccg

SEQ ID NO: 4159 - DNA, 20 bp, human
gggaagagggcggagggtag

SEQ ID NO: 4160 - DNA, 20 bp, human
ggcgcttcgggcgccaccag

SEQ ID NO: 4161 - DNA, 20 bp, human
gatgggagagtgtgtggagt

SEQ ID NO: 4162 - DNA, 20 bp, human
gtgcccgggatggcgaggag

SEQ ID NO: 4163 - DNA, 20 bp, human
gcccggaagtgacgtgtcgg

SEQ ID NO: 4164 - DNA, 20 bp, human
gggcggagggtagtgggatg

SEQ ID NO: 4165 - DNA, 20 bp, human
gtgcatgatgggagagtgtg

SEQ ID NO: 4166 - DNA, 20 bp, human
gaccagcgcgagaaaagtcc

SEQ ID NO: 4167 - DNA, 20 bp, human
gctcgcgctggtctcttcgg

SEQ ID NO: 4168 - DNA, 20 bp, human
gggagcagcgcactagggcc

SEQ ID NO: 4169 - DNA, 20 bp, human
ggccaagtgttgacgaccag

SEQ ID NO: 4170 - DNA, 20 bp, human
gagactcgggaagacctaga

SEQ ID NO: 4171 - DNA, 20 bp, human
ggggctggagcagcgcacta

SEQ ID NO: 4172 - DNA, 20 bp, human
gtcggtggtcagggatggcg

SEQ ID NO: 4173 - DNA, 20 bp, human
gctggtctcttcggtggtca

SEQ ID NO: 4174 - DNA, 20 bp, human
gactatggtcagcagcaggg

SEQ ID NO: 4175 - DNA, 20 bp, human
gtgagcggcgctggagactc

SEQ ID NO: 4176 - DNA, 20 bp, human
gccccgaaggaggcttgctc

SEQ ID NO: 4177 - DNA, 20 bp, human
gctgcgactcggtcccaggt

SEQ ID NO: 4178 - DNA, 20 bp, human
ggtgcgccgcccgccgacct

SEQ ID NO: 4179 - DNA, 20 bp, human
gcggcgggcggcgctcggag

SEQ ID NO: 4180 - DNA, 20 bp, human
gagccctgcgtgccagggag

SEQ ID NO: 4181 - DNA, 20 bp, human
ggactcggtcccaggtcggc

SEQ ID NO: 4182 - DNA, 20 bp, human
gggagcagccattaaagccc

SEQ ID NO: 4183 - DNA, 20 bp, human
gccgggcggcccgctgaccc

SEQ ID NO: 4184 - DNA, 20 bp, human
ggtgcggccggccccgaagg

SEQ ID NO: 4185 - DNA, 20 bp, human
gctccgcggagcagcgccta

SEQ ID NO: 4186 - DNA, 20 bp, human
gatggagacttacagcattg

SEQ ID NO: 4187 - DNA, 20 bp, human
gttgatagaggtgaagacat

SEQ ID NO: 4188 - DNA, 20 bp, human
gttagcgatagtgggaatac

SEQ ID NO: 4189 - DNA, 20 bp, human
gctggctaaagtagcagatc

SEQ ID NO: 4190 - DNA, 20 bp, human
gggatgtttttagcgatagt

SEQ ID NO: 4191 - DNA, 20 bp, human
gaagtctccatcagcacccc

SEQ ID NO: 4192 - DNA, 20 bp, human
gatacaggaaattttgatag

SEQ ID NO: 4193 - DNA, 20 bp, human
ggactcaccattattgaatg

SEQ ID NO: 4194 - DNA, 20 bp, human
gcacaggaagaaaaacagga

SEQ ID NO: 4195 - DNA, 20 bp, human
gcagatctggtaagtgagca

SEQ ID NO: 4196 - DNA, 20 bp, human
ggaggctaggactccggcta

SEQ ID NO: 4197 - DNA, 20 bp, human
ggctaggactccggctacgg

SEQ ID NO: 4198 - DNA, 20 bp, human
gtcctggggcagggaataag

SEQ ID NO: 4199 - DNA, 20 bp, human
ggctctgctcttgggatgag

SEQ ID NO: 4200 - DNA, 20 bp, human
ggctcttgggatgagaggac

SEQ ID NO: 4201 - DNA, 20 bp, human
gatgccccaagcaggtcccc

SEQ ID NO: 4202 - DNA, 20 bp, human
gcacccagcggtgagtcatg

SEQ ID NO: 4203 - DNA, 20 bp, human
gggccgcctgaagtcctgag

SEQ ID NO: 4204 - DNA, 20 bp, human
gcaacccgcgggccgagacg

SEQ ID NO: 4205 - DNA, 20 bp, human
gcccgaagctcccagaccgg

SEQ ID NO: 4206 - DNA, 20 bp, human
gtgtagggccatgggcctca

SEQ ID NO: 4207 - DNA, 20 bp, human
gagcctggcaagacaggtct

SEQ ID NO: 4208 - DNA, 20 bp, human
gcaagaaggtcagctcaaca

SEQ ID NO: 4209 - DNA, 20 bp, human
ggtgaggtcgacagacggaa

SEQ ID NO: 4210 - DNA, 20 bp, human
gccaggctaacaaccacctc

SEQ ID NO: 4211 - DNA, 20 bp, human
ggaaggggccttctgaggtt

SEQ ID NO: 4212 - DNA, 20 bp, human
ggctacaacgaactgcctct

SEQ ID NO: 4213 - DNA, 20 bp, human
gggcaggggcggggagttct

SEQ ID NO: 4214 - DNA, 20 bp, human
ggggcaacatgcatgcccag

SEQ ID NO: 4215 - DNA, 20 bp, human
ggtccccaagatgggactct

SEQ ID NO: 4216 - DNA, 20 bp, human
gctccgaggcagcgggatca

SEQ ID NO: 4217 - DNA, 20 bp, human
gcctccagcggcaacaacaa

SEQ ID NO: 4218 - DNA, 20 bp, human
ggctgggaagcgctcggcag

SEQ ID NO: 4219 - DNA, 20 bp, human
ggagagcgcgaactgctggg

SEQ ID NO: 4220 - DNA, 20 bp, human
gtctgcggcgggcagttcgg

SEQ ID NO: 4221 - DNA, 20 bp, human
gccgcgcagcagctcgtctg

SEQ ID NO: 4222 - DNA, 20 bp, human
gccgcccgcctggaagttca

SEQ ID NO: 4223 - DNA, 20 bp, human
gtggcggggccgggactact

SEQ ID NO: 4224 - DNA, 20 bp, human
ggcggcggccacagcgtgcg

SEQ ID NO: 4225 - DNA, 20 bp, human
gcggcaacaacaacgggacc

SEQ ID NO: 4226 - DNA, 20 bp, human
gatggagacttacagcattg

SEQ ID NO: 4227 - DNA, 20 bp, human
gttgatagaggtgaagacat

SEQ ID NO: 4228 - DNA, 20 bp, human
gctggctaaagtagcagatc

SEQ ID NO: 4229 - DNA, 20 bp, human
gttagcgatagtgggaatac

SEQ ID NO: 4230 - DNA, 20 bp, human
gaagtctccatcagcacccc

SEQ ID NO: 4231 - DNA, 20 bp, human
gggatgtttttagcgatagt

SEQ ID NO: 4232 - DNA, 20 bp, human
gatacaggaaattttgatag

SEQ ID NO: 4233 - DNA, 20 bp, human
ggactcaccattattgaatg

SEQ ID NO: 4234 - DNA, 20 bp, human
gcagatctggtaagtgagca

SEQ ID NO: 4235 - DNA, 20 bp, human
gcacaggaagaaaaacagga

SEQ ID NO: 4236 - DNA, 20 bp, human
ggtcctcgctgtgtctacca

SEQ ID NO: 4237 - DNA, 20 bp, human
ggcaggaggatgtcatagtc

SEQ ID NO: 4238 - DNA, 20 bp, human
gactacatgatcagcaaggg

SEQ ID NO: 4239 - DNA, 20 bp, human
gggaggatgtcatagtctgg

SEQ ID NO: 4240 - DNA, 20 bp, human
ggaccctggtagacacagcg

SEQ ID NO: 4241 - DNA, 20 bp, human
ggcacagggagaaagcgtca

SEQ ID NO: 4242 - DNA, 20 bp, human
gttcactacatgatcagcaa

SEQ ID NO: 4243 - DNA, 20 bp, human
gcagggagaaagcgtcaggg

SEQ ID NO: 4244 - DNA, 20 bp, human
gaacaaacatgggctacatg

SEQ ID NO: 4245 - DNA, 20 bp, human
ggtacctcttaggccaactt

SEQ ID NO: 4246 - DNA, 20 bp, human
gaagtagaggcaggaatatc

SEQ ID NO: 4247 - DNA, 20 bp, human
ggtgtcgggtgagaagactg

SEQ ID NO: 4248 - DNA, 20 bp, human
gtctccgaggaccttgagga

SEQ ID NO: 4249 - DNA, 20 bp, human
gaggatggactccttgtcag

SEQ ID NO: 4250 - DNA, 20 bp, human
gaacagaaagcagatctccg

SEQ ID NO: 4251 - DNA, 20 bp, human
gctttggctatttgaagtag

SEQ ID NO: 4252 - DNA, 20 bp, human
ggagaagaggggtagaacca

SEQ ID NO: 4253 - DNA, 20 bp, human
ggtcttctcacccgacactg

SEQ ID NO: 4254 - DNA, 20 bp, human
ggcaaacccccaggtcacag

SEQ ID NO: 4255 - DNA, 20 bp, human
gagaggggtagaaccacgga

SEQ ID NO: 4256 - DNA, 20 bp, human
ggggccctcacagaaggcgg

SEQ ID NO: 4257 - DNA, 20 bp, human
gctacccgggccctcacaga

SEQ ID NO: 4258 - DNA, 20 bp, human
gggtgcatctgagacaggga

SEQ ID NO: 4259 - DNA, 20 bp, human
gcagaggccaagcagtgtgc

SEQ ID NO: 4260 - DNA, 20 bp, human
gcctcacagaaggcggtggc

SEQ ID NO: 4261 - DNA, 20 bp, human
gcggcagagaagctccagcg

SEQ ID NO: 4262 - DNA, 20 bp, human
ggaaaggagatgctcgccac

SEQ ID NO: 4263 - DNA, 20 bp, human
gctcagggaaagggaagcat

SEQ ID NO: 4264 - DNA, 20 bp, human
gccaccgcacttaagtacag

SEQ ID NO: 4265 - DNA, 20 bp, human
gttcggttgctagactaccc

SEQ ID NO: 4266 - DNA, 20 bp, human
ggcagtggcgttacttctag

SEQ ID NO: 4267 - DNA, 20 bp, human
gcagtggtggaagacacccg

SEQ ID NO: 4268 - DNA, 20 bp, human
gcggccccgacaggacggtg

SEQ ID NO: 4269 - DNA, 20 bp, human
ggcggagcgccggtggataa

SEQ ID NO: 4270 - DNA, 20 bp, human
gttccaccactgcggaggag

SEQ ID NO: 4271 - DNA, 20 bp, human
gggtgaggtatgcagaagta

SEQ ID NO: 4272 - DNA, 20 bp, human
gcgtgcggggagaatatctc

SEQ ID NO: 4273 - DNA, 20 bp, human
gggaaacggcccttatccac

SEQ ID NO: 4274 - DNA, 20 bp, human
gctggccagaggactcgcgt

SEQ ID NO: 4275 - DNA, 20 bp, human
gggtgccggccccgacagga

SEQ ID NO: 4276 - DNA, 20 bp, human
ggagctacctcaggaagacg

SEQ ID NO: 4277 - DNA, 20 bp, human
gagcgggtggtgggatcagt

SEQ ID NO: 4278 - DNA, 20 bp, human
gcggttgcctgggcaacggg

SEQ ID NO: 4279 - DNA, 20 bp, human
gcgaagaccgcggggcagta

SEQ ID NO: 4280 - DNA, 20 bp, human
gtcaggaagacgcggcacga

SEQ ID NO: 4281 - DNA, 20 bp, human
gaccgcggggcagtagggag

SEQ ID NO: 4282 - DNA, 20 bp, human
gcgcggcacgacggttgcct

SEQ ID NO: 4283 - DNA, 20 bp, human
ggtggtgaaggctaatccta

SEQ ID NO: 4284 - DNA, 20 bp, human
gctcaggcaacaggggactc

SEQ ID NO: 4285 - DNA, 20 bp, human
gcagaacatgggcccgaaag

SEQ ID NO: 4286 - DNA, 20 bp, human
ggcacccgggccctccaccc

SEQ ID NO: 4287 - DNA, 20 bp, human
gcagcacccctaaaagaggt

SEQ ID NO: 4288 - DNA, 20 bp, human
gctgctagagtcccactcgg

SEQ ID NO: 4289 - DNA, 20 bp, human
gggaccgcgtaagccaggtc

SEQ ID NO: 4290 - DNA, 20 bp, human
ggttccccgcgagtcgaggg

SEQ ID NO: 4291 - DNA, 20 bp, human
gacggttccccgcgagtcga

SEQ ID NO: 4292 - DNA, 20 bp, human
gcaaaaacacccgagcgccg

SEQ ID NO: 4293 - DNA, 20 bp, human
gagtcccactcgggggaagg

SEQ ID NO: 4294 - DNA, 20 bp, human
gggggaaccgtcacaccgag

SEQ ID NO: 4295 - DNA, 20 bp, human
gcagcctccttcccccgagt

SEQ ID NO: 4296 - DNA, 20 bp, human
ggttcccagcgtggccgggt

SEQ ID NO: 4297 - DNA, 20 bp, human
gggcagtgtgcgcacaaagg

SEQ ID NO: 4298 - DNA, 20 bp, human
gagccggagccagccaaact

SEQ ID NO: 4299 - DNA, 20 bp, human
ggaggaccagagtaagagag

SEQ ID NO: 4300 - DNA, 20 bp, human
gaggagaaaggagggacgat

SEQ ID NO: 4301 - DNA, 20 bp, human
ggtttcagcacagtctggtc

SEQ ID NO: 4302 - DNA, 20 bp, human
ggtgggcagtgtgcgcacaa

SEQ ID NO: 4303 - DNA, 20 bp, human
ggtatatggaacgaaatgga

SEQ ID NO: 4304 - DNA, 20 bp, human
gagagggctaactgaagcat

SEQ ID NO: 4305 - DNA, 20 bp, human
ggaagtagaaccatgacctg

SEQ ID NO: 4306 - DNA, 20 bp, human
gactgtgaggcagagtgacg

SEQ ID NO: 4307 - DNA, 20 bp, human
gccatggtgctatctcccag

SEQ ID NO: 4308 - DNA, 20 bp, human
gtggctgccggaacagcagt

SEQ ID NO: 4309 - DNA, 20 bp, human
gggaacagcagttggagcct

SEQ ID NO: 4310 - DNA, 20 bp, human
gtagggcggaggccacagca

SEQ ID NO: 4311 - DNA, 20 bp, human
gatctcccaggggcagtagt

SEQ ID NO: 4312 - DNA, 20 bp, human
gccccaagaaaccaccccag

SEQ ID NO: 4313 - DNA, 20 bp, human
gtgcagcctcccaacttcca

SEQ ID NO: 4314 - DNA, 20 bp, human
ggtgggtgagggaccttgaa

SEQ ID NO: 4315 - DNA, 20 bp, human
gttctgcagggagggtcagt

SEQ ID NO: 4316 - DNA, 20 bp, human
gccctcaggagaagtcggga

SEQ ID NO: 4317 - DNA, 20 bp, human
ggctgacgggccacaccaac

SEQ ID NO: 4318 - DNA, 20 bp, human
gtcaggagaagtcgggaagg

SEQ ID NO: 4319 - DNA, 20 bp, human
ggagcaggaggtacacacga

SEQ ID NO: 4320 - DNA, 20 bp, human
gctcctgaggggaaaagacg

SEQ ID NO: 4321 - DNA, 20 bp, human
ggcggcggcggcggttgtcc

SEQ ID NO: 4322 - DNA, 20 bp, human
gcctacgttaacatgacggt

SEQ ID NO: 4323 - DNA, 20 bp, human
gatggccgcggcgccaaggg

SEQ ID NO: 4324 - DNA, 20 bp, human
gggcggcgcgcgcagacgga

SEQ ID NO: 4325 - DNA, 20 bp, human
gccacaccaaccggcacagc

SEQ ID NO: 4326 - DNA, 20 bp, human
gaggggtgattgctgactag

SEQ ID NO: 4327 - DNA, 20 bp, human
gtggacggcgaagtctcctg

SEQ ID NO: 4328 - DNA, 20 bp, human
ggctcccgagcttctgtcag

SEQ ID NO: 4329 - DNA, 20 bp, human
ggctcccctgacagaagctc

SEQ ID NO: 4330 - DNA, 20 bp, human
gctcctgtgagtgaccggga

SEQ ID NO: 4331 - DNA, 20 bp, human
gtgtgcaggacgggcaagga

SEQ ID NO: 4332 - DNA, 20 bp, human
gtcggcgtggggggacccgg

SEQ ID NO: 4333 - DNA, 20 bp, human
gcctacgtggatatcaccgt

SEQ ID NO: 4334 - DNA, 20 bp, human
gggagccgggcgtgcggagg

SEQ ID NO: 4335 - DNA, 20 bp, human
gggtgtggtgccgtcgggtg

SEQ ID NO: 4336 - DNA, 20 bp, human
gtaagcagtcggaaaaccag

SEQ ID NO: 4337 - DNA, 20 bp, human
gtctccagctacagagacag

SEQ ID NO: 4338 - DNA, 20 bp, human
ggctcaggctcgggggaggt

SEQ ID NO: 4339 - DNA, 20 bp, human
gccagttgagccggaaacaa

SEQ ID NO: 4340 - DNA, 20 bp, human
gtgagctggcccagctaagg

SEQ ID NO: 4341 - DNA, 20 bp, human
gggagcgtcggataagcagt

SEQ ID NO: 4342 - DNA, 20 bp, human
gaggcggaaggtggagaagt

SEQ ID NO: 4343 - DNA, 20 bp, human
gcggcggacccagagaccac

SEQ ID NO: 4344 - DNA, 20 bp, human
gccggagctcatggcctcgg

SEQ ID NO: 4345 - DNA, 20 bp, human
gactgctcgtcgccgcggag

SEQ ID NO: 4346 - DNA, 20 bp, human
ggagcgcagtgcgggtcgct

SEQ ID NO: 4347 - DNA, 20 bp, human
gacgagccggggaatctgga

SEQ ID NO: 4348 - DNA, 20 bp, human
ggtgcagcggcgcccaggcg

SEQ ID NO: 4349 - DNA, 20 bp, human
gtggagggagcacacaggaa

SEQ ID NO: 4350 - DNA, 20 bp, human
gcgcactgcgctccccgcct

SEQ ID NO: 4351 - DNA, 20 bp, human
gtagatagtgaacccctcat

SEQ ID NO: 4352 - DNA, 20 bp, human
gccgcgagctggaccagccg

SEQ ID NO: 4353 - DNA, 20 bp, human
gcggcccagcgcgactccag

SEQ ID NO: 4354 - DNA, 20 bp, human
ggaaccaaccaacccatcaa

SEQ ID NO: 4355 - DNA, 20 bp, human
ggcggggacccaagcatcag

SEQ ID NO: 4356 - DNA, 20 bp, human
gtacggtccgctcccacctg

SEQ ID NO: 4357 - DNA, 20 bp, human
ggcgcgcactcgccccaggt

SEQ ID NO: 4358 - DNA, 20 bp, human
ggtgcgcgcacggccaggtt

SEQ ID NO: 4359 - DNA, 20 bp, human
gtctacggcagctattccag

SEQ ID NO: 4360 - DNA, 20 bp, human
ggcgcacccggtacccaacc

SEQ ID NO: 4361 - DNA, 20 bp, human
gcctctggcccacttccggg

SEQ ID NO: 4362 - DNA, 20 bp, human
gggtcgagcctcccggaagt

SEQ ID NO: 4363 - DNA, 20 bp, human
gtcgcctcgcgcgggttcct

SEQ ID NO: 4364 - DNA, 20 bp, human
ggcacggccaggttgggtac

SEQ ID NO: 4365 - DNA, 20 bp, human
ggtacctctggcccacttcc

SEQ ID NO: 4366 - DNA, 20 bp, human
gcgatctggctggtcccgaa

SEQ ID NO: 4367 - DNA, 20 bp, human
gtggaggtcccagtatccag

SEQ ID NO: 4368 - DNA, 20 bp, human
gctcgacccggggccagcag

SEQ ID NO: 4369 - DNA, 20 bp, human
gccgcgaggccgccgcgatc

SEQ ID NO: 4370 - DNA, 20 bp, human
gcccggatgaaagagccctg

SEQ ID NO: 4371 - DNA, 20 bp, human
ggagccggctcaaaggtcag

SEQ ID NO: 4372 - DNA, 20 bp, human
ggcctcgcgggcggtttggt

SEQ ID NO: 4373 - DNA, 20 bp, human
gtggctggtcccgaacggcg

SEQ ID NO: 4374 - DNA, 20 bp, human
gggtaaggccggaaggacgg

SEQ ID NO: 4375 - DNA, 20 bp, human
gggtgcagacctcccccgag

SEQ ID NO: 4376 - DNA, 20 bp, human
gctgttgagtgtgctctcag

SEQ ID NO: 4377 - DNA, 20 bp, human
gagcctgaggctgaacaaag

SEQ ID NO: 4378 - DNA, 20 bp, human
gtggagtgacatataaaaga

SEQ ID NO: 4379 - DNA, 20 bp, human
gaggcacctcttctaatgtt

SEQ ID NO: 4380 - DNA, 20 bp, human
gggtaaggtcaatctcctta

SEQ ID NO: 4381 - DNA, 20 bp, human
gattcaatgcttgaagcctg

SEQ ID NO: 4382 - DNA, 20 bp, human
gtccagctgggaatcagaca

SEQ ID NO: 4383 - DNA, 20 bp, human
gcgattctgtgtagagagac

SEQ ID NO: 4384 - DNA, 20 bp, human
gaacaacatgcgaaatccct

SEQ ID NO: 4385 - DNA, 20 bp, human
gtcattccaaacattagaag

SEQ ID NO: 4386 - DNA, 20 bp, human
ggaagagagccctgagatgg

SEQ ID NO: 4387 - DNA, 20 bp, human
ggaccctcgggagcaggtaa

SEQ ID NO: 4388 - DNA, 20 bp, human
gctggccgggcgctcgcagt

SEQ ID NO: 4389 - DNA, 20 bp, human
gggtaagggtccccaggagg

SEQ ID NO: 4390 - DNA, 20 bp, human
gggatggaagcgggaccctc

SEQ ID NO: 4391 - DNA, 20 bp, human
gaggctgtgtgcagttccgg

SEQ ID NO: 4392 - DNA, 20 bp, human
ggagcggccgggcttggtag

SEQ ID NO: 4393 - DNA, 20 bp, human
gcaaactgggcccccatcgt

SEQ ID NO: 4394 - DNA, 20 bp, human
gggccgcctgacctccgcac

SEQ ID NO: 4395 - DNA, 20 bp, human
ggaggctgtatacagtcctg

SEQ ID NO: 4396 - DNA, 20 bp, human
gcgccgggcccgccaaccac

SEQ ID NO: 4397 - DNA, 20 bp, human
ggcgccccgacgactcgcgg

SEQ ID NO: 4398 - DNA, 20 bp, human
gcggcccccgcgagtcgtcg

SEQ ID NO: 4399 - DNA, 20 bp, human
gcgcgtcgggtaaacctgtt

SEQ ID NO: 4400 - DNA, 20 bp, human
gccggctcccgagtacatgg

SEQ ID NO: 4401 - DNA, 20 bp, human
gccggccgcacgatccgccc

SEQ ID NO: 4402 - DNA, 20 bp, human
gcgcgccggggcggatcgtg

SEQ ID NO: 4403 - DNA, 20 bp, human
gccgacgccgcgagccgcga

SEQ ID NO: 4404 - DNA, 20 bp, human
ggcctcgggcctacacgcgg

SEQ ID NO: 4405 - DNA, 20 bp, human
gcgagcgccaggactcaccg

SEQ ID NO: 4406 - DNA, 20 bp, human
gggaggagcggtgggagcgt

SEQ ID NO: 4407 - DNA, 20 bp, human
ggcagtcgtggaggagcggt

SEQ ID NO: 4408 - DNA, 20 bp, human
ggacagaggggagtcccgtc

SEQ ID NO: 4409 - DNA, 20 bp, human
gcggcggcccgcagtcgtgg

SEQ ID NO: 4410 - DNA, 20 bp, human
gggagcggtgggagcgtcgg

SEQ ID NO: 4411 - DNA, 20 bp, human
gatgtgaggcgcggacagag

SEQ ID NO: 4412 - DNA, 20 bp, human
gcggaaaacggcacaggact

SEQ ID NO: 4413 - DNA, 20 bp, human
gtcggagtgcggttgctcag

SEQ ID NO: 4414 - DNA, 20 bp, human
gaggtgcgcgaggtgagcgt

SEQ ID NO: 4415 - DNA, 20 bp, human
gcacctcgcgcacctgggcc

SEQ ID NO: 4416 - DNA, 20 bp, human
ggaggcgctgggacccggtg

SEQ ID NO: 4417 - DNA, 20 bp, human
ggacctcgggatccacccaa

SEQ ID NO: 4418 - DNA, 20 bp, human
gcccggtgaggagcgagctc

SEQ ID NO: 4419 - DNA, 20 bp, human
gacccgagctcgctcctcac

SEQ ID NO: 4420 - DNA, 20 bp, human
ggtccacagagcccggcagg

SEQ ID NO: 4421 - DNA, 20 bp, human
gcgaacccggcgaggcgacg

SEQ ID NO: 4422 - DNA, 20 bp, human
gcactcttggccccacctcg

SEQ ID NO: 4423 - DNA, 20 bp, human
ggaacgagcgcgcgcccgga

SEQ ID NO: 4424 - DNA, 20 bp, human
gcaccgggctctgcaccctc

SEQ ID NO: 4425 - DNA, 20 bp, human
gcgccgcctgccgggctctg

SEQ ID NO: 4426 - DNA, 20 bp, human
gaggggtggcgggggaatag

SEQ ID NO: 4427 - DNA, 20 bp, human
gggtggcgggggaatagcgg

SEQ ID NO: 4428 - DNA, 20 bp, human
ggtctgggagggccgactgg

SEQ ID NO: 4429 - DNA, 20 bp, human
ggaaaggagaggggccgact

SEQ ID NO: 4430 - DNA, 20 bp, human
gcctcagagagacagcagaa

SEQ ID NO: 4431 - DNA, 20 bp, human
ggagcgtgcacagggaatcc

SEQ ID NO: 4432 - DNA, 20 bp, human
gccatagcggtaggaatggt

SEQ ID NO: 4433 - DNA, 20 bp, human
gtcccgcccacacctcagag

SEQ ID NO: 4434 - DNA, 20 bp, human
gtgaaagcgactaggatgag

SEQ ID NO: 4435 - DNA, 20 bp, human
gggagagattgggtctggga

SEQ ID NO: 4436 - DNA, 20 bp, human
gggaaagacggcgaagagct

SEQ ID NO: 4437 - DNA, 20 bp, human
ggtcgtccagccgaatgagt

SEQ ID NO: 4438 - DNA, 20 bp, human
ggttgcgtaaagaaggactg

SEQ ID NO: 4439 - DNA, 20 bp, human
gggagatagtgagggacaaa

SEQ ID NO: 4440 - DNA, 20 bp, human
gtgaggattcaggaagcttg

SEQ ID NO: 4441 - DNA, 20 bp, human
gggaggcacgcgcattccag

SEQ ID NO: 4442 - DNA, 20 bp, human
gctggggcagatgaggattc

SEQ ID NO: 4443 - DNA, 20 bp, human
ggactgctgggagatagtga

SEQ ID NO: 4444 - DNA, 20 bp, human
ggcaaaggaaaccagaccag

SEQ ID NO: 4445 - DNA, 20 bp, human
gagactgatacgaaggaagt

SEQ ID NO: 4446 - DNA, 20 bp, human
gcggtggagaacatgaggca

SEQ ID NO: 4447 - DNA, 20 bp, human
gcgcagcaggcagacgagcg

SEQ ID NO: 4448 - DNA, 20 bp, human
gaagcacagcgcgcagtaca

SEQ ID NO: 4449 - DNA, 20 bp, human
gccgccgccctcgcaataag

SEQ ID NO: 4450 - DNA, 20 bp, human
ggcagcgccgcggccagaca

SEQ ID NO: 4451 - DNA, 20 bp, human
ggagagcgcgcctgggccgg

SEQ ID NO: 4452 - DNA, 20 bp, human
gctcaggccccttattgcga

SEQ ID NO: 4453 - DNA, 20 bp, human
gccggacggtggagaacatg

SEQ ID NO: 4454 - DNA, 20 bp, human
gtggccccgggcgtctacac

SEQ ID NO: 4455 - DNA, 20 bp, human
gcagacgagcgaggccacgg

SEQ ID NO: 4456 - DNA, 20 bp, human
gccggcccggccctgcgtcg

SEQ ID NO: 4457 - DNA, 20 bp, human
ggtcggggcctcagcgagtg

SEQ ID NO: 4458 - DNA, 20 bp, human
ggcccgaggtcggacggctg

SEQ ID NO: 4459 - DNA, 20 bp, human
ggcggcgggagggcgacctc

SEQ ID NO: 4460 - DNA, 20 bp, human
gggcccagggccgaggagcg

SEQ ID NO: 4461 - DNA, 20 bp, human
ggcgggcgccgcactcgctg

SEQ ID NO: 4462 - DNA, 20 bp, human
gctggggcaggggcgacctc

SEQ ID NO: 4463 - DNA, 20 bp, human
ggatcgccgcgcacaggaag

SEQ ID NO: 4464 - DNA, 20 bp, human
gctggtccagcgcgaggccc

SEQ ID NO: 4465 - DNA, 20 bp, human
ggaacccactcgccctccct

SEQ ID NO: 4466 - DNA, 20 bp, human
gaaggggtaggctccggggg

SEQ ID NO: 4467 - DNA, 20 bp, human
gaaaagcgagactccaccca

SEQ ID NO: 4468 - DNA, 20 bp, human
ggctgtaagtcagccaacac

SEQ ID NO: 4469 - DNA, 20 bp, human
gcctgaagggtccaccccat

SEQ ID NO: 4470 - DNA, 20 bp, human
gagctgagatggagccggct

SEQ ID NO: 4471 - DNA, 20 bp, human
gcggagcctaccccttccag

SEQ ID NO: 4472 - DNA, 20 bp, human
gcgggtgagcgtccctttct

SEQ ID NO: 4473 - DNA, 20 bp, human
gcctggagggaggcgaagag

SEQ ID NO: 4474 - DNA, 20 bp, human
gttccttaggacctctggaa

SEQ ID NO: 4475 - DNA, 20 bp, human
gtgggtgggtaaatgaagcc

SEQ ID NO: 4476 - DNA, 20 bp, human
ggagagcgatctcggcagaa

SEQ ID NO: 4477 - DNA, 20 bp, human
gcagaacggcaggaagcatg

SEQ ID NO: 4478 - DNA, 20 bp, human
gtcgtcctgaggctacgagt

SEQ ID NO: 4479 - DNA, 20 bp, human
gcagcatcttctcagctcgg

SEQ ID NO: 4480 - DNA, 20 bp, human
ggtagcgcatggagtacgtg

SEQ ID NO: 4481 - DNA, 20 bp, human
ggcttcctagagagcgatct

SEQ ID NO: 4482 - DNA, 20 bp, human
gatcgctctctaggaagctg

SEQ ID NO: 4483 - DNA, 20 bp, human
gcggcaggaagcatgcggag

SEQ ID NO: 4484 - DNA, 20 bp, human
gtgcccaggagcacgacgct

SEQ ID NO: 4485 - DNA, 20 bp, human
gctgggcagcaggtagcgca

SEQ ID NO: 4486 - DNA, 20 bp, human
gtaggcagctccaaatcccg

SEQ ID NO: 4487 - DNA, 20 bp, human
gtcggagactttgaggtaag

SEQ ID NO: 4488 - DNA, 20 bp, human
gtacggcagccagagaacac

SEQ ID NO: 4489 - DNA, 20 bp, human
gactcaccgaccgcgaggct

SEQ ID NO: 4490 - DNA, 20 bp, human
gcccgcggcggcggcaaggg

SEQ ID NO: 4491 - DNA, 20 bp, human
gtcgcggtcggtgagtagga

SEQ ID NO: 4492 - DNA, 20 bp, human
gtgggcggcgcagacaaagg

SEQ ID NO: 4493 - DNA, 20 bp, human
ggaaggggaatgacagggga

SEQ ID NO: 4494 - DNA, 20 bp, human
gagctgcctagcctcgcggt

SEQ ID NO: 4495 - DNA, 20 bp, human
ggagcggtcgccgcgggatt

SEQ ID NO: 4496 - DNA, 20 bp, human
gggtagcgcgagccagtggt

SEQ ID NO: 4497 - DNA, 20 bp, human
gcggagctgcgggtaagcgg

SEQ ID NO: 4498 - DNA, 20 bp, human
gggtaagcggaggcacaccg

SEQ ID NO: 4499 - DNA, 20 bp, human
ggagacactccgaagaccga

SEQ ID NO: 4500 - DNA, 20 bp, human
gtacccgcagctccgaccac

SEQ ID NO: 4501 - DNA, 20 bp, human
gcctgggtagcgcgagccag

SEQ ID NO: 4502 - DNA, 20 bp, human
ggtctgggctgaagccaccg

SEQ ID NO: 4503 - DNA, 20 bp, human
ggagccagtggtcggagctg

SEQ ID NO: 4504 - DNA, 20 bp, human
gactcaggagaggtccgcag

SEQ ID NO: 4505 - DNA, 20 bp, human
ggggtgcgccgagtcatgga

SEQ ID NO: 4506 - DNA, 20 bp, human
gtccgggcggcagcacaagg

SEQ ID NO: 4507 - DNA, 20 bp, human
gggaggctgcgggttctctc

SEQ ID NO: 4508 - DNA, 20 bp, human
gcagcacaaggcggtagcca

SEQ ID NO: 4509 - DNA, 20 bp, human
ggaagggaagtgacacgggt

SEQ ID NO: 4510 - DNA, 20 bp, human
gcacaaggcggtagccatgg

SEQ ID NO: 4511 - DNA, 20 bp, human
ggagagagtggactagaccc

SEQ ID NO: 4512 - DNA, 20 bp, human
gggttccgggcggcagcaca

SEQ ID NO: 4513 - DNA, 20 bp, human
ggtccactctctcgaaagag

SEQ ID NO: 4514 - DNA, 20 bp, human
gcatcccggtccctgaaagt

SEQ ID NO: 4515 - DNA, 20 bp, human
gaaggcggtagccatggcgg

SEQ ID NO: 4516 - DNA, 20 bp, human
gcgactcacacaaggcaggt

SEQ ID NO: 4517 - DNA, 20 bp, human
gctagccgccgactcacaca

SEQ ID NO: 4518 - DNA, 20 bp, human
gccgagctgaggtgtcatag

SEQ ID NO: 4519 - DNA, 20 bp, human
gtgagtcggcggctaggatg

SEQ ID NO: 4520 - DNA, 20 bp, human
ggggtgaggaaatccaggta

SEQ ID NO: 4521 - DNA, 20 bp, human
gcaggtgggtgaggaaatcc

SEQ ID NO: 4522 - DNA, 20 bp, human
gaagcgggcaatccgagctg

SEQ ID NO: 4523 - DNA, 20 bp, human
gccgccgactcacacaaggc

SEQ ID NO: 4524 - DNA, 20 bp, human
ggccagctctagccaaagaa

SEQ ID NO: 4525 - DNA, 20 bp, human
ggtcatagtggagaagccta

SEQ ID NO: 4526 - DNA, 20 bp, human
gacttggccagtgctcttgt

SEQ ID NO: 4527 - DNA, 20 bp, human
gttccagattacttaatcag

SEQ ID NO: 4528 - DNA, 20 bp, human
ggaccactgattaagtaatc

SEQ ID NO: 4529 - DNA, 20 bp, human
gacatttccaacaagagcac

SEQ ID NO: 4530 - DNA, 20 bp, human
gtttgcttgcttacctgact

SEQ ID NO: 4531 - DNA, 20 bp, human
ggaagctttcagtaaagggt

SEQ ID NO: 4532 - DNA, 20 bp, human
gcaatctaattgctgacata

SEQ ID NO: 4533 - DNA, 20 bp, human
ggatgtttctggttaaaaat

SEQ ID NO: 4534 - DNA, 20 bp, human
gaattagattgtataaacat

SEQ ID NO: 4535 - DNA, 20 bp, human
gttctggttaaaaatgggtg

SEQ ID NO: 4536 - DNA, 20 bp, human
gccatggcgcaggcgagagg

SEQ ID NO: 4537 - DNA, 20 bp, human
gcgggacgcagctccggagg

SEQ ID NO: 4538 - DNA, 20 bp, human
gacgcggccaccacaaggag

SEQ ID NO: 4539 - DNA, 20 bp, human
gggacgggacgcagctccgg

SEQ ID NO: 4540 - DNA, 20 bp, human
gaacgtggtgctcaccggga

SEQ ID NO: 4541 - DNA, 20 bp, human
gcagcgggcccgggtgggac

SEQ ID NO: 4542 - DNA, 20 bp, human
gcgggtcccgggaaactcgc

SEQ ID NO: 4543 - DNA, 20 bp, human
gccacaaggagcggcagcag

SEQ ID NO: 4544 - DNA, 20 bp, human
gaggcgaacgtggtgctcac

SEQ ID NO: 4545 - DNA, 20 bp, human
ggacgcagctccggaggcgg

SEQ ID NO: 4546 - DNA, 20 bp, human
gcctggggcagaggatgtga

SEQ ID NO: 4547 - DNA, 20 bp, human
gcagaggtgagtcctcaggt

SEQ ID NO: 4548 - DNA, 20 bp, human
gccacgcgaggagcccagat

SEQ ID NO: 4549 - DNA, 20 bp, human
ggaggcagaggtgagtcctc

SEQ ID NO: 4550 - DNA, 20 bp, human
gctctgtggggtctctatct

SEQ ID NO: 4551 - DNA, 20 bp, human
ggggtggccgggaactctct

SEQ ID NO: 4552 - DNA, 20 bp, human
gtatccttggagtcccctct

SEQ ID NO: 4553 - DNA, 20 bp, human
gactctctaggcaagaatcc

SEQ ID NO: 4554 - DNA, 20 bp, human
gtctatctgggcacctagag

SEQ ID NO: 4555 - DNA, 20 bp, human
gataagccaagggcacgggg

SEQ ID NO: 4556 - DNA, 20 bp, human
gacagcagaaggtaagccgg

SEQ ID NO: 4557 - DNA, 20 bp, human
ggcagtctgtctcgagggag

SEQ ID NO: 4558 - DNA, 20 bp, human
gctgtctcgagggaggggta

SEQ ID NO: 4559 - DNA, 20 bp, human
gctcctgtaagaccccaggt

SEQ ID NO: 4560 - DNA, 20 bp, human
ggggtagggtgaccactctg

SEQ ID NO: 4561 - DNA, 20 bp, human
ggagagagacaagaccgaga

SEQ ID NO: 4562 - DNA, 20 bp, human
ggtcaggcagtctgtctcga

SEQ ID NO: 4563 - DNA, 20 bp, human
gagggcttgtgcaggaattg

SEQ ID NO: 4564 - DNA, 20 bp, human
gtgatggcaagaggacccgg

SEQ ID NO: 4565 - DNA, 20 bp, human
gccaggtgggcaccgagtgg

SEQ ID NO: 4566 - DNA, 20 bp, human
gagctcgggcccgagagaaa

SEQ ID NO: 4567 - DNA, 20 bp, human
gttgagggaaagccctgacg

SEQ ID NO: 4568 - DNA, 20 bp, human
gactgcagcagggcgctcac

SEQ ID NO: 4569 - DNA, 20 bp, human
gtgggacggggatccaccga

SEQ ID NO: 4570 - DNA, 20 bp, human
gtaaggggcgcagggatccg

SEQ ID NO: 4571 - DNA, 20 bp, human
gcgctcaccggctcaggatg

SEQ ID NO: 4572 - DNA, 20 bp, human
gctccgcaaggtctgggacg

SEQ ID NO: 4573 - DNA, 20 bp, human
ggataccctccgcaaggtct

SEQ ID NO: 4574 - DNA, 20 bp, human
gccagtccccggaccctcgg

SEQ ID NO: 4575 - DNA, 20 bp, human
gatcgggcgcggtctctggg

SEQ ID NO: 4576 - DNA, 20 bp, human
gagtgacaggacgtctggac

SEQ ID NO: 4577 - DNA, 20 bp, human
gaaagtgtggccagctccag

SEQ ID NO: 4578 - DNA, 20 bp, human
ggccgcggcggtgatcgatg

SEQ ID NO: 4579 - DNA, 20 bp, human
gcaggcgctgaccagaacta

SEQ ID NO: 4580 - DNA, 20 bp, human
gcagcgagtgacaggacgtc

SEQ ID NO: 4581 - DNA, 20 bp, human
gcatgcttgggggacttcaa

SEQ ID NO: 4582 - DNA, 20 bp, human
gtctggaatgggagggaaca

SEQ ID NO: 4583 - DNA, 20 bp, human
gccttgcactcggaagagtt

SEQ ID NO: 4584 - DNA, 20 bp, human
ggagcggacccagcgagtga

SEQ ID NO: 4585 - DNA, 20 bp, human
gggcggtgatcgatggggag

SEQ ID NO: 4586 - DNA, 20 bp, human
ggctaaagataagcatacaa

SEQ ID NO: 4587 - DNA, 20 bp, human
gcgtaatagcaccagatctc

SEQ ID NO: 4588 - DNA, 20 bp, human
gaagaaggaaaccagagatc

SEQ ID NO: 4589 - DNA, 20 bp, human
gctcttacaggagtgtgttt

SEQ ID NO: 4590 - DNA, 20 bp, human
gagttttgctctttattagg

SEQ ID NO: 4591 - DNA, 20 bp, human
gtctgcagcctgaattttga

SEQ ID NO: 4592 - DNA, 20 bp, human
gtactcgttctctcagacgc

SEQ ID NO: 4593 - DNA, 20 bp, human
gcaaccagtaagtcttcaag

SEQ ID NO: 4594 - DNA, 20 bp, human
gaaaagttttgctctttatt

SEQ ID NO: 4595 - DNA, 20 bp, human
gaaatacagtgttaaaacac

SEQ ID NO: 4596 - DNA, 20 bp, human
gggcagctccatcccgactc

SEQ ID NO: 4597 - DNA, 20 bp, human
gccatcccgactcaggccga

SEQ ID NO: 4598 - DNA, 20 bp, human
gaacggtgctgggacccggg

SEQ ID NO: 4599 - DNA, 20 bp, human
ggcagccgcggggggctcct

SEQ ID NO: 4600 - DNA, 20 bp, human
gaggtgccctcggcctgagt

SEQ ID NO: 4601 - DNA, 20 bp, human
gccccacgcaagaaggagat

SEQ ID NO: 4602 - DNA, 20 bp, human
gctcctaggctccgaactcg

SEQ ID NO: 4603 - DNA, 20 bp, human
gacgcccagaattcccctgg

SEQ ID NO: 4604 - DNA, 20 bp, human
gcccgacttagcaaacaagg

SEQ ID NO: 4605 - DNA, 20 bp, human
gcctgctgtgaacctgaagg

SEQ ID NO: 4606 - DNA, 20 bp, human
ggatctgtgggtgggaacat

SEQ ID NO: 4607 - DNA, 20 bp, human
gggttcccgagcggcaggtt

SEQ ID NO: 4608 - DNA, 20 bp, human
gcaaccaggaaggagtcccc

SEQ ID NO: 4609 - DNA, 20 bp, human
gcccagcagggcggacacag

SEQ ID NO: 4610 - DNA, 20 bp, human
ggtcaccagcagcttgtgag

SEQ ID NO: 4611 - DNA, 20 bp, human
gcggctgccatgatgcgagg

SEQ ID NO: 4612 - DNA, 20 bp, human
gaccaggaacccactcacac

SEQ ID NO: 4613 - DNA, 20 bp, human
gctgctggtgacccccccca

SEQ ID NO: 4614 - DNA, 20 bp, human
gcctggtctggaacacgtac

SEQ ID NO: 4615 - DNA, 20 bp, human
gccaaggccagtgcagcccc

SEQ ID NO: 4616 - DNA, 20 bp, human
gcggaagtgaccaggcacaa

SEQ ID NO: 4617 - DNA, 20 bp, human
gcctgggagcggaagtgacc

SEQ ID NO: 4618 - DNA, 20 bp, human
gctcagaaagccaaccccca

SEQ ID NO: 4619 - DNA, 20 bp, human
gctccaatctgcttccatgg

SEQ ID NO: 4620 - DNA, 20 bp, human
gcaggaaaggatgcatctca

SEQ ID NO: 4621 - DNA, 20 bp, human
ggggagaaatgactctaatc

SEQ ID NO: 4622 - DNA, 20 bp, human
gcagtagaggatcagcgaga

SEQ ID NO: 4623 - DNA, 20 bp, human
gggaatgttagacctgggtg

SEQ ID NO: 4624 - DNA, 20 bp, human
gattctggaatgttagacct

SEQ ID NO: 4625 - DNA, 20 bp, human
ggccgtaagtggaaaccagg

SEQ ID NO: 4626 - DNA, 20 bp, human
gaggcctgcagaccgctcag

SEQ ID NO: 4627 - DNA, 20 bp, human
ggagcaggcagcgttgcaag

SEQ ID NO: 4628 - DNA, 20 bp, human
ggaaggacccagaagcgcgg

SEQ ID NO: 4629 - DNA, 20 bp, human
gggcgctgtccgaggcgagc

SEQ ID NO: 4630 - DNA, 20 bp, human
ggtcgcgcggcctggacccg

SEQ ID NO: 4631 - DNA, 20 bp, human
gcccgcgaaggcactctcgg

SEQ ID NO: 4632 - DNA, 20 bp, human
gcaacgctgcctgctcgcct

SEQ ID NO: 4633 - DNA, 20 bp, human
ggtgtgagcccggcccgtgg

SEQ ID NO: 4634 - DNA, 20 bp, human
gcgggagacgtggccgccac

SEQ ID NO: 4635 - DNA, 20 bp, human
gcagggtaatgcgcagagcg

SEQ ID NO: 4636 - DNA, 20 bp, human
gctgggaacaggaactgggc

SEQ ID NO: 4637 - DNA, 20 bp, human
gaggccccccgagcagggtc

SEQ ID NO: 4638 - DNA, 20 bp, human
ggccgaggctgcgattccag

SEQ ID NO: 4639 - DNA, 20 bp, human
gatgctggcggcactcgtga

SEQ ID NO: 4640 - DNA, 20 bp, human
ggcggcactcgtgatggaaa

SEQ ID NO: 4641 - DNA, 20 bp, human
gggtccggtccaggcctagg

SEQ ID NO: 4642 - DNA, 20 bp, human
gtcagtctgggaacaggaac

SEQ ID NO: 4643 - DNA, 20 bp, human
ggtgatggaaacgggcgaag

SEQ ID NO: 4644 - DNA, 20 bp, human
gtctgcgagccgcaaactgg

SEQ ID NO: 4645 - DNA, 20 bp, human
gctccgcgggagagcacacc

SEQ ID NO: 4646 - DNA, 20 bp, human
ggtgacgccacgtcaagtac

SEQ ID NO: 4647 - DNA, 20 bp, human
gttgcgtacagcggaggtgg

SEQ ID NO: 4648 - DNA, 20 bp, human
gcaaggcagccggacagcga

SEQ ID NO: 4649 - DNA, 20 bp, human
gggcagccggacagcgacgg

SEQ ID NO: 4650 - DNA, 20 bp, human
gggtggcggcgcgggcaggt

SEQ ID NO: 4651 - DNA, 20 bp, human
gttgtctgttcggcagccca

SEQ ID NO: 4652 - DNA, 20 bp, human
gacggcggaggtgatgtagg

SEQ ID NO: 4653 - DNA, 20 bp, human
gaagggacgcgagcaagccc

SEQ ID NO: 4654 - DNA, 20 bp, human
gggcgcccaagaaggtgcgg

SEQ ID NO: 4655 - DNA, 20 bp, human
gaagcaggccaaggagatcg

SEQ ID NO: 4656 - DNA, 20 bp, human
gggagtattgcttctgactg

SEQ ID NO: 4657 - DNA, 20 bp, human
gtgttactgttgagacacag

SEQ ID NO: 4658 - DNA, 20 bp, human
gcaatgctcgcggcgagaag

SEQ ID NO: 4659 - DNA, 20 bp, human
ggtgtctgggagcattgtgt

SEQ ID NO: 4660 - DNA, 20 bp, human
gtcaataaacacccactcct

SEQ ID NO: 4661 - DNA, 20 bp, human
ggagacacagaggcgggagt

SEQ ID NO: 4662 - DNA, 20 bp, human
gtctcaagggaatcaatctc

SEQ ID NO: 4663 - DNA, 20 bp, human
gaagaaacttgagacaggga

SEQ ID NO: 4664 - DNA, 20 bp, human
gtctgagacttagcaggttt

SEQ ID NO: 4665 - DNA, 20 bp, human
gtctgaagtgggaatcagac

SEQ ID NO: 4666 - DNA, 20 bp, human
gctccgcctcggaggggctc

SEQ ID NO: 4667 - DNA, 20 bp, human
gggcggggccgaccaagagc

SEQ ID NO: 4668 - DNA, 20 bp, human
gtctgagccggtggttgcag

SEQ ID NO: 4669 - DNA, 20 bp, human
gccgcctccgctgcaaccac

SEQ ID NO: 4670 - DNA, 20 bp, human
ggcagcggaggcggtgatgt

SEQ ID NO: 4671 - DNA, 20 bp, human
gccgaggagagggagcgcta

SEQ ID NO: 4672 - DNA, 20 bp, human
ggggccggcagctaacagaa

SEQ ID NO: 4673 - DNA, 20 bp, human
gaggccctggtcagccccga

SEQ ID NO: 4674 - DNA, 20 bp, human
gcacagtcaagaaggtactg

SEQ ID NO: 4675 - DNA, 20 bp, human
ggcgccgcgcacagtcaaga

SEQ ID NO: 4676 - DNA, 20 bp, human
gaggtaaggcgagctcgcag

SEQ ID NO: 4677 - DNA, 20 bp, human
gggcgagggcgagagacgga

SEQ ID NO: 4678 - DNA, 20 bp, human
gatggtgagcggcgaaggta

SEQ ID NO: 4679 - DNA, 20 bp, human
gggagcaggaggactacgcg

SEQ ID NO: 4680 - DNA, 20 bp, human
gcccccccaatagcaaacct

SEQ ID NO: 4681 - DNA, 20 bp, human
gccccaatagcaaacctggg

SEQ ID NO: 4682 - DNA, 20 bp, human
gaccatccggaaccccaggg

SEQ ID NO: 4683 - DNA, 20 bp, human
ggcggaccagacagacagac

SEQ ID NO: 4684 - DNA, 20 bp, human
gtccggatggtgagcggcga

SEQ ID NO: 4685 - DNA, 20 bp, human
gagacgctggctttgggtgg

SEQ ID NO: 4686 - DNA, 20 bp, human
ggcgcgtgcgcgaagtgagg

SEQ ID NO: 4687 - DNA, 20 bp, human
gtaagaatcgggagtaggaa

SEQ ID NO: 4688 - DNA, 20 bp, human
gcgacacgccgcccaggaga

SEQ ID NO: 4689 - DNA, 20 bp, human
ggcggcgcgtgcgcgaagtg

SEQ ID NO: 4690 - DNA, 20 bp, human
gctctccgtgagtacatcat

SEQ ID NO: 4691 - DNA, 20 bp, human
gcggcgcgctgtccgcactg

SEQ ID NO: 4692 - DNA, 20 bp, human
ggtgtcctgaaagcaagccg

SEQ ID NO: 4693 - DNA, 20 bp, human
ggcactgcggcacagagccg

SEQ ID NO: 4694 - DNA, 20 bp, human
gcacgggtcgctggcgggtt

SEQ ID NO: 4695 - DNA, 20 bp, human
ggaagcgcaaaagtacggtg

SEQ ID NO: 4696 - DNA, 20 bp, human
ggcgggcggtgcagtccccg

SEQ ID NO: 4697 - DNA, 20 bp, human
gcggcgacgagccccgttcc

SEQ ID NO: 4698 - DNA, 20 bp, human
ggcggtgctgcggctactgg

SEQ ID NO: 4699 - DNA, 20 bp, human
gtcggggtccggggcaccaa

SEQ ID NO: 4700 - DNA, 20 bp, human
gctgccagacccgcccggaa

SEQ ID NO: 4701 - DNA, 20 bp, human
gcgacgagccccgttccggg

SEQ ID NO: 4702 - DNA, 20 bp, human
ggagccaacagtccgccctc

SEQ ID NO: 4703 - DNA, 20 bp, human
ggccccgttccgggcgggtc

SEQ ID NO: 4704 - DNA, 20 bp, human
ggactgttggctccactgca

SEQ ID NO: 4705 - DNA, 20 bp, human
gtctccggagggcggactgt

SEQ ID NO: 4706 - DNA, 20 bp, human
gcggtgcgcgccaggagagg

SEQ ID NO: 4707 - DNA, 20 bp, human
ggtctcgcctagagttggaa

SEQ ID NO: 4708 - DNA, 20 bp, human
gcagcggtgcgcgccaggag

SEQ ID NO: 4709 - DNA, 20 bp, human
gtagccgaggccccacaaca

SEQ ID NO: 4710 - DNA, 20 bp, human
gtgcacaatgaggccactga

SEQ ID NO: 4711 - DNA, 20 bp, human
ggtgcccaggccgggatgtg

SEQ ID NO: 4712 - DNA, 20 bp, human
gcatcgcacacaaccctcag

SEQ ID NO: 4713 - DNA, 20 bp, human
ggcgaggtctcgcctagagt

SEQ ID NO: 4714 - DNA, 20 bp, human
ggtggcctcattgtgcagag

SEQ ID NO: 4715 - DNA, 20 bp, human
gtctaggcgagacctcgctt

SEQ ID NO: 4716 - DNA, 20 bp, human
gacagacccgcggaagagtg

SEQ ID NO: 4717 - DNA, 20 bp, human
gggtgtccggacatggacac

SEQ ID NO: 4718 - DNA, 20 bp, human
gctgcggctgccctgaatgt

SEQ ID NO: 4719 - DNA, 20 bp, human
gagtgaggcaagcaggtgtc

SEQ ID NO: 4720 - DNA, 20 bp, human
gtggctcctgtgtccatgtc

SEQ ID NO: 4721 - DNA, 20 bp, human
ggcaagcaggtgtccggaca

SEQ ID NO: 4722 - DNA, 20 bp, human
ggcaagcacacggtcatctg

SEQ ID NO: 4723 - DNA, 20 bp, human
gagagcgtctgtagcttcct

SEQ ID NO: 4724 - DNA, 20 bp, human
gcgacctgcagctgacagac

SEQ ID NO: 4725 - DNA, 20 bp, human
gttccaaggagcctgggtgt

SEQ ID NO: 4726 - DNA, 20 bp, human
ggcgacagagacagtctcag

SEQ ID NO: 4727 - DNA, 20 bp, human
ggtccgaggtcggccgcccg

SEQ ID NO: 4728 - DNA, 20 bp, human
gcagtctcagaggccgggag

SEQ ID NO: 4729 - DNA, 20 bp, human
gggaacctacagccacggac

SEQ ID NO: 4730 - DNA, 20 bp, human
gatgggagaagagactccag

SEQ ID NO: 4731 - DNA, 20 bp, human
ggagcaggaacctacagcca

SEQ ID NO: 4732 - DNA, 20 bp, human
gcagggaccgcgagtgacag

SEQ ID NO: 4733 - DNA, 20 bp, human
gccggctccggcgcacgggg

SEQ ID NO: 4734 - DNA, 20 bp, human
gcacggacaggtagaacgcg

SEQ ID NO: 4735 - DNA, 20 bp, human
gtgccgcgggcggccgacct

SEQ ID NO: 4736 - DNA, 20 bp, human
ggaccgccagctcagaacag

SEQ ID NO: 4737 - DNA, 20 bp, human
gctgcgtcctctcgggacag

SEQ ID NO: 4738 - DNA, 20 bp, human
ggttctgagctggcggtccg

SEQ ID NO: 4739 - DNA, 20 bp, human
gcctctcgggacagtggcgt

SEQ ID NO: 4740 - DNA, 20 bp, human
ggcgccgcgcctcaacgcct

SEQ ID NO: 4741 - DNA, 20 bp, human
gtggcctgggtcgctcacgg

SEQ ID NO: 4742 - DNA, 20 bp, human
gctcggaacagagcgtcgac

SEQ ID NO: 4743 - DNA, 20 bp, human
ggggcagccgtgtagccgaa

SEQ ID NO: 4744 - DNA, 20 bp, human
ggctccacctgcgtcctctc

SEQ ID NO: 4745 - DNA, 20 bp, human
gcagcttccgttcggctaca

SEQ ID NO: 4746 - DNA, 20 bp, human
gcggaacgcccggggagtga

SEQ ID NO: 4747 - DNA, 20 bp, human
gaggctcaggcacacccgcg

SEQ ID NO: 4748 - DNA, 20 bp, human
gctcgcatcccgggaacccg

SEQ ID NO: 4749 - DNA, 20 bp, human
gcgagggcgccaggtccggg

SEQ ID NO: 4750 - DNA, 20 bp, human
gggctcagaacactctcgag

SEQ ID NO: 4751 - DNA, 20 bp, human
gggcgccctcggcccgacag

SEQ ID NO: 4752 - DNA, 20 bp, human
gtcagccggggaccacgggt

SEQ ID NO: 4753 - DNA, 20 bp, human
gcggctgtgaggccccgtgg

SEQ ID NO: 4754 - DNA, 20 bp, human
ggccagggcgcgctgccccg

SEQ ID NO: 4755 - DNA, 20 bp, human
gcacagccggacaggcccgt

SEQ ID NO: 4756 - DNA, 20 bp, human
ggagctggtggcgccgcgat

SEQ ID NO: 4757 - DNA, 20 bp, human
gcgccaccaacgtcaacaac

SEQ ID NO: 4758 - DNA, 20 bp, human
gctggcactaagcggtcctg

SEQ ID NO: 4759 - DNA, 20 bp, human
gctctgacaaccctcctctg

SEQ ID NO: 4760 - DNA, 20 bp, human
gggtcctgaggctgtggcta

SEQ ID NO: 4761 - DNA, 20 bp, human
gagactaggagataacgccc

SEQ ID NO: 4762 - DNA, 20 bp, human
gagcggccgcaagcacctcc

SEQ ID NO: 4763 - DNA, 20 bp, human
gtagccctgtccggagatgg

SEQ ID NO: 4764 - DNA, 20 bp, human
ggcatccagcccgagcaggg

SEQ ID NO: 4765 - DNA, 20 bp, human
ggccatcggctctcctatcg

SEQ ID NO: 4766 - DNA, 20 bp, human
gccctcaggccacagacggt

SEQ ID NO: 4767 - DNA, 20 bp, human
ggtggactgggcggaaaaca

SEQ ID NO: 4768 - DNA, 20 bp, human
gcatggcggcgtggactggg

SEQ ID NO: 4769 - DNA, 20 bp, human
gggaaaacaaggaaaggccg

SEQ ID NO: 4770 - DNA, 20 bp, human
gacagacggtgggagtggaa

SEQ ID NO: 4771 - DNA, 20 bp, human
gtgggagtggaaaggtctgt

SEQ ID NO: 4772 - DNA, 20 bp, human
gtcgggagagtccttgagta

SEQ ID NO: 4773 - DNA, 20 bp, human
gaaggccctcaggccacaga

SEQ ID NO: 4774 - DNA, 20 bp, human
ggtacggagaccggctagga

SEQ ID NO: 4775 - DNA, 20 bp, human
gacgctggcttcggagcctt

SEQ ID NO: 4776 - DNA, 20 bp, human
gggaaaggtagacccatgga

SEQ ID NO: 4777 - DNA, 20 bp, human
gaaagcccaccaccctccat

SEQ ID NO: 4778 - DNA, 20 bp, human
ggccctggcaggcgtgcagg

SEQ ID NO: 4779 - DNA, 20 bp, human
ggctgggaaaggtagaccca

SEQ ID NO: 4780 - DNA, 20 bp, human
ggaggccctggcaggcgtgc

SEQ ID NO: 4781 - DNA, 20 bp, human
gaagacaaaggagcaggacg

SEQ ID NO: 4782 - DNA, 20 bp, human
gtgcgatgatccagaaactg

SEQ ID NO: 4783 - DNA, 20 bp, human
ggtagacccatggagggtgg

SEQ ID NO: 4784 - DNA, 20 bp, human
ggtgtacatggagctcaatc

SEQ ID NO: 4785 - DNA, 20 bp, human
gtgcaggtggttggaggctt

SEQ ID NO: 4786 - DNA, 20 bp, human
gcacgcaccctcaagagtgt

SEQ ID NO: 4787 - DNA, 20 bp, human
ggacacgggatacaatgcag

SEQ ID NO: 4788 - DNA, 20 bp, human
gtctgcctgggtagagaaaa

SEQ ID NO: 4789 - DNA, 20 bp, human
gtgtgccaagctatagatgt

SEQ ID NO: 4790 - DNA, 20 bp, human
gtggaaacaacgagagacac

SEQ ID NO: 4791 - DNA, 20 bp, human
gctgaaggtgagcccaacct

SEQ ID NO: 4792 - DNA, 20 bp, human
gagtggaggaagaggataat

SEQ ID NO: 4793 - DNA, 20 bp, human
ggtcacgattttcccaggtt

SEQ ID NO: 4794 - DNA, 20 bp, human
gctgaggtcacgattttccc

SEQ ID NO: 4795 - DNA, 20 bp, human
gtggagactggggggtgccg

SEQ ID NO: 4796 - DNA, 20 bp, human
ggacactctggacaccacta

SEQ ID NO: 4797 - DNA, 20 bp, human
gttctggcctgagacttgca

SEQ ID NO: 4798 - DNA, 20 bp, human
gccactatggacaggtaaag

SEQ ID NO: 4799 - DNA, 20 bp, human
gaaagaggcagtcttctcgt

SEQ ID NO: 4800 - DNA, 20 bp, human
gagcagtactgtactaaaaa

SEQ ID NO: 4801 - DNA, 20 bp, human
gagagactcaaatcatgaaa

SEQ ID NO: 4802 - DNA, 20 bp, human
gcaaccatggtacaaatctc

SEQ ID NO: 4803 - DNA, 20 bp, human
ggtctgaaacagaaagaatt

SEQ ID NO: 4804 - DNA, 20 bp, human
gtctggacaccactatggac

SEQ ID NO: 4805 - DNA, 20 bp, human
gcgtcctgagatttgtacca

SEQ ID NO: 4806 - DNA, 20 bp, human
gccctagagcagcctcgctg

SEQ ID NO: 4807 - DNA, 20 bp, human
gggtagtgcgcgcagctcag

SEQ ID NO: 4808 - DNA, 20 bp, human
ggagacaccgacagaaacaa

SEQ ID NO: 4809 - DNA, 20 bp, human
ggccaaggcttctcagggtg

SEQ ID NO: 4810 - DNA, 20 bp, human
gccctcggctccggaggtag

SEQ ID NO: 4811 - DNA, 20 bp, human
ggccatgatagctaccgagg

SEQ ID NO: 4812 - DNA, 20 bp, human
gacaacggctccgctctctg

SEQ ID NO: 4813 - DNA, 20 bp, human
ggaagccttggctgcagata

SEQ ID NO: 4814 - DNA, 20 bp, human
ggccccagcgaggctgctct

SEQ ID NO: 4815 - DNA, 20 bp, human
ggagccgcaaagtttggctg

SEQ ID NO: 4816 - DNA, 20 bp, human
gagcagatgctggtagaggt

SEQ ID NO: 4817 - DNA, 20 bp, human
gtgtggcaggagggcaataa

SEQ ID NO: 4818 - DNA, 20 bp, human
gggtagaaggaagaactaag

SEQ ID NO: 4819 - DNA, 20 bp, human
gggcttctgagaagactggt

SEQ ID NO: 4820 - DNA, 20 bp, human
gtaattggagaggtgtccag

SEQ ID NO: 4821 - DNA, 20 bp, human
gggaaggcttctgagaagac

SEQ ID NO: 4822 - DNA, 20 bp, human
ggaatgagatggacagacct

SEQ ID NO: 4823 - DNA, 20 bp, human
ggatcgtctaggaattgcta

SEQ ID NO: 4824 - DNA, 20 bp, human
gactgtaggcggtggagaca

SEQ ID NO: 4825 - DNA, 20 bp, human
gtgagctatgagccaaacca

SEQ ID NO: 4826 - DNA, 20 bp, human
ggacgcggcgagggacgagg

SEQ ID NO: 4827 - DNA, 20 bp, human
gaggcacaggcgcctggtcc

SEQ ID NO: 4828 - DNA, 20 bp, human
ggcggacgcggcgagggacg

SEQ ID NO: 4829 - DNA, 20 bp, human
ggtgtggccgcgggaccgag

SEQ ID NO: 4830 - DNA, 20 bp, human
gaggaagagggtagatctgg

SEQ ID NO: 4831 - DNA, 20 bp, human
gcacggcctcgcggaaggag

SEQ ID NO: 4832 - DNA, 20 bp, human
ggctccaggcttcgcggacg

SEQ ID NO: 4833 - DNA, 20 bp, human
gccgccggctccaggcttcg

SEQ ID NO: 4834 - DNA, 20 bp, human
ggtcgcctccgactccaggt

SEQ ID NO: 4835 - DNA, 20 bp, human
gaggcacctgagggaagccc

SEQ ID NO: 4836 - DNA, 20 bp, human
gaatgtgcgtgtgaagagac

SEQ ID NO: 4837 - DNA, 20 bp, human
gaggaggaggtcccgaatag

SEQ ID NO: 4838 - DNA, 20 bp, human
gggtcgtgcgtgagaggaaa

SEQ ID NO: 4839 - DNA, 20 bp, human
gaggcctcaagccgactact

SEQ ID NO: 4840 - DNA, 20 bp, human
gcctcctcccagctccgggt

SEQ ID NO: 4841 - DNA, 20 bp, human
gcgcacacggtccgcaccaa

SEQ ID NO: 4842 - DNA, 20 bp, human
gaatctcttgaaggtcaggt

SEQ ID NO: 4843 - DNA, 20 bp, human
ggagatttgaacccagtagt

SEQ ID NO: 4844 - DNA, 20 bp, human
gggtcaaacaccgtgagccc

SEQ ID NO: 4845 - DNA, 20 bp, human
gcccgtcggtcgtgcgtgag

SEQ ID NO: 4846 - DNA, 20 bp, human
gcgcctcgggtcagtaactc

SEQ ID NO: 4847 - DNA, 20 bp, human
gggccgggaagggcgaaccg

SEQ ID NO: 4848 - DNA, 20 bp, human
gactcgggaagacgaccaag

SEQ ID NO: 4849 - DNA, 20 bp, human
gaccggggaagagggaacac

SEQ ID NO: 4850 - DNA, 20 bp, human
gttcccgagttactgacccg

SEQ ID NO: 4851 - DNA, 20 bp, human
gggaccgggacccggaagag

SEQ ID NO: 4852 - DNA, 20 bp, human
ggctgagtcacgccccgccc

SEQ ID NO: 4853 - DNA, 20 bp, human
ggacggtcctcgcaagatcc

SEQ ID NO: 4854 - DNA, 20 bp, human
gtacccagcggaccctcgga

SEQ ID NO: 4855 - DNA, 20 bp, human
gaccggccgcttctacccag

SEQ ID NO: 4856 - DNA, 20 bp, human
gggcctggaacacggagcag

SEQ ID NO: 4857 - DNA, 20 bp, human
gtgggcaggtagagacacag

SEQ ID NO: 4858 - DNA, 20 bp, human
ggtgtccggagtgctagcca

SEQ ID NO: 4859 - DNA, 20 bp, human
gccggagtgctagccagggt

SEQ ID NO: 4860 - DNA, 20 bp, human
gcaggcccagcagtggactg

SEQ ID NO: 4861 - DNA, 20 bp, human
gggggaaggggggcacgagg

SEQ ID NO: 4862 - DNA, 20 bp, human
gtcgggcagaggaactccac

SEQ ID NO: 4863 - DNA, 20 bp, human
gacatttgagctgggaacca

SEQ ID NO: 4864 - DNA, 20 bp, human
gggcagaggaactccactgg

SEQ ID NO: 4865 - DNA, 20 bp, human
gaaaggggaggtgacctcca

SEQ ID NO: 4866 - DNA, 20 bp, human
ggcggagcccccacactcga

SEQ ID NO: 4867 - DNA, 20 bp, human
ggtcctgccttcgagtgtgg

SEQ ID NO: 4868 - DNA, 20 bp, human
gcttccaggcgtcctagggg

SEQ ID NO: 4869 - DNA, 20 bp, human
ggcttgccctgagctccgtg

SEQ ID NO: 4870 - DNA, 20 bp, human
ggtggcttccaggcgtccta

SEQ ID NO: 4871 - DNA, 20 bp, human
gaactgcacgtgcagaggcg

SEQ ID NO: 4872 - DNA, 20 bp, human
ggctcacctgggctcggcgc

SEQ ID NO: 4873 - DNA, 20 bp, human
ggggatcagatgccacccct

SEQ ID NO: 4874 - DNA, 20 bp, human
gctgggctcgggaaccgctt

SEQ ID NO: 4875 - DNA, 20 bp, human
gccccggcccggcacgttag

SEQ ID NO: 4876 - DNA, 20 bp, human
ggtacccagctaccaggtaa

SEQ ID NO: 4877 - DNA, 20 bp, human
gtcccccagttgccaggtaa

SEQ ID NO: 4878 - DNA, 20 bp, human
gtggggcgcagccaggtggt

SEQ ID NO: 4879 - DNA, 20 bp, human
gcaagcgccatgttcgccag

SEQ ID NO: 4880 - DNA, 20 bp, human
ggattgccatccgcagcacc

SEQ ID NO: 4881 - DNA, 20 bp, human
ggtagctgggtacccttacc

SEQ ID NO: 4882 - DNA, 20 bp, human
gcggccagtacaggtcaccc

SEQ ID NO: 4883 - DNA, 20 bp, human
gggacacgggtggatgctgg

SEQ ID NO: 4884 - DNA, 20 bp, human
gtcagaaggtgccgctgcgg

SEQ ID NO: 4885 - DNA, 20 bp, human
ggatagagcagtaagacagc

SEQ ID NO: 4886 - DNA, 20 bp, human
ggcccagccccggtaccaaa

SEQ ID NO: 4887 - DNA, 20 bp, human
gaccaaagggcagctccgag

SEQ ID NO: 4888 - DNA, 20 bp, human
ggctccggtccgactcccct

SEQ ID NO: 4889 - DNA, 20 bp, human
gttggactctgggctcgcag

SEQ ID NO: 4890 - DNA, 20 bp, human
ggagctgccctttggtaccg

SEQ ID NO: 4891 - DNA, 20 bp, human
gatcccagcccagtcaccaa

SEQ ID NO: 4892 - DNA, 20 bp, human
ggactctgggctcgcagcgg

SEQ ID NO: 4893 - DNA, 20 bp, human
gcggagcaaacagccacccc

SEQ ID NO: 4894 - DNA, 20 bp, human
gccacgccgaaatggttcct

SEQ ID NO: 4895 - DNA, 20 bp, human
gtcgtgggggacgaagccgg

SEQ ID NO: 4896 - DNA, 20 bp, human
ggagagcccaatcgcatcag

SEQ ID NO: 4897 - DNA, 20 bp, human
gaggctgggtgccaattccc

SEQ ID NO: 4898 - DNA, 20 bp, human
ggacacccagcacctaggct

SEQ ID NO: 4899 - DNA, 20 bp, human
gacagactcagcctgggaat

SEQ ID NO: 4900 - DNA, 20 bp, human
ggtgctcccctgatgcgatt

SEQ ID NO: 4901 - DNA, 20 bp, human
gacagtctgcgtggggaccc

SEQ ID NO: 4902 - DNA, 20 bp, human
gctctactcacagtctgcgt

SEQ ID NO: 4903 - DNA, 20 bp, human
ggggagcacggcccagcagc

SEQ ID NO: 4904 - DNA, 20 bp, human
ggaaaggggaaagtctgtca

SEQ ID NO: 4905 - DNA, 20 bp, human
gagtgggggtgagaagcagt

SEQ ID NO: 4906 - DNA, 20 bp, human
gcctagagaagacaaggcta

SEQ ID NO: 4907 - DNA, 20 bp, human
gagaagacaaggctaggggc

SEQ ID NO: 4908 - DNA, 20 bp, human
ggtggtcgcccagaaagtcg

SEQ ID NO: 4909 - DNA, 20 bp, human
gtgctccccgacctgaaggt

SEQ ID NO: 4910 - DNA, 20 bp, human
gaccgaatcgagaattaggg

SEQ ID NO: 4911 - DNA, 20 bp, human
ggggaccgaatcgagaatta

SEQ ID NO: 4912 - DNA, 20 bp, human
gagtcctgccgggtccacgg

SEQ ID NO: 4913 - DNA, 20 bp, human
gttcatcgcaaggtagccaa

SEQ ID NO: 4914 - DNA, 20 bp, human
gtcgcaaggtagccaaagga

SEQ ID NO: 4915 - DNA, 20 bp, human
ggcgggagaaaagctgaatc

SEQ ID NO: 4916 - DNA, 20 bp, human
gcagagagcttaactagcag

SEQ ID NO: 4917 - DNA, 20 bp, human
gccccaggcccagtgtgggt

SEQ ID NO: 4918 - DNA, 20 bp, human
gaagctctctgaaaagaagg

SEQ ID NO: 4919 - DNA, 20 bp, human
gctgctgaaaaagacaactg

SEQ ID NO: 4920 - DNA, 20 bp, human
gaaagtcacctaggttattt

SEQ ID NO: 4921 - DNA, 20 bp, human
ggatcgccccagggatcagg

SEQ ID NO: 4922 - DNA, 20 bp, human
gacatcagctctgaaaggat

SEQ ID NO: 4923 - DNA, 20 bp, human
gtaagcaccatagaggagct

SEQ ID NO: 4924 - DNA, 20 bp, human
ggctggtgttccttaagctt

SEQ ID NO: 4925 - DNA, 20 bp, human
ggcttacctcctgatccctg

SEQ ID NO: 4926 - DNA, 20 bp, human
gacggtgtctggaatagagt

SEQ ID NO: 4927 - DNA, 20 bp, human
gacatgaagcggaggaccac

SEQ ID NO: 4928 - DNA, 20 bp, human
gcgacgtcactcacatgaag

SEQ ID NO: 4929 - DNA, 20 bp, human
gcgtcactcacatgaagcgg

SEQ ID NO: 4930 - DNA, 20 bp, human
ggtggcgggtcactcactcg

SEQ ID NO: 4931 - DNA, 20 bp, human
ggttcacctaatgcctagaa

SEQ ID NO: 4932 - DNA, 20 bp, human
gcatgtgagtgacgtcgtgg

SEQ ID NO: 4933 - DNA, 20 bp, human
ggtggctgtctcggaacccg

SEQ ID NO: 4934 - DNA, 20 bp, human
gcttcctgctgtggctgtct

SEQ ID NO: 4935 - DNA, 20 bp, human
gcactgctatagtacgcggg

SEQ ID NO: 4936 - DNA, 20 bp, human
gaaaccgtcagaggtcacga

SEQ ID NO: 4937 - DNA, 20 bp, human
gacgtgcacggcaggagcta

SEQ ID NO: 4938 - DNA, 20 bp, human
gtctccgtcgtgacctctga

SEQ ID NO: 4939 - DNA, 20 bp, human
gaggtaaagccctatcacgg

SEQ ID NO: 4940 - DNA, 20 bp, human
gggtggggccgtgaaccggt

SEQ ID NO: 4941 - DNA, 20 bp, human
gtggcagaaccaaagcaaaa

SEQ ID NO: 4942 - DNA, 20 bp, human
ggggtcagaagggaggtggc

SEQ ID NO: 4943 - DNA, 20 bp, human
gccggggtggggccgtgaac

SEQ ID NO: 4944 - DNA, 20 bp, human
gggagcgagcgcgtcccaac

SEQ ID NO: 4945 - DNA, 20 bp, human
gagggggtagcgcgtgccaa

SEQ ID NO: 4946 - DNA, 20 bp, human
gcttgtagcagcattggtgg

SEQ ID NO: 4947 - DNA, 20 bp, human
gtcggcaactcctagcacct

SEQ ID NO: 4948 - DNA, 20 bp, human
gctgctacaaggccgagcca

SEQ ID NO: 4949 - DNA, 20 bp, human
gggagttgccgaagcaagtc

SEQ ID NO: 4950 - DNA, 20 bp, human
gacaaggccgagccaggggg

SEQ ID NO: 4951 - DNA, 20 bp, human
ggtagcttccggacttgctt

SEQ ID NO: 4952 - DNA, 20 bp, human
gggaagctaccgagcgagtc

SEQ ID NO: 4953 - DNA, 20 bp, human
gggccgtcagtcatcacaag

SEQ ID NO: 4954 - DNA, 20 bp, human
ggctagctcggaagctgccg

SEQ ID NO: 4955 - DNA, 20 bp, human
gctcggccttgtagcagcat

SEQ ID NO: 4956 - DNA, 20 bp, human
gtccacgttcaggagcagag

SEQ ID NO: 4957 - DNA, 20 bp, human
gtccatggctgcaggagaaa

SEQ ID NO: 4958 - DNA, 20 bp, human
gtaggcttccctggactgaa

SEQ ID NO: 4959 - DNA, 20 bp, human
gaaagggaggtgtccagcac

SEQ ID NO: 4960 - DNA, 20 bp, human
ggccgctctgctcctgaacg

SEQ ID NO: 4961 - DNA, 20 bp, human
gagacgcacccttcagtcca

SEQ ID NO: 4962 - DNA, 20 bp, human
gtgagaagaaagggagtccg

SEQ ID NO: 4963 - DNA, 20 bp, human
ggcctaagtgtcttccccgg

SEQ ID NO: 4964 - DNA, 20 bp, human
gaacgctgggagctccccgg

SEQ ID NO: 4965 - DNA, 20 bp, human
gaagggagtccgaggagtct

SEQ ID NO: 4966 - DNA, 20 bp, human
gggacccgaggccaagcgag

SEQ ID NO: 4967 - DNA, 20 bp, human
ggcggtgggtcccgggacac

SEQ ID NO: 4968 - DNA, 20 bp, human
ggcgcgtggctcgcagaccg

SEQ ID NO: 4969 - DNA, 20 bp, human
ggctcgcagaccggggagac

SEQ ID NO: 4970 - DNA, 20 bp, human
gggtcgcgggggtataacag

SEQ ID NO: 4971 - DNA, 20 bp, human
ggcgctggctgaccacgacg

SEQ ID NO: 4972 - DNA, 20 bp, human
gcacctcacccccaagccaa

SEQ ID NO: 4973 - DNA, 20 bp, human
gccctccccacaaggagcca

SEQ ID NO: 4974 - DNA, 20 bp, human
ggcttggcctcgggtcccgg

SEQ ID NO: 4975 - DNA, 20 bp, human
gctgcaccgcacggagatcg

SEQ ID NO: 4976 - DNA, 20 bp, human
ggggagacacgcaccgtgag

SEQ ID NO: 4977 - DNA, 20 bp, human
ggaggcagacgcgaggaggg

SEQ ID NO: 4978 - DNA, 20 bp, human
gagcccccgggcaacttgag

SEQ ID NO: 4979 - DNA, 20 bp, human
ggcggcttcgccctccgggg

SEQ ID NO: 4980 - DNA, 20 bp, human
ggcgctcagacggagccccc

SEQ ID NO: 4981 - DNA, 20 bp, human
ggccgcggcttcgccctccg

SEQ ID NO: 4982 - DNA, 20 bp, human
gcttgagtggcgccgatcgg

SEQ ID NO: 4983 - DNA, 20 bp, human
gcggagaggcagacgcgagg

SEQ ID NO: 4984 - DNA, 20 bp, human
gacggccgcggcccggagac

SEQ ID NO: 4985 - DNA, 20 bp, human
gagcagcgcgggcggctctg

SEQ ID NO: 4986 - DNA, 20 bp, human
ggcgtgaacagatagacctg

SEQ ID NO: 4987 - DNA, 20 bp, human
ggctcccgggccggctccaa

SEQ ID NO: 4988 - DNA, 20 bp, human
ggcgtccccccgcgcatctg

SEQ ID NO: 4989 - DNA, 20 bp, human
gcaggcccgagggcatggag

SEQ ID NO: 4990 - DNA, 20 bp, human
gaacagatagacctgcggac

SEQ ID NO: 4991 - DNA, 20 bp, human
gcgagaggccccaggcccga

SEQ ID NO: 4992 - DNA, 20 bp, human
gctaggaagtcagggccccg

SEQ ID NO: 4993 - DNA, 20 bp, human
gctagcagggtctctggccg

SEQ ID NO: 4994 - DNA, 20 bp, human
gcggggagagtggggcagtc

SEQ ID NO: 4995 - DNA, 20 bp, human
ggggccccgaggagctactg

SEQ ID NO: 4996 - DNA, 20 bp, human
ggcgggcacgcactgacctg

SEQ ID NO: 4997 - DNA, 20 bp, human
gatagccctacggagcacag

SEQ ID NO: 4998 - DNA, 20 bp, human
gtgccggccgccgcgaggac

SEQ ID NO: 4999 - DNA, 20 bp, human
gggacgggcagggcacgcac

SEQ ID NO: 5000 - DNA, 20 bp, human
gcacacgcacggatccacaa

SEQ ID NO: 5001 - DNA, 20 bp, human
ggcagcctctgtgctccgta

SEQ ID NO: 5002 - DNA, 20 bp, human
ggccgccgcgaggacgggca

SEQ ID NO: 5003 - DNA, 20 bp, human
ggagtgacacgatagcccta

SEQ ID NO: 5004 - DNA, 20 bp, human
gggcacgcactgacctgggg

SEQ ID NO: 5005 - DNA, 20 bp, human
gtcccagcttgggcccagag

SEQ ID NO: 5006 - DNA, 20 bp, human
ggcgttgacctgggaagcac

SEQ ID NO: 5007 - DNA, 20 bp, human
gctggccggggtctcggttc

SEQ ID NO: 5008 - DNA, 20 bp, human
gccactaagggtctagagac

SEQ ID NO: 5009 - DNA, 20 bp, human
ggttgggttagggaatgtga

SEQ ID NO: 5010 - DNA, 20 bp, human
ggagactggaaaggtttgag

SEQ ID NO: 5011 - DNA, 20 bp, human
gggcgtgcgtgcgttgacct

SEQ ID NO: 5012 - DNA, 20 bp, human
gcccgctccgggcaggtcca

SEQ ID NO: 5013 - DNA, 20 bp, human
ggccggagatctagaagccc

SEQ ID NO: 5014 - DNA, 20 bp, human
gggctgattaattccactaa

SEQ ID NO: 5015 - DNA, 20 bp, human
gtccagggcttctagatctc

SEQ ID NO: 5016 - DNA, 20 bp, human
gcgcccgaagcggcccacgg

SEQ ID NO: 5017 - DNA, 20 bp, human
ggcctgcgcgctcacccgct

SEQ ID NO: 5018 - DNA, 20 bp, human
gcactagcaggcggctactg

SEQ ID NO: 5019 - DNA, 20 bp, human
gccgcccgggacagagacct

SEQ ID NO: 5020 - DNA, 20 bp, human
ggactgcgccccaaaacctc

SEQ ID NO: 5021 - DNA, 20 bp, human
gcaaaacctccggcctccgt

SEQ ID NO: 5022 - DNA, 20 bp, human
gacccgcccgaagcggccca

SEQ ID NO: 5023 - DNA, 20 bp, human
gcttcgggcgggttatgggg

SEQ ID NO: 5024 - DNA, 20 bp, human
gccgcttcgggcgggttatg

SEQ ID NO: 5025 - DNA, 20 bp, human
gctcacttccgggaacgccg

SEQ ID NO: 5026 - DNA, 20 bp, human
gctggaggcagcactccgag

SEQ ID NO: 5027 - DNA, 20 bp, human
ggcctcaccccagcccaacg

SEQ ID NO: 5028 - DNA, 20 bp, human
ggcggcagctgagactccgg

SEQ ID NO: 5029 - DNA, 20 bp, human
gggtctcccgggcttacgta

SEQ ID NO: 5030 - DNA, 20 bp, human
ggagcgcatccgccaacccc

SEQ ID NO: 5031 - DNA, 20 bp, human
ggctggggtgaggccctgga

SEQ ID NO: 5032 - DNA, 20 bp, human
ggcctccgcccgcccagtcg

SEQ ID NO: 5033 - DNA, 20 bp, human
ggctcagtccgcctgctact

SEQ ID NO: 5034 - DNA, 20 bp, human
gcgtccccgcagcccctcac

SEQ ID NO: 5035 - DNA, 20 bp, human
gcggccggggctccgcgact

SEQ ID NO: 5036 - DNA, 20 bp, human
gctggcagcccgggaagccg

SEQ ID NO: 5037 - DNA, 20 bp, human
gcgacgggcggtagcatccg

SEQ ID NO: 5038 - DNA, 20 bp, human
ggctagagctggccgacggg

SEQ ID NO: 5039 - DNA, 20 bp, human
gcctcggatgtggacaccca

SEQ ID NO: 5040 - DNA, 20 bp, human
gtgagtgcgcgtgagaaaga

SEQ ID NO: 5041 - DNA, 20 bp, human
gctccgggccagatactcct

SEQ ID NO: 5042 - DNA, 20 bp, human
gcacggggcatgtaatgaag

SEQ ID NO: 5043 - DNA, 20 bp, human
gcagcgcggccgccaggggt

SEQ ID NO: 5044 - DNA, 20 bp, human
gagggctagagctggccgac

SEQ ID NO: 5045 - DNA, 20 bp, human
gtgagccggggctgaagctg

SEQ ID NO: 5046 - DNA, 20 bp, human
gcctcttcttcagccatggt

SEQ ID NO: 5047 - DNA, 20 bp, human
ggaaggttatccggacccag

SEQ ID NO: 5048 - DNA, 20 bp, human
ggagagttgaggccagaacc

SEQ ID NO: 5049 - DNA, 20 bp, human
gaagggtagaaagagaacct

SEQ ID NO: 5050 - DNA, 20 bp, human
gggagccgcgctggttgcta

SEQ ID NO: 5051 - DNA, 20 bp, human
gtctcacggagaaggttatc

SEQ ID NO: 5052 - DNA, 20 bp, human
gcggtccgcaaacccagcga

SEQ ID NO: 5053 - DNA, 20 bp, human
gtcattaaaaggaggaacag

SEQ ID NO: 5054 - DNA, 20 bp, human
gcgcctccttggcaagcgag

SEQ ID NO: 5055 - DNA, 20 bp, human
gggtagaaagagaacctagg

SEQ ID NO: 5056 - DNA, 20 bp, human
gcgacgcggttactagggag

SEQ ID NO: 5057 - DNA, 20 bp, human
gatacggtgcggggcgatag

SEQ ID NO: 5058 - DNA, 20 bp, human
gcctagcgacgcggttacta

SEQ ID NO: 5059 - DNA, 20 bp, human
gtccggggcaccgacactca

SEQ ID NO: 5060 - DNA, 20 bp, human
gccgtactggggcatctcgg

SEQ ID NO: 5061 - DNA, 20 bp, human
gggagtgactccgtgagtgt

SEQ ID NO: 5062 - DNA, 20 bp, human
ggcccgttccaggacttggg

SEQ ID NO: 5063 - DNA, 20 bp, human
gagcgctctaggacaagcaa

SEQ ID NO: 5064 - DNA, 20 bp, human
ggggcatctcgggggggata

SEQ ID NO: 5065 - DNA, 20 bp, human
ggagatgccccagtacgggg

SEQ ID NO: 5066 - DNA, 20 bp, human
ggacgtatcatagagaggtc

SEQ ID NO: 5067 - DNA, 20 bp, human
ggccccgctcccgacgtgag

SEQ ID NO: 5068 - DNA, 20 bp, human
gtgccgagagaggaagcgaa

SEQ ID NO: 5069 - DNA, 20 bp, human
gagagactagcgcagtgtgg

SEQ ID NO: 5070 - DNA, 20 bp, human
gcggagccgcgcttgaaatg

SEQ ID NO: 5071 - DNA, 20 bp, human
gcaccatctttggtaaggat

SEQ ID NO: 5072 - DNA, 20 bp, human
gtgggcggagaaaaagtcga

SEQ ID NO: 5073 - DNA, 20 bp, human
gctcagtgaaggaccgtcag

SEQ ID NO: 5074 - DNA, 20 bp, human
gtcggcagcacgcaggtccc

SEQ ID NO: 5075 - DNA, 20 bp, human
ggacagagactagcgcagtg

SEQ ID NO: 5076 - DNA, 20 bp, human
gcgcctgggctagcacgtgg

SEQ ID NO: 5077 - DNA, 20 bp, human
gctagcacgtgggggagctg

SEQ ID NO: 5078 - DNA, 20 bp, human
ggagcccgcgggcagacaac

SEQ ID NO: 5079 - DNA, 20 bp, human
gcgatctgtcaggagcccgc

SEQ ID NO: 5080 - DNA, 20 bp, human
gaggtgcagagaggcgaccc

SEQ ID NO: 5081 - DNA, 20 bp, human
gcgccctccaggtaccccgg

SEQ ID NO: 5082 - DNA, 20 bp, human
gcctgccggagacccgaagg

SEQ ID NO: 5083 - DNA, 20 bp, human
gcgaggagctggtaggtcgg

SEQ ID NO: 5084 - DNA, 20 bp, human
gacccgcctgggctagcacg

SEQ ID NO: 5085 - DNA, 20 bp, human
gggcggggaaggacgagagg

SEQ ID NO: 5086 - DNA, 20 bp, human
gctgcctgggcatcccgagg

SEQ ID NO: 5087 - DNA, 20 bp, human
gcggcttgttgataatatgg

SEQ ID NO: 5088 - DNA, 20 bp, human
ggaaggaccggaactccggg

SEQ ID NO: 5089 - DNA, 20 bp, human
ggggcggcttgttgataata

SEQ ID NO: 5090 - DNA, 20 bp, human
ggcatcccgaggaggcggtg

SEQ ID NO: 5091 - DNA, 20 bp, human
ggcagagcaaggcactcagg

SEQ ID NO: 5092 - DNA, 20 bp, human
gttccgccggaagaaggaca

SEQ ID NO: 5093 - DNA, 20 bp, human
ggggcccactcccggaagaa

SEQ ID NO: 5094 - DNA, 20 bp, human
gcggggaaggaccggaactc

SEQ ID NO: 5095 - DNA, 20 bp, human
gtctgctccgggactcttct

SEQ ID NO: 5096 - DNA, 20 bp, human
ggcctccgcggcgagcacgt

SEQ ID NO: 5097 - DNA, 20 bp, human
gaagccagaagggggaccag

SEQ ID NO: 5098 - DNA, 20 bp, human
ggtctctgaagaccaccccg

SEQ ID NO: 5099 - DNA, 20 bp, human
gccgggcccagagtagaggg

SEQ ID NO: 5100 - DNA, 20 bp, human
gtcggcgcccggctcacctg

SEQ ID NO: 5101 - DNA, 20 bp, human
gacgcgcaccacgcacccgg

SEQ ID NO: 5102 - DNA, 20 bp, human
gtctcgcgagagagagtggg

SEQ ID NO: 5103 - DNA, 20 bp, human
ggcggccccgaagccagaag

SEQ ID NO: 5104 - DNA, 20 bp, human
gatgcgaaggcgcagctctc

SEQ ID NO: 5105 - DNA, 20 bp, human
gctctactctgggcccggtg

SEQ ID NO: 5106 - DNA, 20 bp, human
gggcgctctcgggacctcgc

SEQ ID NO: 5107 - DNA, 20 bp, human
gggctgggcgcgttcgcagt

SEQ ID NO: 5108 - DNA, 20 bp, human
gggcgaaggaaggcgctctc

SEQ ID NO: 5109 - DNA, 20 bp, human
gaggagtgcgaacccctctt

SEQ ID NO: 5110 - DNA, 20 bp, human
ggcgcccagcctgcgaatga

SEQ ID NO: 5111 - DNA, 20 bp, human
gcgcgttcgcagtcggctgg

SEQ ID NO: 5112 - DNA, 20 bp, human
ggcgtggagctcccctcggg

SEQ ID NO: 5113 - DNA, 20 bp, human
gtctctcggcggaaatcgga

SEQ ID NO: 5114 - DNA, 20 bp, human
gatgggctgggaagttctct

SEQ ID NO: 5115 - DNA, 20 bp, human
gagtgcgaacccctctttgg

SEQ ID NO: 5116 - DNA, 20 bp, human
gttcgctgcggcagctccga

SEQ ID NO: 5117 - DNA, 20 bp, human
ggcagctccgagggcacctc

SEQ ID NO: 5118 - DNA, 20 bp, human
gcagacactcccggaggatg

SEQ ID NO: 5119 - DNA, 20 bp, human
ggaggatgggggagaaccgg

SEQ ID NO: 5120 - DNA, 20 bp, human
gtatactaaaggtctcccat

SEQ ID NO: 5121 - DNA, 20 bp, human
gccggaggatgggggagaac

SEQ ID NO: 5122 - DNA, 20 bp, human
gggtttcggcgggatcagag

SEQ ID NO: 5123 - DNA, 20 bp, human
gtggggaccatcaccatcac

SEQ ID NO: 5124 - DNA, 20 bp, human
gcaaccgcaggtggtttcgg

SEQ ID NO: 5125 - DNA, 20 bp, human
gccgtgcctgccgtccaggg

SEQ ID NO: 5126 - DNA, 20 bp, human
ggagcacaggcgcttcaccg

SEQ ID NO: 5127 - DNA, 20 bp, human
gggcagtctcggcagagcac

SEQ ID NO: 5128 - DNA, 20 bp, human
ggaaagacgctcgggagggt

SEQ ID NO: 5129 - DNA, 20 bp, human
gcggcgacggcctctaagtt

SEQ ID NO: 5130 - DNA, 20 bp, human
ggtccgcagacctgaggtcc

SEQ ID NO: 5131 - DNA, 20 bp, human
gcgccgaaagacgctcggga

SEQ ID NO: 5132 - DNA, 20 bp, human
gcatgcgccgaaagacgctc

SEQ ID NO: 5133 - DNA, 20 bp, human
gcgccgggacctcaggtctg

SEQ ID NO: 5134 - DNA, 20 bp, human
gcggactggagctgtgtgca

SEQ ID NO: 5135 - DNA, 20 bp, human
gggacagacgggtcgccggg

SEQ ID NO: 5136 - DNA, 20 bp, human
gttggaacaggagcagtggt

SEQ ID NO: 5137 - DNA, 20 bp, human
ggagcagtggtaggtggctg

SEQ ID NO: 5138 - DNA, 20 bp, human
ggaggccagataggcagggt

SEQ ID NO: 5139 - DNA, 20 bp, human
gcccggagaatccccagtac

SEQ ID NO: 5140 - DNA, 20 bp, human
gctatctggcctctgagaag

SEQ ID NO: 5141 - DNA, 20 bp, human
gttggagcacaggctcccca

SEQ ID NO: 5142 - DNA, 20 bp, human
gtgggcccacagacgtgtga

SEQ ID NO: 5143 - DNA, 20 bp, human
gctaggagatgccagtggga

SEQ ID NO: 5144 - DNA, 20 bp, human
gctcagaggccagataggca

SEQ ID NO: 5145 - DNA, 20 bp, human
gggaggcttaagaatggtgt

SEQ ID NO: 5146 - DNA, 20 bp, human
gagccgccaccgtcccccgg

SEQ ID NO: 5147 - DNA, 20 bp, human
gaggcgcctccgggggacgg

SEQ ID NO: 5148 - DNA, 20 bp, human
gccctcgacgatccccggac

SEQ ID NO: 5149 - DNA, 20 bp, human
gggagctcgggggatcggat

SEQ ID NO: 5150 - DNA, 20 bp, human
ggcgtcggaggcgcctccgg

SEQ ID NO: 5151 - DNA, 20 bp, human
gcgggggtccctggaagtag

SEQ ID NO: 5152 - DNA, 20 bp, human
gacaggcgcggcctcaccgc

SEQ ID NO: 5153 - DNA, 20 bp, human
gtccctggaagtaggggtag

SEQ ID NO: 5154 - DNA, 20 bp, human
ggactgcaccgaaggagctg

SEQ ID NO: 5155 - DNA, 20 bp, human
gggatgggcgggagactagg

SEQ ID NO: 5156 - DNA, 20 bp, human
gccgctgcctcccgctccgg

SEQ ID NO: 5157 - DNA, 20 bp, human
gggagcgggcgcccagaggt

SEQ ID NO: 5158 - DNA, 20 bp, human
gctggacccccggagtctcc

SEQ ID NO: 5159 - DNA, 20 bp, human
gccagctctgtgtgtataca

SEQ ID NO: 5160 - DNA, 20 bp, human
gtctgggcgcccgctcccgg

SEQ ID NO: 5161 - DNA, 20 bp, human
gtcctcggcaaccccttcct

SEQ ID NO: 5162 - DNA, 20 bp, human
gttggccctcccacaaacct

SEQ ID NO: 5163 - DNA, 20 bp, human
ggcagggagtggtagcctcc

SEQ ID NO: 5164 - DNA, 20 bp, human
gtggggccagcgcatctgca

SEQ ID NO: 5165 - DNA, 20 bp, human
ggcacacgctccgctcgaca

SEQ ID NO: 5166 - DNA, 20 bp, human
gttgcgcagacaggcgagaa

SEQ ID NO: 5167 - DNA, 20 bp, human
gcatgtcctgagtcagtcac

SEQ ID NO: 5168 - DNA, 20 bp, human
gaagaaagctgggaaagtga

SEQ ID NO: 5169 - DNA, 20 bp, human
ggagaagagaaaccaaaata

SEQ ID NO: 5170 - DNA, 20 bp, human
gacaagaacgaggggaaaag

SEQ ID NO: 5171 - DNA, 20 bp, human
gacggtttcgggtagattgt

SEQ ID NO: 5172 - DNA, 20 bp, human
gtgcaaaatggcaagacccg

SEQ ID NO: 5173 - DNA, 20 bp, human
gagcgctaaccaagaaacga

SEQ ID NO: 5174 - DNA, 20 bp, human
gacgcgaacagcaggcgcaa

SEQ ID NO: 5175 - DNA, 20 bp, human
ggttggttaagaagaaagct

SEQ ID NO: 5176 - DNA, 20 bp, human
ggtactggaatagtgaacca

SEQ ID NO: 5177 - DNA, 20 bp, human
gtaaagtcaatgaagatgct

SEQ ID NO: 5178 - DNA, 20 bp, human
gccacagaggatcagaaaat

SEQ ID NO: 5179 - DNA, 20 bp, human
gcactattccagtactacag

SEQ ID NO: 5180 - DNA, 20 bp, human
gtggacagaagaacaacgct

SEQ ID NO: 5181 - DNA, 20 bp, human
gcaagtgatcccctccactt

SEQ ID NO: 5182 - DNA, 20 bp, human
gcagaggtaggtaatcttac

SEQ ID NO: 5183 - DNA, 20 bp, human
gttacctacctctgtagtac

SEQ ID NO: 5184 - DNA, 20 bp, human
gtgactttaaaagtatattc

SEQ ID NO: 5185 - DNA, 20 bp, human
gcatgtacctcccccttgct

SEQ ID NO: 5186 - DNA, 20 bp, human
ggtccaacagctgacagggg

SEQ ID NO: 5187 - DNA, 20 bp, human
gctgcaggtgcccaagaact

SEQ ID NO: 5188 - DNA, 20 bp, human
gggcagtcaaggctgtagga

SEQ ID NO: 5189 - DNA, 20 bp, human
gtggtaccagctggcagtca

SEQ ID NO: 5190 - DNA, 20 bp, human
gtgccacaccccagggtcag

SEQ ID NO: 5191 - DNA, 20 bp, human
ggctgttggaccagactgag

SEQ ID NO: 5192 - DNA, 20 bp, human
gtaggggaatagagaagggg

SEQ ID NO: 5193 - DNA, 20 bp, human
gaggtaactctggtaccagc

SEQ ID NO: 5194 - DNA, 20 bp, human
gtcaaggctgtaggagggca

SEQ ID NO: 5195 - DNA, 20 bp, human
gagcctagtaaaaaaagagg

SEQ ID NO: 5196 - DNA, 20 bp, human
ggccaacactgctcccgagg

SEQ ID NO: 5197 - DNA, 20 bp, human
gtaacgcgaaggggataggt

SEQ ID NO: 5198 - DNA, 20 bp, human
gcttgctccgggtgcgaccg

SEQ ID NO: 5199 - DNA, 20 bp, human
gtgcagagggcgccttgctc

SEQ ID NO: 5200 - DNA, 20 bp, human
gaacactgctcccgaggtgg

SEQ ID NO: 5201 - DNA, 20 bp, human
gggtgctgggagtaagaacg

SEQ ID NO: 5202 - DNA, 20 bp, human
gagggagccgcggtcgcacc

SEQ ID NO: 5203 - DNA, 20 bp, human
gcggataccccgtatccagt

SEQ ID NO: 5204 - DNA, 20 bp, human
ggaggtgcccactggatacg

SEQ ID NO: 5205 - DNA, 20 bp, human
gccctggccgcggattccag

SEQ ID NO: 5206 - DNA, 20 bp, human
gtcatgcagcaggtcaaaca

SEQ ID NO: 5207 - DNA, 20 bp, human
gatctgtaggatgcaatact

SEQ ID NO: 5208 - DNA, 20 bp, human
gggttagtcggtgtctgcta

SEQ ID NO: 5209 - DNA, 20 bp, human
gtcattttaaagcttatctg

SEQ ID NO: 5210 - DNA, 20 bp, human
gaacatcaaaagaagacggt

SEQ ID NO: 5211 - DNA, 20 bp, human
gagatgatgcagctcattat

SEQ ID NO: 5212 - DNA, 20 bp, human
ggtctgctaaggcggagatt

SEQ ID NO: 5213 - DNA, 20 bp, human
gggaaagactgctgttgcta

SEQ ID NO: 5214 - DNA, 20 bp, human
gtaaaaataacagacagagc

SEQ ID NO: 5215 - DNA, 20 bp, human
gtagtcggtgtctgctaagg

SEQ ID NO: 5216 - DNA, 20 bp, human
gtaccaccggcgactcgggt

SEQ ID NO: 5217 - DNA, 20 bp, human
gcgccggaacaagccagaag

SEQ ID NO: 5218 - DNA, 20 bp, human
ggcccgaatccgggtaccac

SEQ ID NO: 5219 - DNA, 20 bp, human
gcgcatgccaggccggacgc

SEQ ID NO: 5220 - DNA, 20 bp, human
gcgggtaccaccggcgactc

SEQ ID NO: 5221 - DNA, 20 bp, human
ggtgagaccgggctgtccag

SEQ ID NO: 5222 - DNA, 20 bp, human
ggactcgggtcggccccttc

SEQ ID NO: 5223 - DNA, 20 bp, human
gctgcgctcgaactttggga

SEQ ID NO: 5224 - DNA, 20 bp, human
ggcgcctctcgcccgaatcc

SEQ ID NO: 5225 - DNA, 20 bp, human
gccccgaagcgggtgagacc

SEQ ID NO: 5226 - DNA, 20 bp, human
gtgtggtcgcctagtaaacg

SEQ ID NO: 5227 - DNA, 20 bp, human
gagtaaacggggctgctggt

SEQ ID NO: 5228 - DNA, 20 bp, human
ggcgtcgaagacatggacca

SEQ ID NO: 5229 - DNA, 20 bp, human
gacatggaccagggctacgg

SEQ ID NO: 5230 - DNA, 20 bp, human
ggtgggccgcgtcgaagaca

SEQ ID NO: 5231 - DNA, 20 bp, human
gcgaagacgccacaaaatgg

SEQ ID NO: 5232 - DNA, 20 bp, human
gggactccgccgaaggtgag

SEQ ID NO: 5233 - DNA, 20 bp, human
gggcgccaaagcccaatgag

SEQ ID NO: 5234 - DNA, 20 bp, human
ggctgaacgcatgcgtgctg

SEQ ID NO: 5235 - DNA, 20 bp, human
ggggctacggaggtttgtgt

SEQ ID NO: 5236 - DNA, 20 bp, human
gccacctgtgtagctcatgg

SEQ ID NO: 5237 - DNA, 20 bp, human
gccgccaccatgagctacac

SEQ ID NO: 5238 - DNA, 20 bp, human
ggcagcagctatcgcagcgt

SEQ ID NO: 5239 - DNA, 20 bp, human
gcgcaggccagggacggagg

SEQ ID NO: 5240 - DNA, 20 bp, human
gcagcagaagccggcgtcgt

SEQ ID NO: 5241 - DNA, 20 bp, human
gtgcctgctcgcaaggacca

SEQ ID NO: 5242 - DNA, 20 bp, human
gggcccacctgtgtagctca

SEQ ID NO: 5243 - DNA, 20 bp, human
gcgtgagggcagcgaccctg

SEQ ID NO: 5244 - DNA, 20 bp, human
gctgaggcaacgaggcgtga

SEQ ID NO: 5245 - DNA, 20 bp, human
gatagctgctgctaaccaca

SEQ ID NO: 5246 - DNA, 20 bp, human
gggatcgtcctcagccgcac

SEQ ID NO: 5247 - DNA, 20 bp, human
gaagcagtctccgcgctcac

SEQ ID NO: 5248 - DNA, 20 bp, human
gggtgacggcgcttcccgtg

SEQ ID NO: 5249 - DNA, 20 bp, human
gtacgtggagacgaagatgg

SEQ ID NO: 5250 - DNA, 20 bp, human
gcagtctccgcgctcactgg

SEQ ID NO: 5251 - DNA, 20 bp, human
gcccagtgcactgcccgaga

SEQ ID NO: 5252 - DNA, 20 bp, human
ggaggtgctgcagggtctta

SEQ ID NO: 5253 - DNA, 20 bp, human
ggagagacagaagaagctgg

SEQ ID NO: 5254 - DNA, 20 bp, human
ggcagaggccatggaggacg

SEQ ID NO: 5255 - DNA, 20 bp, human
gggcgctcccccgcccgaag

SEQ ID NO: 5256 - DNA, 20 bp, human
ggagggggctccctaagtag

SEQ ID NO: 5257 - DNA, 20 bp, human
ggctccctaagtagcggaag

SEQ ID NO: 5258 - DNA, 20 bp, human
gatgccctggagcgtcccaa

SEQ ID NO: 5259 - DNA, 20 bp, human
gtcacccggctcactcgtca

SEQ ID NO: 5260 - DNA, 20 bp, human
gcttagggagccccctcacc

SEQ ID NO: 5261 - DNA, 20 bp, human
gtgtccatggctccctgagt

SEQ ID NO: 5262 - DNA, 20 bp, human
gcgtcccaaaggctgcatgg

SEQ ID NO: 5263 - DNA, 20 bp, human
gtctaggtggggcgcctccc

SEQ ID NO: 5264 - DNA, 20 bp, human
gggagcggtggtctccaggg

SEQ ID NO: 5265 - DNA, 20 bp, human
gcagcgcgttctcccgggag

SEQ ID NO: 5266 - DNA, 20 bp, human
gcgcctccagcacccggcag

SEQ ID NO: 5267 - DNA, 20 bp, human
gcggaagcaaccaggcccag

SEQ ID NO: 5268 - DNA, 20 bp, human
gcccggctgaggagcctctt

SEQ ID NO: 5269 - DNA, 20 bp, human
ggcggacgcggcggtaagtg

SEQ ID NO: 5270 - DNA, 20 bp, human
ggcggtaagtgcggcccaag

SEQ ID NO: 5271 - DNA, 20 bp, human
gcgggctgctgcagactctg

SEQ ID NO: 5272 - DNA, 20 bp, human
gcagagcagggcaggttacc

SEQ ID NO: 5273 - DNA, 20 bp, human
gcgggtgctggaggcgccat

SEQ ID NO: 5274 - DNA, 20 bp, human
gaggcaaagaaggggtccct

SEQ ID NO: 5275 - DNA, 20 bp, human
ggcgccgcctcgaactccat

SEQ ID NO: 5276 - DNA, 20 bp, human
ggggtgggagagttctacga

SEQ ID NO: 5277 - DNA, 20 bp, human
gggagagttctacgagggag

SEQ ID NO: 5278 - DNA, 20 bp, human
gcccgccgccggccccaata

SEQ ID NO: 5279 - DNA, 20 bp, human
ggcggccgccgacaacgggg

SEQ ID NO: 5280 - DNA, 20 bp, human
ggacgggtgacgaaagaaga

SEQ ID NO: 5281 - DNA, 20 bp, human
gtcgaggagagcctacccga

SEQ ID NO: 5282 - DNA, 20 bp, human
gggtgaagagcgggaactcg

SEQ ID NO: 5283 - DNA, 20 bp, human
ggggacgccgggctcaacag

SEQ ID NO: 5284 - DNA, 20 bp, human
ggtgcggagccactctgaaa

SEQ ID NO: 5285 - DNA, 20 bp, human
gccgaggtgggcgccgacaa

SEQ ID NO: 5286 - DNA, 20 bp, human
gcagggcgcaatggagacag

SEQ ID NO: 5287 - DNA, 20 bp, human
gtcagagacgatgcaggcat

SEQ ID NO: 5288 - DNA, 20 bp, human
ggtgcagacgacgacacccc

SEQ ID NO: 5289 - DNA, 20 bp, human
gtggcagaacggcctggagg

SEQ ID NO: 5290 - DNA, 20 bp, human
gggctggcagaacggcctgg

SEQ ID NO: 5291 - DNA, 20 bp, human
gtttggaacaaagaattcac

SEQ ID NO: 5292 - DNA, 20 bp, human
gggtctgtgagcagcagctt

SEQ ID NO: 5293 - DNA, 20 bp, human
gcggtggtggagcccgagag

SEQ ID NO: 5294 - DNA, 20 bp, human
gtgtgagcagcagcttgggc

SEQ ID NO: 5295 - DNA, 20 bp, human
gtggagcccgagagaggtaa

SEQ ID NO: 5296 - DNA, 20 bp, human
gcgccagcaggtgagactcg

SEQ ID NO: 5297 - DNA, 20 bp, human
gggaaaccacccgcgctcgg

SEQ ID NO: 5298 - DNA, 20 bp, human
gctccccgagtctcacctgc

SEQ ID NO: 5299 - DNA, 20 bp, human
gacagcccgaggccccgcca

SEQ ID NO: 5300 - DNA, 20 bp, human
gcgggttgctgtggttactg

SEQ ID NO: 5301 - DNA, 20 bp, human
gggagttgagcggcaaacaa

SEQ ID NO: 5302 - DNA, 20 bp, human
gtggagactgaggaaccccg

SEQ ID NO: 5303 - DNA, 20 bp, human
gtcaccgctccgggaatggg

SEQ ID NO: 5304 - DNA, 20 bp, human
gggcccataccgcccgtcca

SEQ ID NO: 5305 - DNA, 20 bp, human
gccagcccaaacacagcccg

SEQ ID NO: 5306 - DNA, 20 bp, human
gggttctgttggattctgag

SEQ ID NO: 5307 - DNA, 20 bp, human
ggctcaatcttgaaatccaa

SEQ ID NO: 5308 - DNA, 20 bp, human
gttctacagaaaggttctgt

SEQ ID NO: 5309 - DNA, 20 bp, human
gattctgagtggaacctctt

SEQ ID NO: 5310 - DNA, 20 bp, human
gcaatttggattctacagaa

SEQ ID NO: 5311 - DNA, 20 bp, human
ggaacactctcattacatac

SEQ ID NO: 5312 - DNA, 20 bp, human
gtgacttcagaaaatcaatt

SEQ ID NO: 5313 - DNA, 20 bp, human
ggcttctttgagataactgg

SEQ ID NO: 5314 - DNA, 20 bp, human
gcattaccttgctaagggta

SEQ ID NO: 5315 - DNA, 20 bp, human
gttgagataactggaggaac

SEQ ID NO: 5316 - DNA, 20 bp, human
gagtggagagcgcagagcac

SEQ ID NO: 5317 - DNA, 20 bp, human
gaagttccacccggagggag

SEQ ID NO: 5318 - DNA, 20 bp, human
ggcagctggaaaaagcacat

SEQ ID NO: 5319 - DNA, 20 bp, human
gcttaagtctggcggtgagg

SEQ ID NO: 5320 - DNA, 20 bp, human
gttcgacctcgaggatccag

SEQ ID NO: 5321 - DNA, 20 bp, human
ggttctccaaacccgcgctg

SEQ ID NO: 5322 - DNA, 20 bp, human
gcactggaggggacgagact

SEQ ID NO: 5323 - DNA, 20 bp, human
gcccgaggaaggacctgaag

SEQ ID NO: 5324 - DNA, 20 bp, human
ggagcgtgaatagggtactg

SEQ ID NO: 5325 - DNA, 20 bp, human
ggaatcgaggccatctcctc

SEQ ID NO: 5326 - DNA, 20 bp, human
gctggtgggccgcccatcaa

SEQ ID NO: 5327 - DNA, 20 bp, human
ggccaaggccgcaccgtact

SEQ ID NO: 5328 - DNA, 20 bp, human
gaccgcgggcaacccttgat

SEQ ID NO: 5329 - DNA, 20 bp, human
gcccagacccccgcccagta

SEQ ID NO: 5330 - DNA, 20 bp, human
ggcggcacaacgcgagaggg

SEQ ID NO: 5331 - DNA, 20 bp, human
gcccgtgaggtcggcagaaa

SEQ ID NO: 5332 - DNA, 20 bp, human
ggccgtctcctgctcaacaa

SEQ ID NO: 5333 - DNA, 20 bp, human
ggacctcacgggctatttaa

SEQ ID NO: 5334 - DNA, 20 bp, human
gcccgctaggacccaaaatg

SEQ ID NO: 5335 - DNA, 20 bp, human
gtcctagcgggcgccccaag

SEQ ID NO: 5336 - DNA, 20 bp, human
gacgcccctccagagaagaa

SEQ ID NO: 5337 - DNA, 20 bp, human
gaggctgctgctatctacag

SEQ ID NO: 5338 - DNA, 20 bp, human
gggccacaggctgcttaaga

SEQ ID NO: 5339 - DNA, 20 bp, human
gagccttcttaagcagcctg

SEQ ID NO: 5340 - DNA, 20 bp, human
gacacccttcttctctggag

SEQ ID NO: 5341 - DNA, 20 bp, human
gattagctgggagtcacggt

SEQ ID NO: 5342 - DNA, 20 bp, human
gtatctacagtgggaggagt

SEQ ID NO: 5343 - DNA, 20 bp, human
gtgctgctatctacagtggg

SEQ ID NO: 5344 - DNA, 20 bp, human
gcttctctggaggggcgttt

SEQ ID NO: 5345 - DNA, 20 bp, human
gtttgcacacccttcttctc

SEQ ID NO: 5346 - DNA, 20 bp, human
gagacgttccagggctccac

SEQ ID NO: 5347 - DNA, 20 bp, human
gtgagggaggaccttcgtca

SEQ ID NO: 5348 - DNA, 20 bp, human
gtaagccagctgtctgtctg

SEQ ID NO: 5349 - DNA, 20 bp, human
gtgaagacctgactcattcc

SEQ ID NO: 5350 - DNA, 20 bp, human
gccggagacctgaatgagag

SEQ ID NO: 5351 - DNA, 20 bp, human
gaatgagtcaggtcttcacc

SEQ ID NO: 5352 - DNA, 20 bp, human
gtaaggcttagggcggcatc

SEQ ID NO: 5353 - DNA, 20 bp, human
gtagctccagggtgaaagct

SEQ ID NO: 5354 - DNA, 20 bp, human
gttctaaaacagagatctcc

SEQ ID NO: 5355 - DNA, 20 bp, human
gtcaggagttgaatttggct

SEQ ID NO: 5356 - DNA, 20 bp, human
gtttctgtcactagcctggc

SEQ ID NO: 5357 - DNA, 20 bp, human
gtccatttctgtcactagcc

SEQ ID NO: 5358 - DNA, 20 bp, human
ggagtcatgcagagtaacat

SEQ ID NO: 5359 - DNA, 20 bp, human
gttgctcttatagcctgtga

SEQ ID NO: 5360 - DNA, 20 bp, human
gagattgattgcaatgggag

SEQ ID NO: 5361 - DNA, 20 bp, human
gagtgtgtgaagctgaatga

SEQ ID NO: 5362 - DNA, 20 bp, human
gagatgaccctgtgacaaga

SEQ ID NO: 5363 - DNA, 20 bp, human
gaaagttagtggagacgggg

SEQ ID NO: 5364 - DNA, 20 bp, human
gctcttatagcctgtgaggg

SEQ ID NO: 5365 - DNA, 20 bp, human
ggcaaaagttagtggagacg

SEQ ID NO: 5366 - DNA, 20 bp, human
gatcattcagcttcacacac

SEQ ID NO: 5367 - DNA, 20 bp, human
ggaagaaacatttgctaacc

SEQ ID NO: 5368 - DNA, 20 bp, human
gtccatttctgtcactggcc

SEQ ID NO: 5369 - DNA, 20 bp, human
gaccaggccagtgacagaaa

SEQ ID NO: 5370 - DNA, 20 bp, human
gaaagttagtggagacgggg

SEQ ID NO: 5371 - DNA, 20 bp, human
gagatgaccctgtgacaaga

SEQ ID NO: 5372 - DNA, 20 bp, human
gagattgattgcaatgggag

SEQ ID NO: 5373 - DNA, 20 bp, human
ggcaaaagttagtggagacg

SEQ ID NO: 5374 - DNA, 20 bp, human
ggagtcatgcagagtaacat

SEQ ID NO: 5375 - DNA, 20 bp, human
gctcttatagcctgtgaggg

SEQ ID NO: 5376 - DNA, 20 bp, human
gacagaaggcatggcacggg

SEQ ID NO: 5377 - DNA, 20 bp, human
ggataggtagtaggtgtgat

SEQ ID NO: 5378 - DNA, 20 bp, human
gagcaaatttggaactggat

SEQ ID NO: 5379 - DNA, 20 bp, human
gtcacttggctggcaggaga

SEQ ID NO: 5380 - DNA, 20 bp, human
gccatcatgaaggaaggtga

SEQ ID NO: 5381 - DNA, 20 bp, human
gaacttaccatcatgaagga

SEQ ID NO: 5382 - DNA, 20 bp, human
ggggaaacttaccatcatga

SEQ ID NO: 5383 - DNA, 20 bp, human
gaagcatgtcttcacttggc

SEQ ID NO: 5384 - DNA, 20 bp, human
gtgtacagaaggcatggcac

SEQ ID NO: 5385 - DNA, 20 bp, human
gggcatggcacgggaggcct

SEQ ID NO: 5386 - DNA, 20 bp, human
ggctagtcagacaagtgaca

SEQ ID NO: 5387 - DNA, 20 bp, human
gtcagacaagtgacagggaa

SEQ ID NO: 5388 - DNA, 20 bp, human
gtaggctaggagaaaaaagt

SEQ ID NO: 5389 - DNA, 20 bp, human
gactgttggtcatctccctc

SEQ ID NO: 5390 - DNA, 20 bp, human
gcagtgagtcatccagagta

SEQ ID NO: 5391 - DNA, 20 bp, human
ggttggtcatctccctctgg

SEQ ID NO: 5392 - DNA, 20 bp, human
gagctttacacactggtgtt

SEQ ID NO: 5393 - DNA, 20 bp, human
ggcaattaatctccaccaga

SEQ ID NO: 5394 - DNA, 20 bp, human
gtggacctcaatgcagaaca

SEQ ID NO: 5395 - DNA, 20 bp, human
ggaaccttacaacccaatac

SEQ ID NO: 5396 - DNA, 20 bp, human
gagaccacgtgagtcactca

SEQ ID NO: 5397 - DNA, 20 bp, human
gtcacgtggtctgtcttact

SEQ ID NO: 5398 - DNA, 20 bp, human
gctgcagtcatctcctagaa

SEQ ID NO: 5399 - DNA, 20 bp, human
ggtcacttcatgcccgtatt

SEQ ID NO: 5400 - DNA, 20 bp, human
gttaccctgagtgactcacg

SEQ ID NO: 5401 - DNA, 20 bp, human
ggcctggcagttccctttct

SEQ ID NO: 5402 - DNA, 20 bp, human
ggaataagtgaacgatgacc

SEQ ID NO: 5403 - DNA, 20 bp, human
gtgtttccttcagcaacatc

SEQ ID NO: 5404 - DNA, 20 bp, human
gaaaatgtgattattacctc

SEQ ID NO: 5405 - DNA, 20 bp, human
gatctgcttagtgaaagaag

SEQ ID NO: 5406 - DNA, 20 bp, human
gttgtggagaacctgactgt

SEQ ID NO: 5407 - DNA, 20 bp, human
ggcagcactgagatccattg

SEQ ID NO: 5408 - DNA, 20 bp, human
ggagtgattctgaacaccac

SEQ ID NO: 5409 - DNA, 20 bp, human
gtttctaaaaagactccctg

SEQ ID NO: 5410 - DNA, 20 bp, human
gtaaacacacgaatttcatg

SEQ ID NO: 5411 - DNA, 20 bp, human
gggcctattccatcaaagaa

SEQ ID NO: 5412 - DNA, 20 bp, human
gtgaataggtattgagccaa

SEQ ID NO: 5413 - DNA, 20 bp, human
gggactactatttactgaat

SEQ ID NO: 5414 - DNA, 20 bp, human
gacctactcagaacctaaat

SEQ ID NO: 5415 - DNA, 20 bp, human
gctttgatggaataggccct

SEQ ID NO: 5416 - DNA, 20 bp, human
gggcaccgcgcgagctactg

SEQ ID NO: 5417 - DNA, 20 bp, human
gcccgcacgcgactaccgac

SEQ ID NO: 5418 - DNA, 20 bp, human
gtagctcgcgcggtgcctgt

SEQ ID NO: 5419 - DNA, 20 bp, human
gcggagtgtcagccgtcaca

SEQ ID NO: 5420 - DNA, 20 bp, human
gcacttccagccagtcgcaa

SEQ ID NO: 5421 - DNA, 20 bp, human
gcgccgccaaggcctcccct

SEQ ID NO: 5422 - DNA, 20 bp, human
ggcagccccgcccaacgccg

SEQ ID NO: 5423 - DNA, 20 bp, human
gacggctgacactccgacaa

SEQ ID NO: 5424 - DNA, 20 bp, human
gggaggcgcgcctgacctag

SEQ ID NO: 5425 - DNA, 20 bp, human
gttccagccagtcgcaacgg

SEQ ID NO: 5426 - DNA, 20 bp, human
gcgggagactacgcgagacg

SEQ ID NO: 5427 - DNA, 20 bp, human
gccagcaccgaggcgacccg

SEQ ID NO: 5428 - DNA, 20 bp, human
gcgaagcgcgcagtggacgg

SEQ ID NO: 5429 - DNA, 20 bp, human
ggagcgaagcgcgcagtgga

SEQ ID NO: 5430 - DNA, 20 bp, human
gcggagagcgaagcgcgcag

SEQ ID NO: 5431 - DNA, 20 bp, human
ggagcgagggacgaatccgt

SEQ ID NO: 5432 - DNA, 20 bp, human
gcggccgcgggcagcaccga

SEQ ID NO: 5433 - DNA, 20 bp, human
gctcgcgctgcaactcccaa

SEQ ID NO: 5434 - DNA, 20 bp, human
ggcggcactcagcatagcag

SEQ ID NO: 5435 - DNA, 20 bp, human
gcatcacgcatgcacaccct

SEQ ID NO: 5436 - DNA, 20 bp, human
gaaggctgcgaggtgaacag

SEQ ID NO: 5437 - DNA, 20 bp, human
gctgcgaggtgaacaggggt

SEQ ID NO: 5438 - DNA, 20 bp, human
gcgaggaaggagggacgacg

SEQ ID NO: 5439 - DNA, 20 bp, human
gtcgcagccttgggaacacc

SEQ ID NO: 5440 - DNA, 20 bp, human
ggtggagtcgagctcgtggg

SEQ ID NO: 5441 - DNA, 20 bp, human
ggggagagcggggcggtaca

SEQ ID NO: 5442 - DNA, 20 bp, human
gtggcgactatcccaaaagg

SEQ ID NO: 5443 - DNA, 20 bp, human
gccggagctagacgtgccta

SEQ ID NO: 5444 - DNA, 20 bp, human
gaactttgggtgctgccccg

SEQ ID NO: 5445 - DNA, 20 bp, human
gggcctcgtggctttagaga

SEQ ID NO: 5446 - DNA, 20 bp, human
gcgcagcgcggcccgaagac

SEQ ID NO: 5447 - DNA, 20 bp, human
ggcccgaagacgggagcagg

SEQ ID NO: 5448 - DNA, 20 bp, human
gcgcggcgccgccagaatgg

SEQ ID NO: 5449 - DNA, 20 bp, human
gctgggcaccgggcaccgag

SEQ ID NO: 5450 - DNA, 20 bp, human
ggcgcgggcccggccaaggg

SEQ ID NO: 5451 - DNA, 20 bp, human
ggccgccagaatggaggagc

SEQ ID NO: 5452 - DNA, 20 bp, human
ggccgcctgctcccgtcttc

SEQ ID NO: 5453 - DNA, 20 bp, human
gggccggcagcctgcacccc

SEQ ID NO: 5454 - DNA, 20 bp, human
ggaagtggccgagcgggcct

SEQ ID NO: 5455 - DNA, 20 bp, human
gcggccgagcaccgagcgct

SEQ ID NO: 5456 - DNA, 20 bp, human
gacgggcacgtgagtggagg

SEQ ID NO: 5457 - DNA, 20 bp, human
ggctacgggcacgtgagtgg

SEQ ID NO: 5458 - DNA, 20 bp, human
gctggctacgggcacgtgag

SEQ ID NO: 5459 - DNA, 20 bp, human
gggctggcaaagatccaaca

SEQ ID NO: 5460 - DNA, 20 bp, human
ggccatgccctcgagcaaaa

SEQ ID NO: 5461 - DNA, 20 bp, human
gggcctaagccggtcagcta

SEQ ID NO: 5462 - DNA, 20 bp, human
gtcgagggcatggcctaagc

SEQ ID NO: 5463 - DNA, 20 bp, human
gcctcgcccggggtccaggg

SEQ ID NO: 5464 - DNA, 20 bp, human
gccggtcctggcctccgtct

SEQ ID NO: 5465 - DNA, 20 bp, human
gccgccctcaaaagacatgg

SEQ ID NO: 5466 - DNA, 20 bp, human
ggtatttccgtccagagggt

SEQ ID NO: 5467 - DNA, 20 bp, human
gtggcgcactcacctgtcac

SEQ ID NO: 5468 - DNA, 20 bp, human
gtcctccgaggcaggcccaa

SEQ ID NO: 5469 - DNA, 20 bp, human
gtgtttcccggcagcggcaa

SEQ ID NO: 5470 - DNA, 20 bp, human
ggccgctgccgggaaacaca

SEQ ID NO: 5471 - DNA, 20 bp, human
ggcgggccataccactgagg

SEQ ID NO: 5472 - DNA, 20 bp, human
gcgggtggtacagcccatcg

SEQ ID NO: 5473 - DNA, 20 bp, human
ggctccccccaccgcctcag

SEQ ID NO: 5474 - DNA, 20 bp, human
ggcccggacgcgaccatcgt

SEQ ID NO: 5475 - DNA, 20 bp, human
gccccggcccgcgcacgctg

SEQ ID NO: 5476 - DNA, 20 bp, human
ggcgggggctgggtcaccgg

SEQ ID NO: 5477 - DNA, 20 bp, human
gtggctgttacctgcaacgg

SEQ ID NO: 5478 - DNA, 20 bp, human
gcggtggctgttacctgcaa

SEQ ID NO: 5479 - DNA, 20 bp, human
gcacccacacccgaagcctc

SEQ ID NO: 5480 - DNA, 20 bp, human
ggggcaagcgaagggctgca

SEQ ID NO: 5481 - DNA, 20 bp, human
gaaccgcgctgggcatcccc

SEQ ID NO: 5482 - DNA, 20 bp, human
gccggcgggagggcaagcga

SEQ ID NO: 5483 - DNA, 20 bp, human
ggtcaccgcgccgggggcgt

SEQ ID NO: 5484 - DNA, 20 bp, human
gagcggtaccgtctgtgtct

SEQ ID NO: 5485 - DNA, 20 bp, human
gtcaccggaggcttcgggtg

SEQ ID NO: 5486 - DNA, 20 bp, human
gtagctgcgaggccaggaca

SEQ ID NO: 5487 - DNA, 20 bp, human
ggagccgcgggcccctccag

SEQ ID NO: 5488 - DNA, 20 bp, human
gagatgctgtcgggccgcgg

SEQ ID NO: 5489 - DNA, 20 bp, human
gcagagcccccccactggag

SEQ ID NO: 5490 - DNA, 20 bp, human
gccccgagctctggttaagg

SEQ ID NO: 5491 - DNA, 20 bp, human
gcggccgcagtgggacacgg

SEQ ID NO: 5492 - DNA, 20 bp, human
gtactgcccggcaggctggt

SEQ ID NO: 5493 - DNA, 20 bp, human
ggcgggcccctccagtgggg

SEQ ID NO: 5494 - DNA, 20 bp, human
gcaggctggtgggtacgcga

SEQ ID NO: 5495 - DNA, 20 bp, human
gccgcagtgggacacggagg

SEQ ID NO: 5496 - DNA, 20 bp, human
gtcaccgctgtctcccgctc

SEQ ID NO: 5497 - DNA, 20 bp, human
gcgggagcccttagggaggc

SEQ ID NO: 5498 - DNA, 20 bp, human
gagaccggagcgggagacag

SEQ ID NO: 5499 - DNA, 20 bp, human
gcgctcacctgcctccctaa

SEQ ID NO: 5500 - DNA, 20 bp, human
gtacgcggtctgtgggagac

SEQ ID NO: 5501 - DNA, 20 bp, human
gcagcggccgggagccctta

SEQ ID NO: 5502 - DNA, 20 bp, human
ggtctgtgggagaccggagc

SEQ ID NO: 5503 - DNA, 20 bp, human
gccgctcttacgcggtctgt

SEQ ID NO: 5504 - DNA, 20 bp, human
ggaacccgggcccccaacct

SEQ ID NO: 5505 - DNA, 20 bp, human
gcgcaacgcttagtacaaaa

SEQ ID NO: 5506 - DNA, 20 bp, human
gtgaggctgctcccggacaa

SEQ ID NO: 5507 - DNA, 20 bp, human
gcctcactggggacgcgcag

SEQ ID NO: 5508 - DNA, 20 bp, human
gcgggtgactgggacagtgg

SEQ ID NO: 5509 - DNA, 20 bp, human
gacgctcgttgcccttgtcc

SEQ ID NO: 5510 - DNA, 20 bp, human
gaagtcgagggagttgagtc

SEQ ID NO: 5511 - DNA, 20 bp, human
gcaggggcttataaagtcga

SEQ ID NO: 5512 - DNA, 20 bp, human
ggccgtctaggcaaaagatc

SEQ ID NO: 5513 - DNA, 20 bp, human
gcagcgccttgggcctcact

SEQ ID NO: 5514 - DNA, 20 bp, human
gagcctcaggccgcgatcgc

SEQ ID NO: 5515 - DNA, 20 bp, human
gattaaggcgccggcgatcg

SEQ ID NO: 5516 - DNA, 20 bp, human
gagctggcagaccagagata

SEQ ID NO: 5517 - DNA, 20 bp, human
ggcaggtagagggagtcaaa

SEQ ID NO: 5518 - DNA, 20 bp, human
gggacgaacgaatgacaggt

SEQ ID NO: 5519 - DNA, 20 bp, human
gcagcctggcaccctatctc

SEQ ID NO: 5520 - DNA, 20 bp, human
gtctgccagctggtctctca

SEQ ID NO: 5521 - DNA, 20 bp, human
gctgaggacgaacgaatgac

SEQ ID NO: 5522 - DNA, 20 bp, human
gagaccagagatagggtgcc

SEQ ID NO: 5523 - DNA, 20 bp, human
ggccatcgttcttgatagag

SEQ ID NO: 5524 - DNA, 20 bp, human
ggaatgacaggtgggtactt

SEQ ID NO: 5525 - DNA, 20 bp, human
gttcgttcgtcctcagtgca

SEQ ID NO: 5526 - DNA, 20 bp, human
ggcctttggcacaatgaagt

SEQ ID NO: 5527 - DNA, 20 bp, human
gcattgtgccaaaggcgtgt

SEQ ID NO: 5528 - DNA, 20 bp, human
gttagctcggcttattccag

SEQ ID NO: 5529 - DNA, 20 bp, human
gtgtcaaccccacacgcctt

SEQ ID NO: 5530 - DNA, 20 bp, human
gagagaaaagctaggacaaa

SEQ ID NO: 5531 - DNA, 20 bp, human
gacccacttcattgtgccaa

SEQ ID NO: 5532 - DNA, 20 bp, human
gtctcgacgaaacacacccc

SEQ ID NO: 5533 - DNA, 20 bp, human
gaaaagctaggacaaacgga

SEQ ID NO: 5534 - DNA, 20 bp, human
gtttatgagatcaacagcac

SEQ ID NO: 5535 - DNA, 20 bp, human
ggtgcaatggataggtcttt

SEQ ID NO: 5536 - DNA, 20 bp, human
ggcaaagaaaaggagttccg

SEQ ID NO: 5537 - DNA, 20 bp, human
ggttccggggcataaaagta

SEQ ID NO: 5538 - DNA, 20 bp, human
gaaaagataaacaagaactg

SEQ ID NO: 5539 - DNA, 20 bp, human
gtgtcaaattgcacagcaag

SEQ ID NO: 5540 - DNA, 20 bp, human
gggcagctttatcagcagct

SEQ ID NO: 5541 - DNA, 20 bp, human
gacctctgacagatcatcat

SEQ ID NO: 5542 - DNA, 20 bp, human
gtgatcaccaccataaaaag

SEQ ID NO: 5543 - DNA, 20 bp, human
gaatacctttggcaacaggc

SEQ ID NO: 5544 - DNA, 20 bp, human
ggctgcctgcctgttgccaa

SEQ ID NO: 5545 - DNA, 20 bp, human
gaaagaagaaacgagagtgt

SEQ ID NO: 5546 - DNA, 20 bp, human
gctggcgggtcccgacgcag

SEQ ID NO: 5547 - DNA, 20 bp, human
gggcggcgggtctcctcagg

SEQ ID NO: 5548 - DNA, 20 bp, human
gtccgggctgctctgagtag

SEQ ID NO: 5549 - DNA, 20 bp, human
gctgctctgagtagagggac

SEQ ID NO: 5550 - DNA, 20 bp, human
ggaagacgctgcccctgcgt

SEQ ID NO: 5551 - DNA, 20 bp, human
gcgtcagtggcccaccaaga

SEQ ID NO: 5552 - DNA, 20 bp, human
ggcgtgcggcagagaaccga

SEQ ID NO: 5553 - DNA, 20 bp, human
gggtgctaagaaggactcgc

SEQ ID NO: 5554 - DNA, 20 bp, human
gcagcggcggcagcggtctc

SEQ ID NO: 5555 - DNA, 20 bp, human
ggggacgacgccccctcctg

SEQ ID NO: 5556 - DNA, 20 bp, human
gacgaggagttcaggatcaa

SEQ ID NO: 5557 - DNA, 20 bp, human
ggtccgaagagcgacacctc

SEQ ID NO: 5558 - DNA, 20 bp, human
gcggggcgctctgtgttaag

SEQ ID NO: 5559 - DNA, 20 bp, human
gtgtcgctcttcggacctca

SEQ ID NO: 5560 - DNA, 20 bp, human
ggagcgccccgcagtcttcg

SEQ ID NO: 5561 - DNA, 20 bp, human
gaaaccgcggaaacactacg

SEQ ID NO: 5562 - DNA, 20 bp, human
ggaatcacgagagcgtctag

SEQ ID NO: 5563 - DNA, 20 bp, human
gctccggttccagcccaaag

SEQ ID NO: 5564 - DNA, 20 bp, human
ggaggagttcaggaaaaccg

SEQ ID NO: 5565 - DNA, 20 bp, human
gggagtcccgtcatccactg

SEQ ID NO: 5566 - DNA, 20 bp, human
ggcggccgccccgggatcta

SEQ ID NO: 5567 - DNA, 20 bp, human
gtcatcgtgcgggacgtgga

SEQ ID NO: 5568 - DNA, 20 bp, human
gtacatggtgtacccagggg

SEQ ID NO: 5569 - DNA, 20 bp, human
ggtggcgtaagagtaaacct

SEQ ID NO: 5570 - DNA, 20 bp, human
gccgccccgggatctacgga

SEQ ID NO: 5571 - DNA, 20 bp, human
gggacccgcggtagtgccag

SEQ ID NO: 5572 - DNA, 20 bp, human
gagggcgcgctgcaagaccg

SEQ ID NO: 5573 - DNA, 20 bp, human
ggaggcccacacctacccat

SEQ ID NO: 5574 - DNA, 20 bp, human
gtagccatccgtagatcccg

SEQ ID NO: 5575 - DNA, 20 bp, human
gtgcggccagctaaaacccg

SEQ ID NO: 5576 - DNA, 20 bp, human
gtgagtaggacaggtaagtc

SEQ ID NO: 5577 - DNA, 20 bp, human
ggattcggctcctggaacac

SEQ ID NO: 5578 - DNA, 20 bp, human
gctcctggaacacaggtgac

SEQ ID NO: 5579 - DNA, 20 bp, human
gtggaaagaaccaaacgagt

SEQ ID NO: 5580 - DNA, 20 bp, human
gttcttataccaggattcag

SEQ ID NO: 5581 - DNA, 20 bp, human
gggtaagtctggcgtgcctg

SEQ ID NO: 5582 - DNA, 20 bp, human
gagtaaagtcctctgaatcc

SEQ ID NO: 5583 - DNA, 20 bp, human
gaatcagaaatgtcatcctc

SEQ ID NO: 5584 - DNA, 20 bp, human
gtcaaatcggtgagtaggac

SEQ ID NO: 5585 - DNA, 20 bp, human
ggaacaatagaaagcaaaca

SEQ ID NO: 5586 - DNA, 20 bp, human
ggctcctgccccggactctg

SEQ ID NO: 5587 - DNA, 20 bp, human
gaaaccagcctcagagtccg

SEQ ID NO: 5588 - DNA, 20 bp, human
ggccgggtgtccctagcccg

SEQ ID NO: 5589 - DNA, 20 bp, human
gcccgaagcgcagcgttgag

SEQ ID NO: 5590 - DNA, 20 bp, human
gccaaggcgtcctcagacca

SEQ ID NO: 5591 - DNA, 20 bp, human
ggccgcgggctagggacacc

SEQ ID NO: 5592 - DNA, 20 bp, human
gcagtcgggaccgggagaat

SEQ ID NO: 5593 - DNA, 20 bp, human
gggcgcgctcgcctgtatat

SEQ ID NO: 5594 - DNA, 20 bp, human
gcccgcactgccccacgccg

SEQ ID NO: 5595 - DNA, 20 bp, human
ggttccgacgccttcccccg

SEQ ID NO: 5596 - DNA, 20 bp, human
gccgtgcggcggctgggagt

SEQ ID NO: 5597 - DNA, 20 bp, human
gcccgacttcggggaggcag

SEQ ID NO: 5598 - DNA, 20 bp, human
ggccggtgcgccgcagacta

SEQ ID NO: 5599 - DNA, 20 bp, human
ggggcagcgcagggacacgt

SEQ ID NO: 5600 - DNA, 20 bp, human
gccgcagactagggcgcctc

SEQ ID NO: 5601 - DNA, 20 bp, human
gggagctgccaccccgggag

SEQ ID NO: 5602 - DNA, 20 bp, human
ggccctagtctgcggcgcac

SEQ ID NO: 5603 - DNA, 20 bp, human
ggagcgggctgcgcagtgtc

SEQ ID NO: 5604 - DNA, 20 bp, human
gcgctgggcagccagactcg

SEQ ID NO: 5605 - DNA, 20 bp, human
gagggaggctcgggtctcgg

SEQ ID NO: 5606 - DNA, 20 bp, human
ggccccagcaaagcccagga

SEQ ID NO: 5607 - DNA, 20 bp, human
ggtccgcacacacgatgcag

SEQ ID NO: 5608 - DNA, 20 bp, human
ggaattcaggccaggaagta

SEQ ID NO: 5609 - DNA, 20 bp, human
gggcttgagtggcacctgag

SEQ ID NO: 5610 - DNA, 20 bp, human
gagagcacctccactcttca

SEQ ID NO: 5611 - DNA, 20 bp, human
gcagtcagccagccgcagac

SEQ ID NO: 5612 - DNA, 20 bp, human
ggcaggtaaacttaacgcta

SEQ ID NO: 5613 - DNA, 20 bp, human
gatgtccacctgcctgtctg

SEQ ID NO: 5614 - DNA, 20 bp, human
ggatgtgtgcacacacagtg

SEQ ID NO: 5615 - DNA, 20 bp, human
gaacgctaaggcgcagaaac

SEQ ID NO: 5616 - DNA, 20 bp, human
gctatccgcgggaactgcag

SEQ ID NO: 5617 - DNA, 20 bp, human
gccggttcaggatcacgctt

SEQ ID NO: 5618 - DNA, 20 bp, human
gctcctgtagcgtcacccag

SEQ ID NO: 5619 - DNA, 20 bp, human
gtagcgtcacccagaggcgg

SEQ ID NO: 5620 - DNA, 20 bp, human
ggaggcttggacaagcccaa

SEQ ID NO: 5621 - DNA, 20 bp, human
gccgcggcgtccgcatctgg

SEQ ID NO: 5622 - DNA, 20 bp, human
gctgttgaagtgggccgagt

SEQ ID NO: 5623 - DNA, 20 bp, human
gcagttcccgcggatagaga

SEQ ID NO: 5624 - DNA, 20 bp, human
gctgtagcgtcacccagagg

SEQ ID NO: 5625 - DNA, 20 bp, human
gcacctcaccccttctgcgg

SEQ ID NO: 5626 - DNA, 20 bp, human
ggagctggcgccaacctgtg

SEQ ID NO: 5627 - DNA, 20 bp, human
ggcagccccgaaactgaggt

SEQ ID NO: 5628 - DNA, 20 bp, human
ggttggcgccagctccgtaa

SEQ ID NO: 5629 - DNA, 20 bp, human
ggttggtgcagacccgtcct

SEQ ID NO: 5630 - DNA, 20 bp, human
gactcaccgcgcgcaggagt

SEQ ID NO: 5631 - DNA, 20 bp, human
gccgcgcgcaggagttggtg

SEQ ID NO: 5632 - DNA, 20 bp, human
gtgaggctcgataagagaaa

SEQ ID NO: 5633 - DNA, 20 bp, human
ggactcggttctcaccgcaa

SEQ ID NO: 5634 - DNA, 20 bp, human
gaagagaaagggaccagcga

SEQ ID NO: 5635 - DNA, 20 bp, human
gcgcggtggtagggccctta

SEQ ID NO: 5636 - DNA, 20 bp, human
gtggagaggagcgctagcac

SEQ ID NO: 5637 - DNA, 20 bp, human
gagacagtctcggttccata

SEQ ID NO: 5638 - DNA, 20 bp, human
gacagagagacctcagagga

SEQ ID NO: 5639 - DNA, 20 bp, human
gtctccagcatgctgcggcg

SEQ ID NO: 5640 - DNA, 20 bp, human
gctcctccaggagacagtct

SEQ ID NO: 5641 - DNA, 20 bp, human
gctggctgggatggcaaggt

SEQ ID NO: 5642 - DNA, 20 bp, human
ggtcaagagctggagccata

SEQ ID NO: 5643 - DNA, 20 bp, human
gcgctccggcgcttctccac

SEQ ID NO: 5644 - DNA, 20 bp, human
ggactagcagaggccgagag

SEQ ID NO: 5645 - DNA, 20 bp, human
gagcgctagcactggcgacg

SEQ ID NO: 5646 - DNA, 20 bp, human
ggcagcgcgcaacatcgcag

SEQ ID NO: 5647 - DNA, 20 bp, human
gaggcggggcccgaagcggg

SEQ ID NO: 5648 - DNA, 20 bp, human
gggcggcggctgacaagagg

SEQ ID NO: 5649 - DNA, 20 bp, human
ggagcagagctagggtctca

SEQ ID NO: 5650 - DNA, 20 bp, human
gcaacatcgcagcgggctag

SEQ ID NO: 5651 - DNA, 20 bp, human
gcccaggcggggcccgaagc

SEQ ID NO: 5652 - DNA, 20 bp, human
gggccctggaaaacagaccg

SEQ ID NO: 5653 - DNA, 20 bp, human
gcccgaaagcaaggaccatg

SEQ ID NO: 5654 - DNA, 20 bp, human
gagtacactaaggcccacgg

SEQ ID NO: 5655 - DNA, 20 bp, human
gggtggcggcggctgacaag

SEQ ID NO: 5656 - DNA, 20 bp, human
ggagccccagttaccgggag

SEQ ID NO: 5657 - DNA, 20 bp, human
gccgggagaggctgtgtcaa

SEQ ID NO: 5658 - DNA, 20 bp, human
gccgcggagcagggacacca

SEQ ID NO: 5659 - DNA, 20 bp, human
ggtaactggggctcctggaa

SEQ ID NO: 5660 - DNA, 20 bp, human
gtcctgggcaggaactccaa

SEQ ID NO: 5661 - DNA, 20 bp, human
gcagaggtcccagggatccg

SEQ ID NO: 5662 - DNA, 20 bp, human
gtgccatcccccaaaccagg

SEQ ID NO: 5663 - DNA, 20 bp, human
ggactccatgactggaagga

SEQ ID NO: 5664 - DNA, 20 bp, human
gccccctggagagatgatgt

SEQ ID NO: 5665 - DNA, 20 bp, human
gggccgtcagactccatgac

SEQ ID NO: 5666 - DNA, 20 bp, human
ggagtcccactgccagtcgg

SEQ ID NO: 5667 - DNA, 20 bp, human
gtcagcgggcgtggaggtcg

SEQ ID NO: 5668 - DNA, 20 bp, human
gggccatggagctcgaagtc

SEQ ID NO: 5669 - DNA, 20 bp, human
gactggcagtgggactcagc

SEQ ID NO: 5670 - DNA, 20 bp, human
gcatggagctcgaagtccgg

SEQ ID NO: 5671 - DNA, 20 bp, human
gcggcgcctccgactggcag

SEQ ID NO: 5672 - DNA, 20 bp, human
ggaagtccggcgggtccgac

SEQ ID NO: 5673 - DNA, 20 bp, human
ggccctgggcgagtgaattg

SEQ ID NO: 5674 - DNA, 20 bp, human
ggtcgagctcagtcctcccc

SEQ ID NO: 5675 - DNA, 20 bp, human
ggctgcagccgaaaccgcag

SEQ ID NO: 5676 - DNA, 20 bp, human
ggggcgcacagtccttcctg

SEQ ID NO: 5677 - DNA, 20 bp, human
ggctgtcccgctctgcctgg

SEQ ID NO: 5678 - DNA, 20 bp, human
gccccgggatactctacctg

SEQ ID NO: 5679 - DNA, 20 bp, human
ggccaagctgcccttcctcc

SEQ ID NO: 5680 - DNA, 20 bp, human
gattcccggacaccctccaa

SEQ ID NO: 5681 - DNA, 20 bp, human
gcccagctcggacaacggaa

SEQ ID NO: 5682 - DNA, 20 bp, human
gggagtggcagcgaggtccc

SEQ ID NO: 5683 - DNA, 20 bp, human
gtcccaggaaaaggaggcgg

SEQ ID NO: 5684 - DNA, 20 bp, human
ggaaccaagggaacagctct

SEQ ID NO: 5685 - DNA, 20 bp, human
ggggatacttgacccctgtg

SEQ ID NO: 5686 - DNA, 20 bp, human
gcaggcgtgggcacgggagt

SEQ ID NO: 5687 - DNA, 20 bp, human
gttaccccattgccaggcgt

SEQ ID NO: 5688 - DNA, 20 bp, human
ggatcgcagtcagcagagca

SEQ ID NO: 5689 - DNA, 20 bp, human
gggacactggtgggaaccag

SEQ ID NO: 5690 - DNA, 20 bp, human
gcattgccaggcgtgggcac

SEQ ID NO: 5691 - DNA, 20 bp, human
ggtgggcacgggagttggtt

SEQ ID NO: 5692 - DNA, 20 bp, human
gctgggagctcctcaaaggg

SEQ ID NO: 5693 - DNA, 20 bp, human
gcagggtaaaggacactggt

SEQ ID NO: 5694 - DNA, 20 bp, human
gggcgggcagagggagctca

SEQ ID NO: 5695 - DNA, 20 bp, human
ggctcccaggttagaggaga

SEQ ID NO: 5696 - DNA, 20 bp, human
ggtgaggtgagtgactacag

SEQ ID NO: 5697 - DNA, 20 bp, human
gtcacccggccccggtccag

SEQ ID NO: 5698 - DNA, 20 bp, human
gggaggctaagggatctcag

SEQ ID NO: 5699 - DNA, 20 bp, human
ggcatctcgggttagaagcg

SEQ ID NO: 5700 - DNA, 20 bp, human
ggaaggtgactacctgaggg

SEQ ID NO: 5701 - DNA, 20 bp, human
gagatccagtattaggagtg

SEQ ID NO: 5702 - DNA, 20 bp, human
gtcaacgccgggttcctcag

SEQ ID NO: 5703 - DNA, 20 bp, human
gggtggggaagtgagatgtg

SEQ ID NO: 5704 - DNA, 20 bp, human
ggacactgaacgtgagacga

SEQ ID NO: 5705 - DNA, 20 bp, human
gtacctgagggaggaggcta

SEQ ID NO: 5706 - DNA, 20 bp, human
ggccatggcccgggcaacga

SEQ ID NO: 5707 - DNA, 20 bp, human
gcagcggcagaaagcctcgt

SEQ ID NO: 5708 - DNA, 20 bp, human
ggcacaggagggaggcgacg

SEQ ID NO: 5709 - DNA, 20 bp, human
ggcctggaaacgtcgacccg

SEQ ID NO: 5710 - DNA, 20 bp, human
gtcggctaccatgcccagag

SEQ ID NO: 5711 - DNA, 20 bp, human
gcgcgcgcacgggaacgcag

SEQ ID NO: 5712 - DNA, 20 bp, human
gcatccgggctctctcacct

SEQ ID NO: 5713 - DNA, 20 bp, human
gagccaaatgcaggtcgcca

SEQ ID NO: 5714 - DNA, 20 bp, human
gtgcgcaccgacagcttcgt

SEQ ID NO: 5715 - DNA, 20 bp, human
gatgcaggtcgccatggccc

SEQ ID NO: 5716 - DNA, 20 bp, human
gtagtgcttctgggcagtag

SEQ ID NO: 5717 - DNA, 20 bp, human
gctagggcggccgagagcca

SEQ ID NO: 5718 - DNA, 20 bp, human
ggggcggccgagagccatgg

SEQ ID NO: 5719 - DNA, 20 bp, human
ggccatggcggcgctattgg

SEQ ID NO: 5720 - DNA, 20 bp, human
gtggcagctgtagtgcttct

SEQ ID NO: 5721 - DNA, 20 bp, human
gggacagggccgcacaggtc

SEQ ID NO: 5722 - DNA, 20 bp, human
gagggccgcacaggtcgggt

SEQ ID NO: 5723 - DNA, 20 bp, human
gggctggtgcagaggtaaaa

SEQ ID NO: 5724 - DNA, 20 bp, human
gaggaggtctggccaaaaag

SEQ ID NO: 5725 - DNA, 20 bp, human
gtctgggcagtagaggcgcg

SEQ ID NO: 5726 - DNA, 20 bp, human
ggagtcccgggctcagtatg

SEQ ID NO: 5727 - DNA, 20 bp, human
gggcgccacatactgagccc

SEQ ID NO: 5728 - DNA, 20 bp, human
gggctccgcgaggaaaacga

SEQ ID NO: 5729 - DNA, 20 bp, human
gctcctcgagcgagccccgg

SEQ ID NO: 5730 - DNA, 20 bp, human
gcacacacagcgcgcgagga

SEQ ID NO: 5731 - DNA, 20 bp, human
gtatggtctaccgggcgcgg

SEQ ID NO: 5732 - DNA, 20 bp, human
gaggccggggagaggtacgc

SEQ ID NO: 5733 - DNA, 20 bp, human
gcagcagctctcagggcctt

SEQ ID NO: 5734 - DNA, 20 bp, human
ggcgcccgcgtacctctccc

SEQ ID NO: 5735 - DNA, 20 bp, human
ggcgccagcggggagtcggt

SEQ ID NO: 5736 - DNA, 20 bp, human
ggctcagtcgtaaagaggaa

SEQ ID NO: 5737 - DNA, 20 bp, human
gtgagtgctcagtcgtaaag

SEQ ID NO: 5738 - DNA, 20 bp, human
ggtttgttccagccatagca

SEQ ID NO: 5739 - DNA, 20 bp, human
gtaatatgttggccaattat

SEQ ID NO: 5740 - DNA, 20 bp, human
gtcttacgacccatcaacag

SEQ ID NO: 5741 - DNA, 20 bp, human
ggcagaatttttccttgcta

SEQ ID NO: 5742 - DNA, 20 bp, human
gtttgtactagacactgatt

SEQ ID NO: 5743 - DNA, 20 bp, human
gatcatacagtccagttaca

SEQ ID NO: 5744 - DNA, 20 bp, human
gtgctggaaaacttcataga

SEQ ID NO: 5745 - DNA, 20 bp, human
gtgacttactttctgcatat

SEQ ID NO: 5746 - DNA, 20 bp, human
gctgctcggagaaacatgag

SEQ ID NO: 5747 - DNA, 20 bp, human
gtcatggcggcgacaggaga

SEQ ID NO: 5748 - DNA, 20 bp, human
gctcggagaaacatgagtgg

SEQ ID NO: 5749 - DNA, 20 bp, human
gtgcagaacacaggaaacgg

SEQ ID NO: 5750 - DNA, 20 bp, human
ggccgaagactgcgaagaag

SEQ ID NO: 5751 - DNA, 20 bp, human
gtaactgcaacgagccgggg

SEQ ID NO: 5752 - DNA, 20 bp, human
gcaaaaaaggaagttaacag

SEQ ID NO: 5753 - DNA, 20 bp, human
gctgtcgccgccatgagcac

SEQ ID NO: 5754 - DNA, 20 bp, human
gcgaagaagcggggagagcg

SEQ ID NO: 5755 - DNA, 20 bp, human
gagtgcctccgggcagggat

SEQ ID NO: 5756 - DNA, 20 bp, human
ggggctggcgagtggattca

SEQ ID NO: 5757 - DNA, 20 bp, human
ggtcaccaggaccccttctg

SEQ ID NO: 5758 - DNA, 20 bp, human
gttctgcggcgcgttccgag

SEQ ID NO: 5759 - DNA, 20 bp, human
gccctggcggggatcctaag

SEQ ID NO: 5760 - DNA, 20 bp, human
ggccccttccgaggctaaat

SEQ ID NO: 5761 - DNA, 20 bp, human
ggccgatttagcctcggaag

SEQ ID NO: 5762 - DNA, 20 bp, human
gggctgcgcgcgctgagtca

SEQ ID NO: 5763 - DNA, 20 bp, human
gggatcctaagaggcagtga

SEQ ID NO: 5764 - DNA, 20 bp, human
gagacgctggcatgggatgg

SEQ ID NO: 5765 - DNA, 20 bp, human
gcgcgccgcagaaggggtcc

SEQ ID NO: 5766 - DNA, 20 bp, human
ggtgctgtccaggtatacaa

SEQ ID NO: 5767 - DNA, 20 bp, human
gcctagatatcaaaagctgt

SEQ ID NO: 5768 - DNA, 20 bp, human
gggacagcaccagtgaataa

SEQ ID NO: 5769 - DNA, 20 bp, human
ggccaaataagacagatctt

SEQ ID NO: 5770 - DNA, 20 bp, human
gctgattagaacctaacgat

SEQ ID NO: 5771 - DNA, 20 bp, human
gcctctcaaaaagtcaggaa

SEQ ID NO: 5772 - DNA, 20 bp, human
gaccaaagatctgtcttatt

SEQ ID NO: 5773 - DNA, 20 bp, human
gagcttatagaagggaagat

SEQ ID NO: 5774 - DNA, 20 bp, human
gcttgaacactcctatcgtt

SEQ ID NO: 5775 - DNA, 20 bp, human
gttattaaccccttattcac

SEQ ID NO: 5776 - DNA, 20 bp, human
gaacagctgcaggaacagta

SEQ ID NO: 5777 - DNA, 20 bp, human
gagctgcaggaacagtacgg

SEQ ID NO: 5778 - DNA, 20 bp, human
ggtccagcagtcaccatgtt

SEQ ID NO: 5779 - DNA, 20 bp, human
ggtacggtggagagctgtta

SEQ ID NO: 5780 - DNA, 20 bp, human
gcaagcagggtatataaggt

SEQ ID NO: 5781 - DNA, 20 bp, human
gtgttctggagtatacttct

SEQ ID NO: 5782 - DNA, 20 bp, human
gcggtggagagctgttacgg

SEQ ID NO: 5783 - DNA, 20 bp, human
gttctcaagcagggtatata

SEQ ID NO: 5784 - DNA, 20 bp, human
gagcccaacatggtgactgc

SEQ ID NO: 5785 - DNA, 20 bp, human
gtggccatagctacttgttc

SEQ ID NO: 5786 - DNA, 20 bp, human
gcatttaccagagggagcca

SEQ ID NO: 5787 - DNA, 20 bp, human
gtctgatccgcaaacagatg

SEQ ID NO: 5788 - DNA, 20 bp, human
gccgcagcctcatttaccag

SEQ ID NO: 5789 - DNA, 20 bp, human
gagctacgtgactcctccgg

SEQ ID NO: 5790 - DNA, 20 bp, human
gagaacccgagctgtgcttg

SEQ ID NO: 5791 - DNA, 20 bp, human
gcagagctacgtgactcctc

SEQ ID NO: 5792 - DNA, 20 bp, human
gcgtgactcctccgggggcg

SEQ ID NO: 5793 - DNA, 20 bp, human
ggggagagacctagaccggg

SEQ ID NO: 5794 - DNA, 20 bp, human
gatgcaggctaaccagtcag

SEQ ID NO: 5795 - DNA, 20 bp, human
gagcgggagagacctagacc

SEQ ID NO: 5796 - DNA, 20 bp, human
gccactcactgcagaacccc

SEQ ID NO: 5797 - DNA, 20 bp, human
gggttagaaccgaggatcaa

SEQ ID NO: 5798 - DNA, 20 bp, human
gtgcgggccagccaagatgg

SEQ ID NO: 5799 - DNA, 20 bp, human
ggccagcaggaccaagcatg

SEQ ID NO: 5800 - DNA, 20 bp, human
gctagagacccacccaggaa

SEQ ID NO: 5801 - DNA, 20 bp, human
gtgctgcgggccagccaaga

SEQ ID NO: 5802 - DNA, 20 bp, human
gcacgtggcaagattaacgc

SEQ ID NO: 5803 - DNA, 20 bp, human
gattacgtgagaccacgcaa

SEQ ID NO: 5804 - DNA, 20 bp, human
gtaaccgccccggggagtcg

SEQ ID NO: 5805 - DNA, 20 bp, human
gatctcggagagctgcccaa

SEQ ID NO: 5806 - DNA, 20 bp, human
gacaggacgagtgaagtcta

SEQ ID NO: 5807 - DNA, 20 bp, human
gtcgaaatgggcgcgctagg

SEQ ID NO: 5808 - DNA, 20 bp, human
ggcgcggatccggaaagatc

SEQ ID NO: 5809 - DNA, 20 bp, human
gtcatgttctgaggcttgag

SEQ ID NO: 5810 - DNA, 20 bp, human
gctaaggatgggaggacgtg

SEQ ID NO: 5811 - DNA, 20 bp, human
gagtgaagtctaaggatggg

SEQ ID NO: 5812 - DNA, 20 bp, human
ggacgagtgaagtctaagga

SEQ ID NO: 5813 - DNA, 20 bp, human
gggctcgaaatgggcgcgct

SEQ ID NO: 5814 - DNA, 20 bp, human
gcctccaggaaggagtgatc

SEQ ID NO: 5815 - DNA, 20 bp, human
gaacagcagatctgtcctcc

SEQ ID NO: 5816 - DNA, 20 bp, human
ggcgcggatccggaaaacag

SEQ ID NO: 5817 - DNA, 20 bp, human
ggcagatctgatccccaggg

SEQ ID NO: 5818 - DNA, 20 bp, human
gacagcagatctgatcccca

SEQ ID NO: 5819 - DNA, 20 bp, human
gacgagttaagtctaaagat

SEQ ID NO: 5820 - DNA, 20 bp, human
gtcatgttctgaggctgggg

SEQ ID NO: 5821 - DNA, 20 bp, human
gtaagtctaaagatgggaga

SEQ ID NO: 5822 - DNA, 20 bp, human
ggcaggaatggcgcagctag

SEQ ID NO: 5823 - DNA, 20 bp, human
gtctttcatgttctgaggct

SEQ ID NO: 5824 - DNA, 20 bp, human
gctagagggttactgtttct

SEQ ID NO: 5825 - DNA, 20 bp, human
gacagcgacccgctgttttc

SEQ ID NO: 5826 - DNA, 20 bp, human
gggtgagcagccggtcgtgt

SEQ ID NO: 5827 - DNA, 20 bp, human
ggtctgtgagcccacacgac

SEQ ID NO: 5828 - DNA, 20 bp, human
gaagcgtttcctgagttcgg

SEQ ID NO: 5829 - DNA, 20 bp, human
gaggcaccagctcctttcgc

SEQ ID NO: 5830 - DNA, 20 bp, human
ggaagatggcggccggcgaa

SEQ ID NO: 5831 - DNA, 20 bp, human
gtccgccgacccccgaactc

SEQ ID NO: 5832 - DNA, 20 bp, human
gttcgggggtcggcggaaga

SEQ ID NO: 5833 - DNA, 20 bp, human
ggtttcctgagttcgggggt

SEQ ID NO: 5834 - DNA, 20 bp, human
gtagattggaaaatgtctcg

SEQ ID NO: 5835 - DNA, 20 bp, human
gatatagactggaatagact

SEQ ID NO: 5836 - DNA, 20 bp, human
gagggcacagagggtctctg

SEQ ID NO: 5837 - DNA, 20 bp, human
gaccgcagccccggccgcta

SEQ ID NO: 5838 - DNA, 20 bp, human
gcggcggccatctttactca

SEQ ID NO: 5839 - DNA, 20 bp, human
gagggtctctgcggccgtag

SEQ ID NO: 5840 - DNA, 20 bp, human
gcgcctgaaggccccggtcg

SEQ ID NO: 5841 - DNA, 20 bp, human
gggccagacctctcacccgg

SEQ ID NO: 5842 - DNA, 20 bp, human
gggtcgggcccccggatgag

SEQ ID NO: 5843 - DNA, 20 bp, human
gcgggcgcgcggcgagacca

SEQ ID NO: 5844 - DNA, 20 bp, human
gggccggacctctcatccgg

SEQ ID NO: 5845 - DNA, 20 bp, human
gggccggacctcccacctgg

SEQ ID NO: 5846 - DNA, 20 bp, human
gctggcagtatggccggaga

SEQ ID NO: 5847 - DNA, 20 bp, human
gtttccgcctccctcacaga

SEQ ID NO: 5848 - DNA, 20 bp, human
gtcaaagctggtggtcccta

SEQ ID NO: 5849 - DNA, 20 bp, human
gcgacgtgcggtccacaggg

SEQ ID NO: 5850 - DNA, 20 bp, human
gggcggagaatagagcgcgg

SEQ ID NO: 5851 - DNA, 20 bp, human
gatgaggtcgtcaaagctgg

SEQ ID NO: 5852 - DNA, 20 bp, human
ggaggagcggccggaataat

SEQ ID NO: 5853 - DNA, 20 bp, human
gtatccggcccttgcgatca

SEQ ID NO: 5854 - DNA, 20 bp, human
ggtggaaaacccgagctcgg

SEQ ID NO: 5855 - DNA, 20 bp, human
gggcggagccgttggaagga

SEQ ID NO: 5856 - DNA, 20 bp, human
gtgccgaagcgactcaaacg

SEQ ID NO: 5857 - DNA, 20 bp, human
gttccatggacgttacgccc

SEQ ID NO: 5858 - DNA, 20 bp, human
gggtccggtaagtatcgagg

SEQ ID NO: 5859 - DNA, 20 bp, human
ggtaccagggaagagcgtcg

SEQ ID NO: 5860 - DNA, 20 bp, human
gagaagtgctaagggtacca

SEQ ID NO: 5861 - DNA, 20 bp, human
gcgcacaccatgcagagaaa

SEQ ID NO: 5862 - DNA, 20 bp, human
ggcaccgcgacgctcttccc

SEQ ID NO: 5863 - DNA, 20 bp, human
gtgcgttctcgttctagctg

SEQ ID NO: 5864 - DNA, 20 bp, human
gcgggcagtccagccagggt

SEQ ID NO: 5865 - DNA, 20 bp, human
gctgggtccggtaagtatcg

SEQ ID NO: 5866 - DNA, 20 bp, human
gcagcccaaaaaacaaagca

SEQ ID NO: 5867 - DNA, 20 bp, human
ggcaagacagagaggtgagg

SEQ ID NO: 5868 - DNA, 20 bp, human
gcagagaggtgagggggcac

SEQ ID NO: 5869 - DNA, 20 bp, human
gcaaaaaacaaagcaaggag

SEQ ID NO: 5870 - DNA, 20 bp, human
gcgcaacccgaagcagggag

SEQ ID NO: 5871 - DNA, 20 bp, human
gcatgcaagacagagaggtg

SEQ ID NO: 5872 - DNA, 20 bp, human
gctagacatgcaagacagag

SEQ ID NO: 5873 - DNA, 20 bp, human
gcaatgcctctccctgcttc

SEQ ID NO: 5874 - DNA, 20 bp, human
gaggggtgacggactcacct

SEQ ID NO: 5875 - DNA, 20 bp, human
gctagctagttctgtttctg

SEQ ID NO: 5876 - DNA, 20 bp, human
gaccacgtcgaactcctcgt

SEQ ID NO: 5877 - DNA, 20 bp, human
gtgcgaaccgcagacaggga

SEQ ID NO: 5878 - DNA, 20 bp, human
gggtggaggaacagcaccga

SEQ ID NO: 5879 - DNA, 20 bp, human
ggccgacgaggagttcgacg

SEQ ID NO: 5880 - DNA, 20 bp, human
ggggccatggcggaggagca

SEQ ID NO: 5881 - DNA, 20 bp, human
gagtccccggcacagcgcac

SEQ ID NO: 5882 - DNA, 20 bp, human
ggccgcccacgcccaggtct

SEQ ID NO: 5883 - DNA, 20 bp, human
ggtgcggacctcgccgtgga

SEQ ID NO: 5884 - DNA, 20 bp, human
ggggtgcagttgcggctcca

SEQ ID NO: 5885 - DNA, 20 bp, human
gtgcgcagaagacccccatc

SEQ ID NO: 5886 - DNA, 20 bp, human
gcggcgcaccgttaagatgg

SEQ ID NO: 5887 - DNA, 20 bp, human
gctgggccgcggaaccggac

SEQ ID NO: 5888 - DNA, 20 bp, human
gtgcagaaggccaatctcta

SEQ ID NO: 5889 - DNA, 20 bp, human
gggttccgcggcccaggcag

SEQ ID NO: 5890 - DNA, 20 bp, human
gggtggtgggcccacacaag

SEQ ID NO: 5891 - DNA, 20 bp, human
ggcggccctaggaaatgact

SEQ ID NO: 5892 - DNA, 20 bp, human
gcaaggtgtcagactcacgt

SEQ ID NO: 5893 - DNA, 20 bp, human
gaggtggataccctagagat

SEQ ID NO: 5894 - DNA, 20 bp, human
gcgctcttcgaagaatcctc

SEQ ID NO: 5895 - DNA, 20 bp, human
gcggctgggctgcggaaacg

SEQ ID NO: 5896 - DNA, 20 bp, human
ggagaggtcgaggttgacag

SEQ ID NO: 5897 - DNA, 20 bp, human
ggctgccacggcatggagaa

SEQ ID NO: 5898 - DNA, 20 bp, human
ggagagtctgggagaggtcg

SEQ ID NO: 5899 - DNA, 20 bp, human
ggtcccggagagtctgggag

SEQ ID NO: 5900 - DNA, 20 bp, human
gaggtcgaggttgacagagg

SEQ ID NO: 5901 - DNA, 20 bp, human
gtcgaggttgacagaggagg

SEQ ID NO: 5902 - DNA, 20 bp, human
gcaatcccgcacctccacac

SEQ ID NO: 5903 - DNA, 20 bp, human
ggcggccgcagccctcgtac

SEQ ID NO: 5904 - DNA, 20 bp, human
gtgggcgggctgccacggca

SEQ ID NO: 5905 - DNA, 20 bp, human
gctgcaggtcccggagagtc

SEQ ID NO: 5906 - DNA, 20 bp, human
gcggcaggcgcgaatcccag

SEQ ID NO: 5907 - DNA, 20 bp, human
gtaagagcatgggatcccgg

SEQ ID NO: 5908 - DNA, 20 bp, human
gggcggcggggtaagagcat

SEQ ID NO: 5909 - DNA, 20 bp, human
gcgcagtggacacaacaccg

SEQ ID NO: 5910 - DNA, 20 bp, human
gcctggggtccggaacctcc

SEQ ID NO: 5911 - DNA, 20 bp, human
gaggcgcgaatcccagcggc

SEQ ID NO: 5912 - DNA, 20 bp, human
gcggggagtgcagctatccc

SEQ ID NO: 5913 - DNA, 20 bp, human
gtgaggggacgcggtgatag

SEQ ID NO: 5914 - DNA, 20 bp, human
gggggacgcggtgatagtgg

SEQ ID NO: 5915 - DNA, 20 bp, human
gctcagaaccgcaaggacaa

SEQ ID NO: 5916 - DNA, 20 bp, human
gtgcggtgccgcagcaatgg

SEQ ID NO: 5917 - DNA, 20 bp, human
ggtgagcgccgccattgctg

SEQ ID NO: 5918 - DNA, 20 bp, human
gggatgtggatcaagttggt

SEQ ID NO: 5919 - DNA, 20 bp, human
ggcgtgcggtgccgcagcaa

SEQ ID NO: 5920 - DNA, 20 bp, human
gcggcgctcacaattgccac

SEQ ID NO: 5921 - DNA, 20 bp, human
gtcccggatgtggatcaagt

SEQ ID NO: 5922 - DNA, 20 bp, human
gatgcgcgggatcccggatg

SEQ ID NO: 5923 - DNA, 20 bp, human
gcatctcccgggagttagaa

SEQ ID NO: 5924 - DNA, 20 bp, human
ggaacggtacctggcacctc

SEQ ID NO: 5925 - DNA, 20 bp, human
gctggctgaatggctgttgg

SEQ ID NO: 5926 - DNA, 20 bp, human
gcctgggccaggcctagagt

SEQ ID NO: 5927 - DNA, 20 bp, human
ggcgcgctcaccgacttcat

SEQ ID NO: 5928 - DNA, 20 bp, human
ggcctggggaaaaaagaatt

SEQ ID NO: 5929 - DNA, 20 bp, human
gacagctaagaccctcccgg

SEQ ID NO: 5930 - DNA, 20 bp, human
gcagtggagggatctaaggt

SEQ ID NO: 5931 - DNA, 20 bp, human
ggagtgggcacagcctctgt

SEQ ID NO: 5932 - DNA, 20 bp, human
gcgagcccctcgactagcca

SEQ ID NO: 5933 - DNA, 20 bp, human
gatcacagatccgcactcca

SEQ ID NO: 5934 - DNA, 20 bp, human
gcttgccatggctagtcgag

SEQ ID NO: 5935 - DNA, 20 bp, human
ggagcgcgcagacatagctt

SEQ ID NO: 5936 - DNA, 20 bp, human
gccaggcagatgcgatccag

SEQ ID NO: 5937 - DNA, 20 bp, human
gcccgcgaccctccgaacag

SEQ ID NO: 5938 - DNA, 20 bp, human
ggcgaccctccgaacagagg

SEQ ID NO: 5939 - DNA, 20 bp, human
gtccgaacagaggcggcggg

SEQ ID NO: 5940 - DNA, 20 bp, human
gcggtctgggcgggaaccga

SEQ ID NO: 5941 - DNA, 20 bp, human
gaccctccgaacagaggcgg

SEQ ID NO: 5942 - DNA, 20 bp, human
gtgggtggccgaccagaggg

SEQ ID NO: 5943 - DNA, 20 bp, human
gtctgggcgggaaccgaggg

SEQ ID NO: 5944 - DNA, 20 bp, human
gacctcccgccgcctctgtt

SEQ ID NO: 5945 - DNA, 20 bp, human
gatgcgatccagcggctctg

SEQ ID NO: 5946 - DNA, 20 bp, human
gtccgaaaggcgtcctcccc

SEQ ID NO: 5947 - DNA, 20 bp, human
gaatggccgcctaaagaaac

SEQ ID NO: 5948 - DNA, 20 bp, human
gaggcggccattcctggcgg

SEQ ID NO: 5949 - DNA, 20 bp, human
gactctggcgactgagcccg

SEQ ID NO: 5950 - DNA, 20 bp, human
gaaacccaaacagaaatgtg

SEQ ID NO: 5951 - DNA, 20 bp, human
ggcccaaaaggtacagagag

SEQ ID NO: 5952 - DNA, 20 bp, human
ggggtataggccgcgagatg

SEQ ID NO: 5953 - DNA, 20 bp, human
gtcggtctggaggtgaaaag

SEQ ID NO: 5954 - DNA, 20 bp, human
gccggctctgacggtagaag

SEQ ID NO: 5955 - DNA, 20 bp, human
gcttccggatcagagggtat

SEQ ID NO: 5956 - DNA, 20 bp, human
gtcccaccacgaggccacca

SEQ ID NO: 5957 - DNA, 20 bp, human
gtggcgtgcgaattcccagg

SEQ ID NO: 5958 - DNA, 20 bp, human
ggcgtggagtgcagacctct

SEQ ID NO: 5959 - DNA, 20 bp, human
gctagcttgcaaaaacccag

SEQ ID NO: 5960 - DNA, 20 bp, human
gaggccaccagggtgactgc

SEQ ID NO: 5961 - DNA, 20 bp, human
gaaagccggaagggacccta

SEQ ID NO: 5962 - DNA, 20 bp, human
gctagggacaatctgatcca

SEQ ID NO: 5963 - DNA, 20 bp, human
gtcgcagctccggcgcagat

SEQ ID NO: 5964 - DNA, 20 bp, human
gaatcccgcagtcaccctgg

SEQ ID NO: 5965 - DNA, 20 bp, human
gaggtggacgtgggagaccc

SEQ ID NO: 5966 - DNA, 20 bp, human
gagactgcggagtgggtcag

SEQ ID NO: 5967 - DNA, 20 bp, human
gaggttccgatcacagactg

SEQ ID NO: 5968 - DNA, 20 bp, human
ggcaaacccggtaggacttg

SEQ ID NO: 5969 - DNA, 20 bp, human
ggcgcccgtgcaaacccggt

SEQ ID NO: 5970 - DNA, 20 bp, human
ggggcgcgcccgtgcaaacc

SEQ ID NO: 5971 - DNA, 20 bp, human
gcgatcacagactgcggagt

SEQ ID NO: 5972 - DNA, 20 bp, human
gagagcttggtcgtggataa

SEQ ID NO: 5973 - DNA, 20 bp, human
ggggctgccccaagtcctac

SEQ ID NO: 5974 - DNA, 20 bp, human
ggcccaggaagagacttcag

SEQ ID NO: 5975 - DNA, 20 bp, human
gaccagtgctgtaaaataca

SEQ ID NO: 5976 - DNA, 20 bp, human
gcattcccgaaggacttcgg

SEQ ID NO: 5977 - DNA, 20 bp, human
gaggacttcgggggtctcgg

SEQ ID NO: 5978 - DNA, 20 bp, human
ggacccgagaggctacgtcg

SEQ ID NO: 5979 - DNA, 20 bp, human
ggtgctgaataccagtccaa

SEQ ID NO: 5980 - DNA, 20 bp, human
gttcgggaatgcggttgcaa

SEQ ID NO: 5981 - DNA, 20 bp, human
gtcccagcgccagacccgag

SEQ ID NO: 5982 - DNA, 20 bp, human
gcacggaaagggtcgatcga

SEQ ID NO: 5983 - DNA, 20 bp, human
gtaccgtaagggtccctcac

SEQ ID NO: 5984 - DNA, 20 bp, human
gctggcgctgggagcttcac

SEQ ID NO: 5985 - DNA, 20 bp, human
gtcacctcggggactctggg

SEQ ID NO: 5986 - DNA, 20 bp, human
gtgaggagcccgctaaggag

SEQ ID NO: 5987 - DNA, 20 bp, human
ggctctccgcacgacgtcac

SEQ ID NO: 5988 - DNA, 20 bp, human
gggagcggcgggtcatgcaa

SEQ ID NO: 5989 - DNA, 20 bp, human
gcgcggtgaggagcccgcta

SEQ ID NO: 5990 - DNA, 20 bp, human
gagcggcgctggcggacgtc

SEQ ID NO: 5991 - DNA, 20 bp, human
gcgcagacgcctcaacccca

SEQ ID NO: 5992 - DNA, 20 bp, human
gacgtcccgggacaactata

SEQ ID NO: 5993 - DNA, 20 bp, human
gcagggaaccgccacaacgt

SEQ ID NO: 5994 - DNA, 20 bp, human
gggctgcccgtgacgtcgtg

SEQ ID NO: 5995 - DNA, 20 bp, human
ggctgctctagggtcctccg

SEQ ID NO: 5996 - DNA, 20 bp, human
ggctctacacatagccccca

SEQ ID NO: 5997 - DNA, 20 bp, human
ggtagagatggatgtcaata

SEQ ID NO: 5998 - DNA, 20 bp, human
gggtctgaagcggggtctca

SEQ ID NO: 5999 - DNA, 20 bp, human
gagggtggacatgtctgagg

SEQ ID NO: 6000 - DNA, 20 bp, human
gtcaggaggggaaatccgag

SEQ ID NO: 6001 - DNA, 20 bp, human
gactctgcgtctgtaatgtg

SEQ ID NO: 6002 - DNA, 20 bp, human
gtcacaggagtgcacagaat

SEQ ID NO: 6003 - DNA, 20 bp, human
gaaatggctgggagggggat

SEQ ID NO: 6004 - DNA, 20 bp, human
gagcccagagtaggagtccg

SEQ ID NO: 6005 - DNA, 20 bp, human
gctgagggtggacatgtctg

SEQ ID NO: 6006 - DNA, 20 bp, human
gggagcggggtcatgagaga

SEQ ID NO: 6007 - DNA, 20 bp, human
gccagtcccggccataatcc

SEQ ID NO: 6008 - DNA, 20 bp, human
gcccggccataatcccggag

SEQ ID NO: 6009 - DNA, 20 bp, human
gggacgtggagcatcagatg

SEQ ID NO: 6010 - DNA, 20 bp, human
ggaccgggcagggccacact

SEQ ID NO: 6011 - DNA, 20 bp, human
ggccccgcccccacgctaaa

SEQ ID NO: 6012 - DNA, 20 bp, human
gcccgctccgggattatggc

SEQ ID NO: 6013 - DNA, 20 bp, human
gcactgggacgcggtgagac

SEQ ID NO: 6014 - DNA, 20 bp, human
gacagtaccgtttagcgtgg

SEQ ID NO: 6015 - DNA, 20 bp, human
gtgaccccgctccgggatta

SEQ ID NO: 6016 - DNA, 20 bp, human
gggcgcccttggtgcagtgt

SEQ ID NO: 6017 - DNA, 20 bp, human
ggaaaggggatggatcccag

SEQ ID NO: 6018 - DNA, 20 bp, human
gtagcaccagaacaccgcag

SEQ ID NO: 6019 - DNA, 20 bp, human
gggcgtgcaagtatccgctg

SEQ ID NO: 6020 - DNA, 20 bp, human
gttctggtgctagagtggag

SEQ ID NO: 6021 - DNA, 20 bp, human
gagctagggctgagaaccta

SEQ ID NO: 6022 - DNA, 20 bp, human
gcttgcacgccatctcccct

SEQ ID NO: 6023 - DNA, 20 bp, human
gagaggacggttgcaacatg

SEQ ID NO: 6024 - DNA, 20 bp, human
gtggccgcgcccaggggaga

SEQ ID NO: 6025 - DNA, 20 bp, human
gcggtgttctggtgctagag

SEQ ID NO: 6026 - DNA, 20 bp, human
ggctggcactcaagcaccgt

SEQ ID NO: 6027 - DNA, 20 bp, human
gcggtaccaacacagttcaa

SEQ ID NO: 6028 - DNA, 20 bp, human
gctggaggggccccacaggt

SEQ ID NO: 6029 - DNA, 20 bp, human
gagcaccgtgggaccttggc

SEQ ID NO: 6030 - DNA, 20 bp, human
ggctcagagagaatgtatag

SEQ ID NO: 6031 - DNA, 20 bp, human
gacagttcaacggcacaaag

SEQ ID NO: 6032 - DNA, 20 bp, human
gagaagcctgacccacctgt

SEQ ID NO: 6033 - DNA, 20 bp, human
ggagaatgtataggggcctg

SEQ ID NO: 6034 - DNA, 20 bp, human
gttctgactgctgggtgagc

SEQ ID NO: 6035 - DNA, 20 bp, human
ggggctttgccaaaagaata

SEQ ID NO: 6036 - DNA, 20 bp, human
gccggccatggcagatcctc

SEQ ID NO: 6037 - DNA, 20 bp, human
gagatcctcgggctccatgt

SEQ ID NO: 6038 - DNA, 20 bp, human
ggcgcgcagctgaggctagt

SEQ ID NO: 6039 - DNA, 20 bp, human
gccagagcgagacaccaaca

SEQ ID NO: 6040 - DNA, 20 bp, human
gtggggcccgtagtgagagt

SEQ ID NO: 6041 - DNA, 20 bp, human
gggactccgactctcactac

SEQ ID NO: 6042 - DNA, 20 bp, human
gctggaaagtatagacgacg

SEQ ID NO: 6043 - DNA, 20 bp, human
gcctccagctcgcccggcca

SEQ ID NO: 6044 - DNA, 20 bp, human
gaacgctgagagaggaccac

SEQ ID NO: 6045 - DNA, 20 bp, human
gaggcccaggacccaccgag

SEQ ID NO: 6046 - DNA, 20 bp, human
gcacgaagctgggacgaggt

SEQ ID NO: 6047 - DNA, 20 bp, human
gtgggggctgccgggaccag

SEQ ID NO: 6048 - DNA, 20 bp, human
gtggcgccccccagcagctt

SEQ ID NO: 6049 - DNA, 20 bp, human
gcccccagcagcttaggcga

SEQ ID NO: 6050 - DNA, 20 bp, human
ggacccaggccagacttagt

SEQ ID NO: 6051 - DNA, 20 bp, human
ggcggtcccgggaatcgcac

SEQ ID NO: 6052 - DNA, 20 bp, human
gccgaggcgccggcagccct

SEQ ID NO: 6053 - DNA, 20 bp, human
gggacgaggtgggcaagatt

SEQ ID NO: 6054 - DNA, 20 bp, human
gggccacgcggatgcggtag

SEQ ID NO: 6055 - DNA, 20 bp, human
gccagggcaggtgaaatgta

SEQ ID NO: 6056 - DNA, 20 bp, human
gggtgagtgagcaggtgtct

SEQ ID NO: 6057 - DNA, 20 bp, human
gagagactttgcaactgggg

SEQ ID NO: 6058 - DNA, 20 bp, human
gcaccagctgggctccgcct

SEQ ID NO: 6059 - DNA, 20 bp, human
gccacacgaaggcccaaggc

SEQ ID NO: 6060 - DNA, 20 bp, human
ggcacccaccccggccacca

SEQ ID NO: 6061 - DNA, 20 bp, human
gtcagtcccagacaccgtgg

SEQ ID NO: 6062 - DNA, 20 bp, human
gtgaccattgtggggacaca

SEQ ID NO: 6063 - DNA, 20 bp, human
gcactcagtcccagacaccg

SEQ ID NO: 6064 - DNA, 20 bp, human
gactgggcctgcctctgaaa

SEQ ID NO: 6065 - DNA, 20 bp, human
gcctccgaggtgcagtggtg

SEQ ID NO: 6066 - DNA, 20 bp, human
ggcatagagcgaggccccag

SEQ ID NO: 6067 - DNA, 20 bp, human
gcgcatccgcgtgtccactg

SEQ ID NO: 6068 - DNA, 20 bp, human
gatcggccagaggccaacgg

SEQ ID NO: 6069 - DNA, 20 bp, human
gcaaggagcagagcttcaag

SEQ ID NO: 6070 - DNA, 20 bp, human
gttccaaggagatcgggtag

SEQ ID NO: 6071 - DNA, 20 bp, human
gggcccttggcaaagagaat

SEQ ID NO: 6072 - DNA, 20 bp, human
ggagcatgccctcaattcca

SEQ ID NO: 6073 - DNA, 20 bp, human
gccccaagcgacctccgaga

SEQ ID NO: 6074 - DNA, 20 bp, human
gaggcttggcccaaagtccg

SEQ ID NO: 6075 - DNA, 20 bp, human
gttggaaccggcatagagcg

SEQ ID NO: 6076 - DNA, 20 bp, human
gcggtgtcagctggaaccag

SEQ ID NO: 6077 - DNA, 20 bp, human
gagtcagtggcaataaccag

SEQ ID NO: 6078 - DNA, 20 bp, human
gaaccaggcgtgtcccaggg

SEQ ID NO: 6079 - DNA, 20 bp, human
ggcctaagtccagctctcta

SEQ ID NO: 6080 - DNA, 20 bp, human
gctccagccactggtagcag

SEQ ID NO: 6081 - DNA, 20 bp, human
gcggcagaaccaggcatccg

SEQ ID NO: 6082 - DNA, 20 bp, human
gggaggtggccgccccgcgg

SEQ ID NO: 6083 - DNA, 20 bp, human
gtggaaccagcggcagaacc

SEQ ID NO: 6084 - DNA, 20 bp, human
gcgcacagggctgcagagcg

SEQ ID NO: 6085 - DNA, 20 bp, human
ggccgtagagagctggactt

SEQ ID NO: 6086 - DNA, 20 bp, human
gccacggtgaccgtgtagga

SEQ ID NO: 6087 - DNA, 20 bp, human
ggtggccacggtgaccgtgt

SEQ ID NO: 6088 - DNA, 20 bp, human
gggccggtgggtaccctggt

SEQ ID NO: 6089 - DNA, 20 bp, human
gcagtggccggtgggtaccc

SEQ ID NO: 6090 - DNA, 20 bp, human
gaagcgtccaggacccctcg

SEQ ID NO: 6091 - DNA, 20 bp, human
gtgcccaccagggtacccac

SEQ ID NO: 6092 - DNA, 20 bp, human
gcacctggaccgccgcgccg

SEQ ID NO: 6093 - DNA, 20 bp, human
ggaggctgcggcgctagatg

SEQ ID NO: 6094 - DNA, 20 bp, human
ggtgaccgtgtaggagggca

SEQ ID NO: 6095 - DNA, 20 bp, human
gtgggctcccagtggccggt

SEQ ID NO: 6096 - DNA, 20 bp, human
gagccagggctgcaacttga

SEQ ID NO: 6097 - DNA, 20 bp, human
gcaacctgccctgtacagga

SEQ ID NO: 6098 - DNA, 20 bp, human
gacgctgatgagggtgacga

SEQ ID NO: 6099 - DNA, 20 bp, human
gaaggtgagaagactagaaa

SEQ ID NO: 6100 - DNA, 20 bp, human
gatgctgatcatagacactt

SEQ ID NO: 6101 - DNA, 20 bp, human
gttctggaccacgctgatga

SEQ ID NO: 6102 - DNA, 20 bp, human
ggatcatagacacttcggtg

SEQ ID NO: 6103 - DNA, 20 bp, human
gagcgtggtccagaatggta

SEQ ID NO: 6104 - DNA, 20 bp, human
gtccccttcctgtacagggc

SEQ ID NO: 6105 - DNA, 20 bp, human
gacagggcaggttgtgcagc

SEQ ID NO: 6106 - DNA, 20 bp, human
ggggaagcgcgacctcagag

SEQ ID NO: 6107 - DNA, 20 bp, human
ggccctcaggtagggaccag

SEQ ID NO: 6108 - DNA, 20 bp, human
gaaagacagggacctcaata

SEQ ID NO: 6109 - DNA, 20 bp, human
gtagagtgcaagactgtggg

SEQ ID NO: 6110 - DNA, 20 bp, human
ggatgggcccagctctctct

SEQ ID NO: 6111 - DNA, 20 bp, human
gcctggatcggtgagtacaa

SEQ ID NO: 6112 - DNA, 20 bp, human
gagtgtgccggccctcaggt

SEQ ID NO: 6113 - DNA, 20 bp, human
gaccagtggtcacacacagg

SEQ ID NO: 6114 - DNA, 20 bp, human
ggggaccagtggtcacacac

SEQ ID NO: 6115 - DNA, 20 bp, human
gtattagagtgcaagactgt

SEQ ID NO: 6116 - DNA, 20 bp, human
gtcctggtggctgtcaccgt

SEQ ID NO: 6117 - DNA, 20 bp, human
gcggcacccgggaccttcag

SEQ ID NO: 6118 - DNA, 20 bp, human
ggggcccctgcatgtcttgg

SEQ ID NO: 6119 - DNA, 20 bp, human
gctgcccccaagacatgcag

SEQ ID NO: 6120 - DNA, 20 bp, human
gccagggcccctgcatgtct

SEQ ID NO: 6121 - DNA, 20 bp, human
gcagcaggagggaggcgaag

SEQ ID NO: 6122 - DNA, 20 bp, human
gtcttggcgaccttctggat

SEQ ID NO: 6123 - DNA, 20 bp, human
gctgcctgggtttaaatcag

SEQ ID NO: 6124 - DNA, 20 bp, human
gccatggccaggggcgtctc

SEQ ID NO: 6125 - DNA, 20 bp, human
ggaggcgaagtggggacacc

SEQ ID NO: 6126 - DNA, 20 bp, human
gctctgagcagagttaattc

SEQ ID NO: 6127 - DNA, 20 bp, human
gtgagttggtggggtgaagg

SEQ ID NO: 6128 - DNA, 20 bp, human
gaaggggaggatgagttggt

SEQ ID NO: 6129 - DNA, 20 bp, human
gggcaaaccagtttttcata

SEQ ID NO: 6130 - DNA, 20 bp, human
gacacactgtttctcataaa

SEQ ID NO: 6131 - DNA, 20 bp, human
gacttttgcctggaatacat

SEQ ID NO: 6132 - DNA, 20 bp, human
gggcttcagtttcaggaagt

SEQ ID NO: 6133 - DNA, 20 bp, human
gaaactgtagtcattatgaa

SEQ ID NO: 6134 - DNA, 20 bp, human
gagtcattatgaaggggaga

SEQ ID NO: 6135 - DNA, 20 bp, human
ggactacagtttaccattgt

SEQ ID NO: 6136 - DNA, 20 bp, human
ggacctagttcactgaaggg

SEQ ID NO: 6137 - DNA, 20 bp, human
gaatgacctagttcactgaa

SEQ ID NO: 6138 - DNA, 20 bp, human
gtcccgggacagggattcaa

SEQ ID NO: 6139 - DNA, 20 bp, human
gtaaagtgggcaaactctca

SEQ ID NO: 6140 - DNA, 20 bp, human
gtgtgtgtgaggcattgatt

SEQ ID NO: 6141 - DNA, 20 bp, human
gtccatgcccggggaagttc

SEQ ID NO: 6142 - DNA, 20 bp, human
gatcaggtcaaagcatagat

SEQ ID NO: 6143 - DNA, 20 bp, human
gcttcttccagaacttcccc

SEQ ID NO: 6144 - DNA, 20 bp, human
ggaatgagatgaaaccaata

SEQ ID NO: 6145 - DNA, 20 bp, human
gaatccctgtcccgggaaca

SEQ ID NO: 6146 - DNA, 20 bp, human
gggcgctactgcagacacca

SEQ ID NO: 6147 - DNA, 20 bp, human
gcagacaccagggccgccaa

SEQ ID NO: 6148 - DNA, 20 bp, human
gctcacagggactgatccca

SEQ ID NO: 6149 - DNA, 20 bp, human
gcggcccgagaccaggtaag

SEQ ID NO: 6150 - DNA, 20 bp, human
gtcccgggcctctccagacg

SEQ ID NO: 6151 - DNA, 20 bp, human
ggccgccaagggagcggact

SEQ ID NO: 6152 - DNA, 20 bp, human
gggctccgagtccgctccct

SEQ ID NO: 6153 - DNA, 20 bp, human
gctcggagccggccctgggg

SEQ ID NO: 6154 - DNA, 20 bp, human
gtccgagtccgctcccttgg

SEQ ID NO: 6155 - DNA, 20 bp, human
gggccctggggcgggcacat

SEQ ID NO: 6156 - DNA, 20 bp, human
gcactggcgagggtccgtcc

SEQ ID NO: 6157 - DNA, 20 bp, human
gctcagtcacggggcaccaa

SEQ ID NO: 6158 - DNA, 20 bp, human
ggagcacggagccaggatag

SEQ ID NO: 6159 - DNA, 20 bp, human
gcgtccaggcacaagcgcgt

SEQ ID NO: 6160 - DNA, 20 bp, human
ggccgtagctctagagacct

SEQ ID NO: 6161 - DNA, 20 bp, human
gtctagagctacggctaagg

SEQ ID NO: 6162 - DNA, 20 bp, human
ggcggagccggcgaactcag

SEQ ID NO: 6163 - DNA, 20 bp, human
gtcgggaggtaggagaccct

SEQ ID NO: 6164 - DNA, 20 bp, human
ggcacaagcgcgtgggagca

SEQ ID NO: 6165 - DNA, 20 bp, human
gcactccgcgcccgctatcc

SEQ ID NO: 6166 - DNA, 20 bp, human
gcacttagaaactcccggtg

SEQ ID NO: 6167 - DNA, 20 bp, human
ggccagaagtgacggctctg

SEQ ID NO: 6168 - DNA, 20 bp, human
ggccatctcagctgccacac

SEQ ID NO: 6169 - DNA, 20 bp, human
ggaggtggcatgaagctcag

SEQ ID NO: 6170 - DNA, 20 bp, human
ggtacatgcgatgtttgagg

SEQ ID NO: 6171 - DNA, 20 bp, human
gagtgacggctctggggtag

SEQ ID NO: 6172 - DNA, 20 bp, human
gggtaatatagttctttcct

SEQ ID NO: 6173 - DNA, 20 bp, human
gaccccagagccgtcacttc

SEQ ID NO: 6174 - DNA, 20 bp, human
gcactggagcgcagcttgcg

SEQ ID NO: 6175 - DNA, 20 bp, human
ggttgttagatgttagatgt

SEQ ID NO: 6176 - DNA, 20 bp, human
ggggccccagcatgtctgga

SEQ ID NO: 6177 - DNA, 20 bp, human
ggtgtgaggcttgggcccca

SEQ ID NO: 6178 - DNA, 20 bp, human
gacagaaatgtgtgaggctt

SEQ ID NO: 6179 - DNA, 20 bp, human
ggttgtgtaggggcagctcg

SEQ ID NO: 6180 - DNA, 20 bp, human
gtgcagggccccagcatgtc

SEQ ID NO: 6181 - DNA, 20 bp, human
gctgccctccagacatgctg

SEQ ID NO: 6182 - DNA, 20 bp, human
gagcaggacagtggcgaggc

SEQ ID NO: 6183 - DNA, 20 bp, human
ggaaggaacagaaatgtgtg

SEQ ID NO: 6184 - DNA, 20 bp, human
ggaggcaggaattctgggca

SEQ ID NO: 6185 - DNA, 20 bp, human
gcctgtgtgtgtgttgtgta

SEQ ID NO: 6186 - DNA, 20 bp, human
gctgcatgtctggaagcagt

SEQ ID NO: 6187 - DNA, 20 bp, human
gtctggaagcagtcggagag

SEQ ID NO: 6188 - DNA, 20 bp, human
ggcggcgaggcggaaatccc

SEQ ID NO: 6189 - DNA, 20 bp, human
gttgctccccagggctgtcc

SEQ ID NO: 6190 - DNA, 20 bp, human
gcagctcatactccatacct

SEQ ID NO: 6191 - DNA, 20 bp, human
ggaggcggaaatcccaggta

SEQ ID NO: 6192 - DNA, 20 bp, human
ggaaggagcagaagtgtgtg

SEQ ID NO: 6193 - DNA, 20 bp, human
ggcagaagaaggacaaactg

SEQ ID NO: 6194 - DNA, 20 bp, human
ggtgtgtgtaggggcagctg

SEQ ID NO: 6195 - DNA, 20 bp, human
gaagcagtcggagagcggcg

SEQ ID NO: 6196 - DNA, 20 bp, human
gcgctcacctgaagctccac

SEQ ID NO: 6197 - DNA, 20 bp, human
gaatagctggaaggcagcgt

SEQ ID NO: 6198 - DNA, 20 bp, human
ggcttcaggtgagcgagtgt

SEQ ID NO: 6199 - DNA, 20 bp, human
ggcgagtgtgggtcccgggt

SEQ ID NO: 6200 - DNA, 20 bp, human
ggcgagcttggcaacccagt

SEQ ID NO: 6201 - DNA, 20 bp, human
gtgcagcggcgcccagtctg

SEQ ID NO: 6202 - DNA, 20 bp, human
gagctggaaggcagcgtggg

SEQ ID NO: 6203 - DNA, 20 bp, human
gtggaaggcagcgtgggtgg

SEQ ID NO: 6204 - DNA, 20 bp, human
gtcgtgaatgaatagctgga

SEQ ID NO: 6205 - DNA, 20 bp, human
ggccaagctcgcgccggatg

SEQ ID NO: 6206 - DNA, 20 bp, human
gaaccacagcgctcaggtaa

SEQ ID NO: 6207 - DNA, 20 bp, human
gcaggtaagggcgcgacgaa

SEQ ID NO: 6208 - DNA, 20 bp, human
gcatatgcgacagcagggag

SEQ ID NO: 6209 - DNA, 20 bp, human
gtgcgagcgaggagccgcac

SEQ ID NO: 6210 - DNA, 20 bp, human
gggccacctcctggaatccc

SEQ ID NO: 6211 - DNA, 20 bp, human
gagggcgcgcgtctgcggac

SEQ ID NO: 6212 - DNA, 20 bp, human
gtgacgccggctggttaggg

SEQ ID NO: 6213 - DNA, 20 bp, human
gcggggcaaccacagcgctc

SEQ ID NO: 6214 - DNA, 20 bp, human
gggcctgacctgagccgtgg

SEQ ID NO: 6215 - DNA, 20 bp, human
gtggccttttcgcatgggag

SEQ ID NO: 6216 - DNA, 20 bp, human
gccgtcggttgggcgcagac

SEQ ID NO: 6217 - DNA, 20 bp, human
gcagtagcgggccgtcggtt

SEQ ID NO: 6218 - DNA, 20 bp, human
gcagcagggcacctggaggg

SEQ ID NO: 6219 - DNA, 20 bp, human
gctgcgcagtagcgggccgt

SEQ ID NO: 6220 - DNA, 20 bp, human
gtcccttacgccctgaacca

SEQ ID NO: 6221 - DNA, 20 bp, human
ggcacacttgataaccgcag

SEQ ID NO: 6222 - DNA, 20 bp, human
gggttatcaagtgtgctgaa

SEQ ID NO: 6223 - DNA, 20 bp, human
gggccgcgcctgcgcagtag

SEQ ID NO: 6224 - DNA, 20 bp, human
gaaggcctatttgtctcttg

SEQ ID NO: 6225 - DNA, 20 bp, human
gcaagaaccaggagggcacc

SEQ ID NO: 6226 - DNA, 20 bp, human
ggtcaccagtgagccggcag

SEQ ID NO: 6227 - DNA, 20 bp, human
ggtcacaggaatctgaatgg

SEQ ID NO: 6228 - DNA, 20 bp, human
gttggcctgccatctcccaa

SEQ ID NO: 6229 - DNA, 20 bp, human
ggaagcctctgccggctcac

SEQ ID NO: 6230 - DNA, 20 bp, human
gtcactggtgactattgtta

SEQ ID NO: 6231 - DNA, 20 bp, human
gagggcaaacctcacaactc

SEQ ID NO: 6232 - DNA, 20 bp, human
gcagatctttgggcagtcca

SEQ ID NO: 6233 - DNA, 20 bp, human
gcttggaatggccactaaag

SEQ ID NO: 6234 - DNA, 20 bp, human
gagcctcaggtaaaatcatc

SEQ ID NO: 6235 - DNA, 20 bp, human
gtattgttagggcaagcctc

SEQ ID NO: 6236 - DNA, 20 bp, human
ggactgtcgcgtagctcctg

SEQ ID NO: 6237 - DNA, 20 bp, human
gggtggaggaaggtagtgga

SEQ ID NO: 6238 - DNA, 20 bp, human
gttactcggagggctcttga

SEQ ID NO: 6239 - DNA, 20 bp, human
ggctcctggggcacagaaac

SEQ ID NO: 6240 - DNA, 20 bp, human
gcaccgctgctgtcctgaca

SEQ ID NO: 6241 - DNA, 20 bp, human
gcagaaactggagagcgctg

SEQ ID NO: 6242 - DNA, 20 bp, human
gggatcggtctgatcaggca

SEQ ID NO: 6243 - DNA, 20 bp, human
gcgacagtcttccaggatta

SEQ ID NO: 6244 - DNA, 20 bp, human
gcgaaaggagaatcgctcag

SEQ ID NO: 6245 - DNA, 20 bp, human
ggagggagagatccagcacc

SEQ ID NO: 6246 - DNA, 20 bp, human
ggtcccccgaggccacatag

SEQ ID NO: 6247 - DNA, 20 bp, human
gccgtggcgaaaggcgagag

SEQ ID NO: 6248 - DNA, 20 bp, human
ggtgcaggccccacgcggaa

SEQ ID NO: 6249 - DNA, 20 bp, human
gtaagcaggaaggcccgggt

SEQ ID NO: 6250 - DNA, 20 bp, human
gcagggcgcacaggcctccg

SEQ ID NO: 6251 - DNA, 20 bp, human
gctgggaggtagggctccag

SEQ ID NO: 6252 - DNA, 20 bp, human
gcccgaggccacataggggc

SEQ ID NO: 6253 - DNA, 20 bp, human
gcttggcgggcgctcacagg

SEQ ID NO: 6254 - DNA, 20 bp, human
gcctgcacccggcccctatg

SEQ ID NO: 6255 - DNA, 20 bp, human
gggcccggcccggccctcaa

SEQ ID NO: 6256 - DNA, 20 bp, human
gcctgcaagacgcccccgga

SEQ ID NO: 6257 - DNA, 20 bp, human
ggggctgtagtaggcgtcca

SEQ ID NO: 6258 - DNA, 20 bp, human
gtagtaggcgtccatggcag

SEQ ID NO: 6259 - DNA, 20 bp, human
gtgcgacaccgggctgtagt

SEQ ID NO: 6260 - DNA, 20 bp, human
ggcggaagccaagcaccccg

SEQ ID NO: 6261 - DNA, 20 bp, human
ggtttgaggctgccgtccgg

SEQ ID NO: 6262 - DNA, 20 bp, human
gctcgctgcaagtaaagatg

SEQ ID NO: 6263 - DNA, 20 bp, human
gaacctgcaaggccgcgctg

SEQ ID NO: 6264 - DNA, 20 bp, human
gctcccgactctgcgacacc

SEQ ID NO: 6265 - DNA, 20 bp, human
gccaagagccgggcccgtta

SEQ ID NO: 6266 - DNA, 20 bp, human
gcggcgggcccatccggaac

SEQ ID NO: 6267 - DNA, 20 bp, human
gggaggcggcaggaaccgac

SEQ ID NO: 6268 - DNA, 20 bp, human
gcgggcgcggaatcgggcat

SEQ ID NO: 6269 - DNA, 20 bp, human
gccgggccggcgggtggata

SEQ ID NO: 6270 - DNA, 20 bp, human
gcaccctccggacctccggg

SEQ ID NO: 6271 - DNA, 20 bp, human
ggagcggccgcccggaggtc

SEQ ID NO: 6272 - DNA, 20 bp, human
gccatggcgggcgcggaatc

SEQ ID NO: 6273 - DNA, 20 bp, human
gacgcaccctccggacctcc

SEQ ID NO: 6274 - DNA, 20 bp, human
gggccgcccggaggtccgga

SEQ ID NO: 6275 - DNA, 20 bp, human
gcgaccggcgccctacagca

SEQ ID NO: 6276 - DNA, 20 bp, human
ggaagcgccatggcactgca

SEQ ID NO: 6277 - DNA, 20 bp, human
ggagatgccctgcagtgcca

SEQ ID NO: 6278 - DNA, 20 bp, human
gcggcaacagggcaaaggtg

SEQ ID NO: 6279 - DNA, 20 bp, human
gctgcagggcatctcggtcg

SEQ ID NO: 6280 - DNA, 20 bp, human
gtcactaacaataccctagg

SEQ ID NO: 6281 - DNA, 20 bp, human
ggctgctgggctggggctaa

SEQ ID NO: 6282 - DNA, 20 bp, human
gcacagacgccgcagcacgg

SEQ ID NO: 6283 - DNA, 20 bp, human
gtgatcactaacaataccct

SEQ ID NO: 6284 - DNA, 20 bp, human
gtggaaggctggggccgaca

SEQ ID NO: 6285 - DNA, 20 bp, human
gtctcggtcgtggagctgtc

SEQ ID NO: 6286 - DNA, 20 bp, human
ggacatgcactgtgctctca

SEQ ID NO: 6287 - DNA, 20 bp, human
ggctctgtacttctcattca

SEQ ID NO: 6288 - DNA, 20 bp, human
gtgttaggcatgtcatctct

SEQ ID NO: 6289 - DNA, 20 bp, human
gcatctctgggacatgctaa

SEQ ID NO: 6290 - DNA, 20 bp, human
gcagtgcatgtcagcatcta

SEQ ID NO: 6291 - DNA, 20 bp, human
gttttttcaggactgtgcgt

SEQ ID NO: 6292 - DNA, 20 bp, human
gtcagcatctaaggtaaaat

SEQ ID NO: 6293 - DNA, 20 bp, human
gtatcttggttggcatcatc

SEQ ID NO: 6294 - DNA, 20 bp, human
gttttttttcttagttgaat

SEQ ID NO: 6295 - DNA, 20 bp, human
gcctgacagcttttataaag

SEQ ID NO: 6296 - DNA, 20 bp, human
ggagcctgtgggatatacca

SEQ ID NO: 6297 - DNA, 20 bp, human
ggctcggtctagcaacagaa

SEQ ID NO: 6298 - DNA, 20 bp, human
ggtgggatataccaaggcag

SEQ ID NO: 6299 - DNA, 20 bp, human
ggttgctagaccgagcctgt

SEQ ID NO: 6300 - DNA, 20 bp, human
gagccaagagacccacggaa

SEQ ID NO: 6301 - DNA, 20 bp, human
gtgtcctcgtgggctccaag

SEQ ID NO: 6302 - DNA, 20 bp, human
gccttctgcactgtcctcgt

SEQ ID NO: 6303 - DNA, 20 bp, human
gcaggttcccattaacacaa

SEQ ID NO: 6304 - DNA, 20 bp, human
gagggccccgaggctcctca

SEQ ID NO: 6305 - DNA, 20 bp, human
gcgaggctcctcatggctat

SEQ ID NO: 6306 - DNA, 20 bp, human
ggacaactcagccctcgacc

SEQ ID NO: 6307 - DNA, 20 bp, human
gaccgaccggcaggagaagg

SEQ ID NO: 6308 - DNA, 20 bp, human
ggagacatcaagcaagaaga

SEQ ID NO: 6309 - DNA, 20 bp, human
ggatgtctcctgagcggcgg

SEQ ID NO: 6310 - DNA, 20 bp, human
gcttgatgtctcctgagcgg

SEQ ID NO: 6311 - DNA, 20 bp, human
ggagggagaagccgaaagga

SEQ ID NO: 6312 - DNA, 20 bp, human
gaaccgagggagaagccgaa

SEQ ID NO: 6313 - DNA, 20 bp, human
gggaggagatgttgggtcta

SEQ ID NO: 6314 - DNA, 20 bp, human
gggcggcggcgccgggtcga

SEQ ID NO: 6315 - DNA, 20 bp, human
gtctttagggaggagatgtt

SEQ ID NO: 6316 - DNA, 20 bp, human
gcgctctcgcttacacagta

SEQ ID NO: 6317 - DNA, 20 bp, human
gggatcttcgcactatccca

SEQ ID NO: 6318 - DNA, 20 bp, human
gcagctggaacaatccgcag

SEQ ID NO: 6319 - DNA, 20 bp, human
ggtggctggtgcctcggcgg

SEQ ID NO: 6320 - DNA, 20 bp, human
ggagcgctagctaatgtcgc

SEQ ID NO: 6321 - DNA, 20 bp, human
gagcagcccgacgcaaacca

SEQ ID NO: 6322 - DNA, 20 bp, human
gctcgcttacacagtatggc

SEQ ID NO: 6323 - DNA, 20 bp, human
gcggggcgctcgctgacatc

SEQ ID NO: 6324 - DNA, 20 bp, human
ggtgagtcttttggaaatag

SEQ ID NO: 6325 - DNA, 20 bp, human
gtcgctctactctctctaac

SEQ ID NO: 6326 - DNA, 20 bp, human
gggccaccggcaggactcag

SEQ ID NO: 6327 - DNA, 20 bp, human
gtcagagaggaacaccccat

SEQ ID NO: 6328 - DNA, 20 bp, human
gctccactgagtcctgccgg

SEQ ID NO: 6329 - DNA, 20 bp, human
gccctcggcgcgaggcgaca

SEQ ID NO: 6330 - DNA, 20 bp, human
gcctgccggtggcccgagcc

SEQ ID NO: 6331 - DNA, 20 bp, human
gggacctcaaccccttctga

SEQ ID NO: 6332 - DNA, 20 bp, human
gcccgagcccggtggcctcc

SEQ ID NO: 6333 - DNA, 20 bp, human
ggtcctccactgagtcctgc

SEQ ID NO: 6334 - DNA, 20 bp, human
gctggtggtgggcaagtaag

SEQ ID NO: 6335 - DNA, 20 bp, human
gcctcgcgccgagggtcgcc

SEQ ID NO: 6336 - DNA, 20 bp, human
ggagccgtgtcgggagcgag

SEQ ID NO: 6337 - DNA, 20 bp, human
ggtccccagggaggatctgt

SEQ ID NO: 6338 - DNA, 20 bp, human
gagtcagctgaaggtcacgt

SEQ ID NO: 6339 - DNA, 20 bp, human
ggcgcatcgtgagccgtgtc

SEQ ID NO: 6340 - DNA, 20 bp, human
ggagccgctcgctcccgaca

SEQ ID NO: 6341 - DNA, 20 bp, human
gctcggctggggttcgtcac

SEQ ID NO: 6342 - DNA, 20 bp, human
gatcctccctggggacgcag

SEQ ID NO: 6343 - DNA, 20 bp, human
ggcacccacagatcctccct

SEQ ID NO: 6344 - DNA, 20 bp, human
gacccactgcgtccccaggg

SEQ ID NO: 6345 - DNA, 20 bp, human
gtgggcgcggtctcagctct

SEQ ID NO: 6346 - DNA, 20 bp, human
gatagttggaagaaatctaa

SEQ ID NO: 6347 - DNA, 20 bp, human
gagtttctgtttgaaactca

SEQ ID NO: 6348 - DNA, 20 bp, human
ggtaaaaataatacattcac

SEQ ID NO: 6349 - DNA, 20 bp, human
gtaattccaaaggtctttct

SEQ ID NO: 6350 - DNA, 20 bp, human
gcagagtctaatttaattat

SEQ ID NO: 6351 - DNA, 20 bp, human
gtcaatagttactttttagt

SEQ ID NO: 6352 - DNA, 20 bp, human
gttgcactgaatacattcaa

SEQ ID NO: 6353 - DNA, 20 bp, human
gtgtggccaagaaagacctt

SEQ ID NO: 6354 - DNA, 20 bp, human
gagtgcttgtctaattccaa

SEQ ID NO: 6355 - DNA, 20 bp, human
gagaaaaaacacttcatgga

SEQ ID NO: 6356 - DNA, 20 bp, human
gatagttaaagaaaatctag

SEQ ID NO: 6357 - DNA, 20 bp, human
gactttctttgtgctacaca

SEQ ID NO: 6358 - DNA, 20 bp, human
ggcataaagtattagaaaca

SEQ ID NO: 6359 - DNA, 20 bp, human
gaagaatcagttacttctgt

SEQ ID NO: 6360 - DNA, 20 bp, human
gtgtgctacacagggaggct

SEQ ID NO: 6361 - DNA, 20 bp, human
gtttctctgaatatatttaa

SEQ ID NO: 6362 - DNA, 20 bp, human
gatggttttagtatgaaata

SEQ ID NO: 6363 - DNA, 20 bp, human
ggagataaagttttagatga

SEQ ID NO: 6364 - DNA, 20 bp, human
gagtttaataacacacattt

SEQ ID NO: 6365 - DNA, 20 bp, human
gtttagtttacaagtgagtt

SEQ ID NO: 6366 - DNA, 20 bp, human
ggtggcggcgctctcagccg

SEQ ID NO: 6367 - DNA, 20 bp, human
gtgccgcacagtcccgggaa

SEQ ID NO: 6368 - DNA, 20 bp, human
ggtgccctcctccagtccgt

SEQ ID NO: 6369 - DNA, 20 bp, human
gctggaggtgactggagccg

SEQ ID NO: 6370 - DNA, 20 bp, human
gactaggcgggtcggagtcc

SEQ ID NO: 6371 - DNA, 20 bp, human
ggggagctacccaaagcctg

SEQ ID NO: 6372 - DNA, 20 bp, human
gtagcctgggccaagcctcc

SEQ ID NO: 6373 - DNA, 20 bp, human
ggtgctctgctcctacggac

SEQ ID NO: 6374 - DNA, 20 bp, human
gtccgcaaagcgggttccaa

SEQ ID NO: 6375 - DNA, 20 bp, human
gcgtgctgccgcacagtccc

SEQ ID NO: 6376 - DNA, 20 bp, human
gtgctaaggacagacatgaa

SEQ ID NO: 6377 - DNA, 20 bp, human
gcaagcacaacagctccccg

SEQ ID NO: 6378 - DNA, 20 bp, human
gggagctggcgcgtccgtgg

SEQ ID NO: 6379 - DNA, 20 bp, human
gttcctcctgcagaccccca

SEQ ID NO: 6380 - DNA, 20 bp, human
gtgcagggagtctaggagag

SEQ ID NO: 6381 - DNA, 20 bp, human
gagagaaggaatccgaaggt

SEQ ID NO: 6382 - DNA, 20 bp, human
gagacgagccggagccgcgg

SEQ ID NO: 6383 - DNA, 20 bp, human
ggcacaacagctccccgggg

SEQ ID NO: 6384 - DNA, 20 bp, human
gggcgctcggaaaacggcaa

SEQ ID NO: 6385 - DNA, 20 bp, human
ggggctgtcagcgagcgcgg

SEQ ID NO: 6386 - DNA, 20 bp, human
gagacgactgcacctgaggg

SEQ ID NO: 6387 - DNA, 20 bp, human
gggcgcagccgcaaccgggt

SEQ ID NO: 6388 - DNA, 20 bp, human
gggagcgggcctgcaagaag

SEQ ID NO: 6389 - DNA, 20 bp, human
gctgtgcgctcccggaagag

SEQ ID NO: 6390 - DNA, 20 bp, human
gtctgccgcagtcttgaggg

SEQ ID NO: 6391 - DNA, 20 bp, human
gtccgggagcgcacaggtgt

SEQ ID NO: 6392 - DNA, 20 bp, human
ggaccgcagcactctcggaa

SEQ ID NO: 6393 - DNA, 20 bp, human
ggggagacgactgcacctga

SEQ ID NO: 6394 - DNA, 20 bp, human
gttgcggctgcgcctccctc

SEQ ID NO: 6395 - DNA, 20 bp, human
gctcgtgacgaggctccggg

SEQ ID NO: 6396 - DNA, 20 bp, human
gcagcgacgccagagcccgt

SEQ ID NO: 6397 - DNA, 20 bp, human
gctcgctcacccacacgaag

SEQ ID NO: 6398 - DNA, 20 bp, human
gctccgccagggacccccga

SEQ ID NO: 6399 - DNA, 20 bp, human
gcctcgcgaacggcgcccac

SEQ ID NO: 6400 - DNA, 20 bp, human
gaggccgctgaggcccgtgt

SEQ ID NO: 6401 - DNA, 20 bp, human
gtcagacagcctcttcgtgt

SEQ ID NO: 6402 - DNA, 20 bp, human
gggcgagccggaccagctaa

SEQ ID NO: 6403 - DNA, 20 bp, human
gtctgcggcggcctcgcgaa

SEQ ID NO: 6404 - DNA, 20 bp, human
gcccaggcgctcgccctcgg

SEQ ID NO: 6405 - DNA, 20 bp, human
gaggtactgggccacatcgc

SEQ ID NO: 6406 - DNA, 20 bp, human
gaggctgtttaatgagcggg

SEQ ID NO: 6407 - DNA, 20 bp, human
ggcggacatcagtgcactca

SEQ ID NO: 6408 - DNA, 20 bp, human
gcacacacactgacacagta

SEQ ID NO: 6409 - DNA, 20 bp, human
ggaggagggtcccaagtcag

SEQ ID NO: 6410 - DNA, 20 bp, human
gcccgccaggagacacctgt

SEQ ID NO: 6411 - DNA, 20 bp, human
gacatcagtgcactcagggc

SEQ ID NO: 6412 - DNA, 20 bp, human
gccaaactagacagcgctgg

SEQ ID NO: 6413 - DNA, 20 bp, human
gcccaccagccagctaggag

SEQ ID NO: 6414 - DNA, 20 bp, human
gggggaggctgtttaatgag

SEQ ID NO: 6415 - DNA, 20 bp, human
ggccttttcccactgagaga

SEQ ID NO: 6416 - DNA, 20 bp, human
gagacgcaagctctcaggag

SEQ ID NO: 6417 - DNA, 20 bp, human
ggacatcaaggcaagaatgc

SEQ ID NO: 6418 - DNA, 20 bp, human
gaacctccaggagtgcccag

SEQ ID NO: 6419 - DNA, 20 bp, human
gtgagaggtcatgggagtcc

SEQ ID NO: 6420 - DNA, 20 bp, human
gtctcccaggtgccccaggg

SEQ ID NO: 6421 - DNA, 20 bp, human
gggttgagacgcaagctctc

SEQ ID NO: 6422 - DNA, 20 bp, human
gccaggtgagtccatctgga

SEQ ID NO: 6423 - DNA, 20 bp, human
gatgtccaggtgagtccatc

SEQ ID NO: 6424 - DNA, 20 bp, human
gccaggcacccctgacccca

SEQ ID NO: 6425 - DNA, 20 bp, human
gatagagatcccaagaccat

SEQ ID NO: 6426 - DNA, 20 bp, human
gcaagatgaagagcacccag

SEQ ID NO: 6427 - DNA, 20 bp, human
gcagctccacctaaacccac

SEQ ID NO: 6428 - DNA, 20 bp, human
ggctgcgagcactctaggtt

SEQ ID NO: 6429 - DNA, 20 bp, human
gagactgctgcgagcactct

SEQ ID NO: 6430 - DNA, 20 bp, human
gagtcacccgtgggtttagg

SEQ ID NO: 6431 - DNA, 20 bp, human
ggtttaggtggagctgtgac

SEQ ID NO: 6432 - DNA, 20 bp, human
ggaactcttgatctctgcag

SEQ ID NO: 6433 - DNA, 20 bp, human
gcagcttttaagtcacccgt

SEQ ID NO: 6434 - DNA, 20 bp, human
gttcaaccagccttcaggac

SEQ ID NO: 6435 - DNA, 20 bp, human
gagaagtgtgccagtcctga

SEQ ID NO: 6436 - DNA, 20 bp, human
gagctgagggaaggtcaaca

SEQ ID NO: 6437 - DNA, 20 bp, human
gggaggcgcagcgatcccag

SEQ ID NO: 6438 - DNA, 20 bp, human
gggagtcacagggatggcac

SEQ ID NO: 6439 - DNA, 20 bp, human
gggcgcagcgatcccagcgg

SEQ ID NO: 6440 - DNA, 20 bp, human
gggcctggcgcggatcggtg

SEQ ID NO: 6441 - DNA, 20 bp, human
gctgctgggagtcacaggga

SEQ ID NO: 6442 - DNA, 20 bp, human
gagcggagggagcggcgtgg

SEQ ID NO: 6443 - DNA, 20 bp, human
gccgcaggcctggcgcggat

SEQ ID NO: 6444 - DNA, 20 bp, human
gcgccggagcccaccgaccg

SEQ ID NO: 6445 - DNA, 20 bp, human
gcggtctgggagctccgtcg

SEQ ID NO: 6446 - DNA, 20 bp, human
gggacgcgcagaccttcgga

SEQ ID NO: 6447 - DNA, 20 bp, human
gcaggaggcaggacgcgcag

SEQ ID NO: 6448 - DNA, 20 bp, human
gggtgcaagagtgacagaca

SEQ ID NO: 6449 - DNA, 20 bp, human
gccttcggaaggcactgcgt

SEQ ID NO: 6450 - DNA, 20 bp, human
gcgccgggagccggagggaa

SEQ ID NO: 6451 - DNA, 20 bp, human
gagcctcgtgggctccgggg

SEQ ID NO: 6452 - DNA, 20 bp, human
gcgggaggctgcaggacccg

SEQ ID NO: 6453 - DNA, 20 bp, human
gccgcccgccgggagccgga

SEQ ID NO: 6454 - DNA, 20 bp, human
gagacggacgcgcagacctt

SEQ ID NO: 6455 - DNA, 20 bp, human
gactgcgtaggcagcctccc

SEQ ID NO: 6456 - DNA, 20 bp, human
ggggccagcagccgtctacc

SEQ ID NO: 6457 - DNA, 20 bp, human
gcgccctgacgccggatcca

SEQ ID NO: 6458 - DNA, 20 bp, human
ggggctcagtcagaaggtac

SEQ ID NO: 6459 - DNA, 20 bp, human
gagggatggccagcgactag

SEQ ID NO: 6460 - DNA, 20 bp, human
ggaacgcgacaccgggtaga

SEQ ID NO: 6461 - DNA, 20 bp, human
gcaacacagaacgcgacacc

SEQ ID NO: 6462 - DNA, 20 bp, human
gggccctggatccggcgtca

SEQ ID NO: 6463 - DNA, 20 bp, human
gatccggcgtcagggcgacc

SEQ ID NO: 6464 - DNA, 20 bp, human
gcccgaactcaggccggacc

SEQ ID NO: 6465 - DNA, 20 bp, human
ggatctggcgggactaggga

SEQ ID NO: 6466 - DNA, 20 bp, human
ggccgacggcccctactctc

SEQ ID NO: 6467 - DNA, 20 bp, human
ggagggctagcgaagccgaa

SEQ ID NO: 6468 - DNA, 20 bp, human
gcccaggttgtgaggcggtg

SEQ ID NO: 6469 - DNA, 20 bp, human
gacctgggaaccggagagta

SEQ ID NO: 6470 - DNA, 20 bp, human
gtagcggcaggtaactcggc

SEQ ID NO: 6471 - DNA, 20 bp, human
ggtcatggcggcgaccacca

SEQ ID NO: 6472 - DNA, 20 bp, human
gctccggttcccaggttgtg

SEQ ID NO: 6473 - DNA, 20 bp, human
ggcagtagcggcaggtaact

SEQ ID NO: 6474 - DNA, 20 bp, human
gcagggcgcgcagctggaag

SEQ ID NO: 6475 - DNA, 20 bp, human
gagcagcaccaaccaggtca

SEQ ID NO: 6476 - DNA, 20 bp, human
gggtcggaaacgctgcgtgg

SEQ ID NO: 6477 - DNA, 20 bp, human
ggtctaaccggaggaggtag

SEQ ID NO: 6478 - DNA, 20 bp, human
gcgccacccgagccagaggg

SEQ ID NO: 6479 - DNA, 20 bp, human
ggagggcacggtactcacta

SEQ ID NO: 6480 - DNA, 20 bp, human
gccgggctcccggaagatgg

SEQ ID NO: 6481 - DNA, 20 bp, human
ggagcccggcgatgaggacg

SEQ ID NO: 6482 - DNA, 20 bp, human
gggctgggaggtctaaccgg

SEQ ID NO: 6483 - DNA, 20 bp, human
ggacgaggcggcggacgatg

SEQ ID NO: 6484 - DNA, 20 bp, human
ggccagctcgcctcacttat

SEQ ID NO: 6485 - DNA, 20 bp, human
ggcggccggggtagaaagta

SEQ ID NO: 6486 - DNA, 20 bp, human
gagcgggggggaggagtccc

SEQ ID NO: 6487 - DNA, 20 bp, human
ggaaggaggccggcgggcgg

SEQ ID NO: 6488 - DNA, 20 bp, human
ggctcgctcgctgtaaagtt

SEQ ID NO: 6489 - DNA, 20 bp, human
gcgctcgctgtaaagtttgg

SEQ ID NO: 6490 - DNA, 20 bp, human
gcggacgcgctgcgcggacg

SEQ ID NO: 6491 - DNA, 20 bp, human
gggcgagggtccgggggcag

SEQ ID NO: 6492 - DNA, 20 bp, human
gccgcaggccagcttctctc

SEQ ID NO: 6493 - DNA, 20 bp, human
gtgcagacaaggaccaggag

SEQ ID NO: 6494 - DNA, 20 bp, human
ggagaagctggcctgcgggc

SEQ ID NO: 6495 - DNA, 20 bp, human
gcctggagggagtgcagaca

SEQ ID NO: 6496 - DNA, 20 bp, human
gcaaggagccgaggcgagat

SEQ ID NO: 6497 - DNA, 20 bp, human
gctgcagccacagcaggacc

SEQ ID NO: 6498 - DNA, 20 bp, human
gcggtgagccgggaccacac

SEQ ID NO: 6499 - DNA, 20 bp, human
gcgcactcgccagacgaggg

SEQ ID NO: 6500 - DNA, 20 bp, human
gcctgggccgggtcctgctg

SEQ ID NO: 6501 - DNA, 20 bp, human
gctggtgtgaaggcggagga

SEQ ID NO: 6502 - DNA, 20 bp, human
gcaggacgcccatctcgcct

SEQ ID NO: 6503 - DNA, 20 bp, human
gtcagcttcccggtccccaa

SEQ ID NO: 6504 - DNA, 20 bp, human
gcggcctggtgtgaaggcgg

SEQ ID NO: 6505 - DNA, 20 bp, human
gtggggcaaagtctcctggt

SEQ ID NO: 6506 - DNA, 20 bp, human
gccccaccggagccagcccg

SEQ ID NO: 6507 - DNA, 20 bp, human
gcgcggaaggaggcactagg

SEQ ID NO: 6508 - DNA, 20 bp, human
gcaacgtgtgcagaccagga

SEQ ID NO: 6509 - DNA, 20 bp, human
ggaggtcgtgctcagacgcg

SEQ ID NO: 6510 - DNA, 20 bp, human
ggggccgggtgagcactgag

SEQ ID NO: 6511 - DNA, 20 bp, human
gacgttgggtctgagcactc

SEQ ID NO: 6512 - DNA, 20 bp, human
ggcggaagtgtcccgaagcg

SEQ ID NO: 6513 - DNA, 20 bp, human
ggccagggccgagccccacg

SEQ ID NO: 6514 - DNA, 20 bp, human
gtcagacgcgtggcgtggcg

SEQ ID NO: 6515 - DNA, 20 bp, human
gtcctcgggctggctccggt

SEQ ID NO: 6516 - DNA, 20 bp, human
ggagctgactgacccgccgt

SEQ ID NO: 6517 - DNA, 20 bp, human
gtgcagcgatgcctcgccca

SEQ ID NO: 6518 - DNA, 20 bp, human
gagggtagactcacagatcc

SEQ ID NO: 6519 - DNA, 20 bp, human
gagcgatgcctcgcccacgg

SEQ ID NO: 6520 - DNA, 20 bp, human
gggccctgggaccgcggaag

SEQ ID NO: 6521 - DNA, 20 bp, human
gacgacagatcaggaaccca

SEQ ID NO: 6522 - DNA, 20 bp, human
ggcgcagcggagtgttggag

SEQ ID NO: 6523 - DNA, 20 bp, human
gacacgcggggcctcttcag

SEQ ID NO: 6524 - DNA, 20 bp, human
ggagctgtcaaggctgacgg

SEQ ID NO: 6525 - DNA, 20 bp, human
gggttaagaccacggatccc

SEQ ID NO: 6526 - DNA, 20 bp, human
gcagctcctgggcaaaggat

SEQ ID NO: 6527 - DNA, 20 bp, human
gaaagctcctcggaaggaag

SEQ ID NO: 6528 - DNA, 20 bp, human
gggaaggggcgtgactgcca

SEQ ID NO: 6529 - DNA, 20 bp, human
gcggaggcgagactgactgg

SEQ ID NO: 6530 - DNA, 20 bp, human
gtgactgccaaggcagctcc

SEQ ID NO: 6531 - DNA, 20 bp, human
ggtaggggagggggacgaac

SEQ ID NO: 6532 - DNA, 20 bp, human
gagcggacaggcaggatacc

SEQ ID NO: 6533 - DNA, 20 bp, human
gcggagagaactaagagaag

SEQ ID NO: 6534 - DNA, 20 bp, human
gcctgaaggcaaagaagaca

SEQ ID NO: 6535 - DNA, 20 bp, human
gtacttttcgcggggaactg

SEQ ID NO: 6536 - DNA, 20 bp, human
ggtggagggcaaagttgcgc

SEQ ID NO: 6537 - DNA, 20 bp, human
gcatgatcgcctcatgtgga

SEQ ID NO: 6538 - DNA, 20 bp, human
gggacccagcagcggttgtc

SEQ ID NO: 6539 - DNA, 20 bp, human
gggagcgcgcgagaagctct

SEQ ID NO: 6540 - DNA, 20 bp, human
gtggctgcgcccctcaggaa

SEQ ID NO: 6541 - DNA, 20 bp, human
gggtgaagccctgtgtgaat

SEQ ID NO: 6542 - DNA, 20 bp, human
ggtcaacgtgggtcgcgggg

SEQ ID NO: 6543 - DNA, 20 bp, human
gtcgggcgcgcagcaccccg

SEQ ID NO: 6544 - DNA, 20 bp, human
gcatatggccagacactccg

SEQ ID NO: 6545 - DNA, 20 bp, human
gctcccggcacctcgagtgg

SEQ ID NO: 6546 - DNA, 20 bp, human
ggcgcgaacagccagagcgt

SEQ ID NO: 6547 - DNA, 20 bp, human
gctgcaacttgagctccaag

SEQ ID NO: 6548 - DNA, 20 bp, human
gagtcagacaccacaacctc

SEQ ID NO: 6549 - DNA, 20 bp, human
gcactgcggctgcctcgaaa

SEQ ID NO: 6550 - DNA, 20 bp, human
gcctgcaacccgaaacactg

SEQ ID NO: 6551 - DNA, 20 bp, human
gagccagagcgtcggcgcca

SEQ ID NO: 6552 - DNA, 20 bp, human
gggccgtggcgccgacgctc

SEQ ID NO: 6553 - DNA, 20 bp, human
gtccgggagtcggagcctcg

SEQ ID NO: 6554 - DNA, 20 bp, human
gtgggccgagccggaggttg

SEQ ID NO: 6555 - DNA, 20 bp, human
ggaagatgtgttctcggccg

SEQ ID NO: 6556 - DNA, 20 bp, human
gtacctgggagtttgaacag

SEQ ID NO: 6557 - DNA, 20 bp, human
gtgctgccatagctctgaga

SEQ ID NO: 6558 - DNA, 20 bp, human
gatgactctagctatggtat

SEQ ID NO: 6559 - DNA, 20 bp, human
gtacataatgactctagcta

SEQ ID NO: 6560 - DNA, 20 bp, human
gtgctgaaatccttgattct

SEQ ID NO: 6561 - DNA, 20 bp, human
gggtaggtgtacaaagtgtt

SEQ ID NO: 6562 - DNA, 20 bp, human
gtgcctctgttcaaactccc

SEQ ID NO: 6563 - DNA, 20 bp, human
gaaccatcagaatacacaca

SEQ ID NO: 6564 - DNA, 20 bp, human
gtgaatgatcaaagctgata

SEQ ID NO: 6565 - DNA, 20 bp, human
gaagctgatatggtagctaa

SEQ ID NO: 6566 - DNA, 20 bp, human
gactcccgcggccggactgt

SEQ ID NO: 6567 - DNA, 20 bp, human
ggccagagtgacaagagggt

SEQ ID NO: 6568 - DNA, 20 bp, human
ggagccggcgagattttggt

SEQ ID NO: 6569 - DNA, 20 bp, human
ggcgtgactcccccacagtc

SEQ ID NO: 6570 - DNA, 20 bp, human
gagcacagcagcaggaccta

SEQ ID NO: 6571 - DNA, 20 bp, human
gggtggactcccgcagacct

SEQ ID NO: 6572 - DNA, 20 bp, human
gtgctgtacagacttctcgt

SEQ ID NO: 6573 - DNA, 20 bp, human
gctgccctggcactgagatg

SEQ ID NO: 6574 - DNA, 20 bp, human
gcactgagatggggaaagta

SEQ ID NO: 6575 - DNA, 20 bp, human
ggaccccaccaaaatctcgc

SEQ ID NO: 6576 - DNA, 20 bp, human
ggccatggctgggaccacgg

SEQ ID NO: 6577 - DNA, 20 bp, human
ggccgccgtggtcccagcca

SEQ ID NO: 6578 - DNA, 20 bp, human
gttgccagagccagatggat

SEQ ID NO: 6579 - DNA, 20 bp, human
gccagatggataggatgcca

SEQ ID NO: 6580 - DNA, 20 bp, human
ggtcctctgtcacaaggagt

SEQ ID NO: 6581 - DNA, 20 bp, human
ggtctgagcggcaccggctg

SEQ ID NO: 6582 - DNA, 20 bp, human
gtggataggatgccatggct

SEQ ID NO: 6583 - DNA, 20 bp, human
gcagcaccttgggcgagagg

SEQ ID NO: 6584 - DNA, 20 bp, human
ggcacaggcgccagtcagag

SEQ ID NO: 6585 - DNA, 20 bp, human
ggggggagtctgagcggcac

SEQ ID NO: 6586 - DNA, 20 bp, human
gaggaactgcctcagcacag

SEQ ID NO: 6587 - DNA, 20 bp, human
ggccttcccactctcctaaa

SEQ ID NO: 6588 - DNA, 20 bp, human
gcctaaagcagccctcccaa

SEQ ID NO: 6589 - DNA, 20 bp, human
gagtgagcggctgtaagcag

SEQ ID NO: 6590 - DNA, 20 bp, human
gcggagctggaggcccacgt

SEQ ID NO: 6591 - DNA, 20 bp, human
gtataacgaggggatttcag

SEQ ID NO: 6592 - DNA, 20 bp, human
gtgattaaaatggcatcaca

SEQ ID NO: 6593 - DNA, 20 bp, human
gcaagcagggttgattaaaa

SEQ ID NO: 6594 - DNA, 20 bp, human
gtcacaagaggaaactaaag

SEQ ID NO: 6595 - DNA, 20 bp, human
gacagaggcggacagaggac

SEQ ID NO: 6596 - DNA, 20 bp, human
gccaggagagcggcaacccg

SEQ ID NO: 6597 - DNA, 20 bp, human
gccatggccgacatcaagac

SEQ ID NO: 6598 - DNA, 20 bp, human
gctccggagctggacatatc

SEQ ID NO: 6599 - DNA, 20 bp, human
gggagagggccgagcaaggg

SEQ ID NO: 6600 - DNA, 20 bp, human
gcgaagagcagagcgcgcag

SEQ ID NO: 6601 - DNA, 20 bp, human
ggacatatccggcgtctccg

SEQ ID NO: 6602 - DNA, 20 bp, human
gcgccggatatgtccagctc

SEQ ID NO: 6603 - DNA, 20 bp, human
ggccggggacccgcagaccc

SEQ ID NO: 6604 - DNA, 20 bp, human
gaagatgcccgtcttgatgt

SEQ ID NO: 6605 - DNA, 20 bp, human
ggccagggtctgcgggtccc

SEQ ID NO: 6606 - DNA, 20 bp, human
gtaagtgtggtggcccgtct

SEQ ID NO: 6607 - DNA, 20 bp, human
gtgcaggcgaaagcccagac

SEQ ID NO: 6608 - DNA, 20 bp, human
gtggacgacacaaggccggg

SEQ ID NO: 6609 - DNA, 20 bp, human
gcagagggctgtaagtgtgg

SEQ ID NO: 6610 - DNA, 20 bp, human
gatgcagagggctgtaagtg

SEQ ID NO: 6611 - DNA, 20 bp, human
ggaagagctagaggtcatgg

SEQ ID NO: 6612 - DNA, 20 bp, human
gtggaccactgtaaacaggg

SEQ ID NO: 6613 - DNA, 20 bp, human
ggagtggaccactgtaaaca

SEQ ID NO: 6614 - DNA, 20 bp, human
ggcccacggcgggaaaatgg

SEQ ID NO: 6615 - DNA, 20 bp, human
gccaggtggaagtcatagag

SEQ ID NO: 6616 - DNA, 20 bp, human
gtgacaagctaataagctgt

SEQ ID NO: 6617 - DNA, 20 bp, human
gtgttacctttgggtccacg

SEQ ID NO: 6618 - DNA, 20 bp, human
gtggtttctcaagtttactc

SEQ ID NO: 6619 - DNA, 20 bp, human
gggtagcaatctgaaacatg

SEQ ID NO: 6620 - DNA, 20 bp, human
gttttgcctcgtggacccaa

SEQ ID NO: 6621 - DNA, 20 bp, human
ggagcaataggctagaaatt

SEQ ID NO: 6622 - DNA, 20 bp, human
ggcaaaatgtacaatactca

SEQ ID NO: 6623 - DNA, 20 bp, human
gagatgctgttgaaactggc

SEQ ID NO: 6624 - DNA, 20 bp, human
ggtaaacttgagaaaccaac

SEQ ID NO: 6625 - DNA, 20 bp, human
gaccttttaccacgatggag

SEQ ID NO: 6626 - DNA, 20 bp, human
gtactaaacactgacatcaa

SEQ ID NO: 6627 - DNA, 20 bp, human
gggtatgtacagataccaag

SEQ ID NO: 6628 - DNA, 20 bp, human
gtttatctagaggctgggaa

SEQ ID NO: 6629 - DNA, 20 bp, human
gtgtcagtgtttagtacacg

SEQ ID NO: 6630 - DNA, 20 bp, human
ggcagtctctgatccgtgca

SEQ ID NO: 6631 - DNA, 20 bp, human
gtgttctgagatttatctag

SEQ ID NO: 6632 - DNA, 20 bp, human
gtgagatttatctagaggct

SEQ ID NO: 6633 - DNA, 20 bp, human
gtgcttgtggaagacaagtc

SEQ ID NO: 6634 - DNA, 20 bp, human
gccgtcttgtcggtctgtca

SEQ ID NO: 6635 - DNA, 20 bp, human
gacgtggcttggtcacttca

SEQ ID NO: 6636 - DNA, 20 bp, human
gccaaccctgacagactgac

SEQ ID NO: 6637 - DNA, 20 bp, human
gtctctttaaagatccagaa

SEQ ID NO: 6638 - DNA, 20 bp, human
gtaatgtttttcttaggttc

SEQ ID NO: 6639 - DNA, 20 bp, human
gagcaacaggtcactgttta

SEQ ID NO: 6640 - DNA, 20 bp, human
ggtttttttgtatgccattc

SEQ ID NO: 6641 - DNA, 20 bp, human
gctgacaggacagaaacaag

SEQ ID NO: 6642 - DNA, 20 bp, human
gttgatgttctttacctgtt

SEQ ID NO: 6643 - DNA, 20 bp, human
gttacttaccttgagttgga

SEQ ID NO: 6644 - DNA, 20 bp, human
gagatattaatgtttttctt

SEQ ID NO: 6645 - DNA, 20 bp, human
gaaaaacattaatatctaaa

SEQ ID NO: 6646 - DNA, 20 bp, human
ggtagtaagaagaggtggca

SEQ ID NO: 6647 - DNA, 20 bp, human
gatagtgtagtaagaagagg

SEQ ID NO: 6648 - DNA, 20 bp, human
ggatcaacctgttgtaatac

SEQ ID NO: 6649 - DNA, 20 bp, human
gtgaactccagtattacaac

SEQ ID NO: 6650 - DNA, 20 bp, human
gagtggtttgcttaggaaac

SEQ ID NO: 6651 - DNA, 20 bp, human
gtgattgagagaagttaatg

SEQ ID NO: 6652 - DNA, 20 bp, human
gttgtaaaacactcaactgt

SEQ ID NO: 6653 - DNA, 20 bp, human
gtgaaaatgtgtcttagcct

SEQ ID NO: 6654 - DNA, 20 bp, human
gctttttgtcttgaaataag

SEQ ID NO: 6655 - DNA, 20 bp, human
gtccaaatcagatttgtaca

SEQ ID NO: 6656 - DNA, 20 bp, human
ggagccccgggcagcagcgt

SEQ ID NO: 6657 - DNA, 20 bp, human
gtcccgatgggagcaaactg

SEQ ID NO: 6658 - DNA, 20 bp, human
ggggacgggtcgggaatcca

SEQ ID NO: 6659 - DNA, 20 bp, human
gggcctgggccgggaggatc

SEQ ID NO: 6660 - DNA, 20 bp, human
gcgtccccggggaacctcca

SEQ ID NO: 6661 - DNA, 20 bp, human
gcggcctctgccggctccgg

SEQ ID NO: 6662 - DNA, 20 bp, human
ggacctgcgcgcttcccgat

SEQ ID NO: 6663 - DNA, 20 bp, human
ggcgggactgcgaggtaggg

SEQ ID NO: 6664 - DNA, 20 bp, human
gagcaaactggggacgggtc

SEQ ID NO: 6665 - DNA, 20 bp, human
ggcgccctggaggttccccg

SEQ ID NO: 6666 - DNA, 20 bp, human
gcgtgagggctgccgcgggt

SEQ ID NO: 6667 - DNA, 20 bp, human
gacatcacgggcaaacggga

SEQ ID NO: 6668 - DNA, 20 bp, human
gtataggcaaccagccaggg

SEQ ID NO: 6669 - DNA, 20 bp, human
gggtggtatcgaggcctgtc

SEQ ID NO: 6670 - DNA, 20 bp, human
gcggtgcctctagggagcca

SEQ ID NO: 6671 - DNA, 20 bp, human
gatgcgcgtgagggctgccg

SEQ ID NO: 6672 - DNA, 20 bp, human
gacccggctaccctgcctag

SEQ ID NO: 6673 - DNA, 20 bp, human
gccgcgggtgggtggtatcg

SEQ ID NO: 6674 - DNA, 20 bp, human
gtatcgaggcctgtcgggtc

SEQ ID NO: 6675 - DNA, 20 bp, human
gtggcgtggcgcagtgcgaa

SEQ ID NO: 6676 - DNA, 20 bp, human
gcagcgggctcgagtgctaa

SEQ ID NO: 6677 - DNA, 20 bp, human
ggaagaacgggcaacagcag

SEQ ID NO: 6678 - DNA, 20 bp, human
gtcgagtgctaatggcagga

SEQ ID NO: 6679 - DNA, 20 bp, human
ggggctcgagtgctaatggc

SEQ ID NO: 6680 - DNA, 20 bp, human
gccccggcgcgaggcaagac

SEQ ID NO: 6681 - DNA, 20 bp, human
gccagacctacggccaccag

SEQ ID NO: 6682 - DNA, 20 bp, human
gcggggtactgggaacccga

SEQ ID NO: 6683 - DNA, 20 bp, human
gcaagacgggaaagtcaaga

SEQ ID NO: 6684 - DNA, 20 bp, human
ggtactgggaacccgaggga

SEQ ID NO: 6685 - DNA, 20 bp, human
gcttcctccagaatagggga

SEQ ID NO: 6686 - DNA, 20 bp, human
gcgttggcgaagccagctgc

SEQ ID NO: 6687 - DNA, 20 bp, human
gtggcgaagccagctgctgg

SEQ ID NO: 6688 - DNA, 20 bp, human
gcgccaacggcgttgaacaa

SEQ ID NO: 6689 - DNA, 20 bp, human
gtggcgtccagtcccaagtc

SEQ ID NO: 6690 - DNA, 20 bp, human
ggcgcaacagtaagccgtgt

SEQ ID NO: 6691 - DNA, 20 bp, human
gttcggcaagcagccaggtc

SEQ ID NO: 6692 - DNA, 20 bp, human
gctaggaccacgctcgacgt

SEQ ID NO: 6693 - DNA, 20 bp, human
gtaacgctggaggtgtcagt

SEQ ID NO: 6694 - DNA, 20 bp, human
ggacccttgttcaacgccgt

SEQ ID NO: 6695 - DNA, 20 bp, human
gacagagtctggtgccgaca

SEQ ID NO: 6696 - DNA, 20 bp, human
ggactcggcgggcgctgttg

SEQ ID NO: 6697 - DNA, 20 bp, human
ggcccttccgttggcagcgc

SEQ ID NO: 6698 - DNA, 20 bp, human
ggccctacccgcccttccgt

SEQ ID NO: 6699 - DNA, 20 bp, human
ggccggcgctgccaacggaa

SEQ ID NO: 6700 - DNA, 20 bp, human
gtgacagtgcagacttgggg

SEQ ID NO: 6701 - DNA, 20 bp, human
gactggcgtgcgagactcgg

SEQ ID NO: 6702 - DNA, 20 bp, human
ggccaacggaagggcgggta

SEQ ID NO: 6703 - DNA, 20 bp, human
ggggcgctgttgagggagtc

SEQ ID NO: 6704 - DNA, 20 bp, human
gcgcactggcgtgcgagact

SEQ ID NO: 6705 - DNA, 20 bp, human
gcgctccgcccgatcggcca

SEQ ID NO: 6706 - DNA, 20 bp, human
ggggcgctggaaacccttac

SEQ ID NO: 6707 - DNA, 20 bp, human
gcggtggccgggtgccggta

SEQ ID NO: 6708 - DNA, 20 bp, human
ggagcaagcgtctgccgcgg

SEQ ID NO: 6709 - DNA, 20 bp, human
gcctccaaaacctaggccgg

SEQ ID NO: 6710 - DNA, 20 bp, human
gacaggccgtccctcagctg

SEQ ID NO: 6711 - DNA, 20 bp, human
gtgagggacggcctgtcgta

SEQ ID NO: 6712 - DNA, 20 bp, human
gcagagcatggcaccaactg

SEQ ID NO: 6713 - DNA, 20 bp, human
gtcccgcgcctccaaaacct

SEQ ID NO: 6714 - DNA, 20 bp, human
gaggcaggatgtaccaaacg

SEQ ID NO: 6715 - DNA, 20 bp, human
gctcggccgatgggaatagg

SEQ ID NO: 6716 - DNA, 20 bp, human
ggcggtggctttgcgacggt

SEQ ID NO: 6717 - DNA, 20 bp, human
gactgacagaccagcgatct

SEQ ID NO: 6718 - DNA, 20 bp, human
ggctgctgccggcggcgacc

SEQ ID NO: 6719 - DNA, 20 bp, human
gctgtacttaccgcgccggg

SEQ ID NO: 6720 - DNA, 20 bp, human
gagcgcttccgggtcgccgc

SEQ ID NO: 6721 - DNA, 20 bp, human
gatcgtaatgagcaaagaaa

SEQ ID NO: 6722 - DNA, 20 bp, human
ggaggaagcggccaatgagc

SEQ ID NO: 6723 - DNA, 20 bp, human
gtgacggaccttgtgtgacg

SEQ ID NO: 6724 - DNA, 20 bp, human
gtgggttcttccgctcaggc

SEQ ID NO: 6725 - DNA, 20 bp, human
gcggcagcagcctcccggcg

SEQ ID NO: 6726 - DNA, 20 bp, human
gctcaccacgacgaggaccg

SEQ ID NO: 6727 - DNA, 20 bp, human
ggtgttcgccccccaacaga

SEQ ID NO: 6728 - DNA, 20 bp, human
gggctgcgctcaccacgacg

SEQ ID NO: 6729 - DNA, 20 bp, human
ggtggtgagcgcagccactc

SEQ ID NO: 6730 - DNA, 20 bp, human
gctagaaaaatggagaaggt

SEQ ID NO: 6731 - DNA, 20 bp, human
gccactcaggctggtcctgg

SEQ ID NO: 6732 - DNA, 20 bp, human
ggctggctccgtctgttggg

SEQ ID NO: 6733 - DNA, 20 bp, human
gcctcggcctcttacctcag

SEQ ID NO: 6734 - DNA, 20 bp, human
gatgccgcagctgtaacggg

SEQ ID NO: 6735 - DNA, 20 bp, human
gttctgagcgctcccctctc

SEQ ID NO: 6736 - DNA, 20 bp, human
gacagagccgtatgaacccg

SEQ ID NO: 6737 - DNA, 20 bp, human
gcgtatgaacccgagggtag

SEQ ID NO: 6738 - DNA, 20 bp, human
gagcgaatctcggagtcggt

SEQ ID NO: 6739 - DNA, 20 bp, human
ggccgagcgaatctcggagt

SEQ ID NO: 6740 - DNA, 20 bp, human
gcgaggggaacacaacatag

SEQ ID NO: 6741 - DNA, 20 bp, human
gtggggtgcagaaaaccgtg

SEQ ID NO: 6742 - DNA, 20 bp, human
gcggtgggtgcagatggcgg

SEQ ID NO: 6743 - DNA, 20 bp, human
gctggtccgggaagacacct

SEQ ID NO: 6744 - DNA, 20 bp, human
gcggagtcggtgggtgcaga

SEQ ID NO: 6745 - DNA, 20 bp, human
ggggaacacaacatagaggt

SEQ ID NO: 6746 - DNA, 20 bp, human
ggccgtgttagtctgccggt

SEQ ID NO: 6747 - DNA, 20 bp, human
gtggggactcttgcaggtac

SEQ ID NO: 6748 - DNA, 20 bp, human
gccccaccggcagactaaca

SEQ ID NO: 6749 - DNA, 20 bp, human
gcagactaacacggccccag

SEQ ID NO: 6750 - DNA, 20 bp, human
ggggaggggagaggccactg

SEQ ID NO: 6751 - DNA, 20 bp, human
gtgcctggagcgcgcgacag

SEQ ID NO: 6752 - DNA, 20 bp, human
ggcctgtggcccgaatgaac

SEQ ID NO: 6753 - DNA, 20 bp, human
ggccagccatgtctgcagaa

SEQ ID NO: 6754 - DNA, 20 bp, human
gggcccgaatgaacaggctc

SEQ ID NO: 6755 - DNA, 20 bp, human
gtgctgggtctgctcccggg

SEQ ID NO: 6756 - DNA, 20 bp, human
ggccttgtggtgacaactgg

SEQ ID NO: 6757 - DNA, 20 bp, human
gagatgagccgcacaggcga

SEQ ID NO: 6758 - DNA, 20 bp, human
ggccgccagttgtcaccaca

SEQ ID NO: 6759 - DNA, 20 bp, human
gattgaagtagaggctctcg

SEQ ID NO: 6760 - DNA, 20 bp, human
gcggcccgagactaagtctc

SEQ ID NO: 6761 - DNA, 20 bp, human
ggcgggcggagatgtagacc

SEQ ID NO: 6762 - DNA, 20 bp, human
gcacaaggcacaacactacc

SEQ ID NO: 6763 - DNA, 20 bp, human
gagactaagtctcgggcccg

SEQ ID NO: 6764 - DNA, 20 bp, human
gtgtgccttgtggtgacaac

SEQ ID NO: 6765 - DNA, 20 bp, human
gcgcctctcacctgcagcag

SEQ ID NO: 6766 - DNA, 20 bp, human
gggtccatcgggtccacacg

SEQ ID NO: 6767 - DNA, 20 bp, human
gggcggcggtctgggagcgg

SEQ ID NO: 6768 - DNA, 20 bp, human
gggcggcttggagacataga

SEQ ID NO: 6769 - DNA, 20 bp, human
ggaggctctgaggacgaccc

SEQ ID NO: 6770 - DNA, 20 bp, human
gttggagacatagaaggcag

SEQ ID NO: 6771 - DNA, 20 bp, human
gcccaggcgagggtttcctg

SEQ ID NO: 6772 - DNA, 20 bp, human
gtgactcgaaaagccggtag

SEQ ID NO: 6773 - DNA, 20 bp, human
gctgaggacgacccaggcga

SEQ ID NO: 6774 - DNA, 20 bp, human
gtcctgctctgcaaagccgc

SEQ ID NO: 6775 - DNA, 20 bp, human
ggctacccgcctcaactcac

SEQ ID NO: 6776 - DNA, 20 bp, human
gtgtacacggacggagatgg

SEQ ID NO: 6777 - DNA, 20 bp, human
gtatgaagctaccagagagg

SEQ ID NO: 6778 - DNA, 20 bp, human
ggcctcctagggcttccctt

SEQ ID NO: 6779 - DNA, 20 bp, human
gcgaacctaagggaagccct

SEQ ID NO: 6780 - DNA, 20 bp, human
gacagaatcgccgaacctaa

SEQ ID NO: 6781 - DNA, 20 bp, human
ggctccccatcatcgtacta

SEQ ID NO: 6782 - DNA, 20 bp, human
gcgtactagggaggaagaag

SEQ ID NO: 6783 - DNA, 20 bp, human
gttgattagtaggcttggag

SEQ ID NO: 6784 - DNA, 20 bp, human
gcctccctagtacgatgatg

SEQ ID NO: 6785 - DNA, 20 bp, human
gtcctgctttgcatctaggt

SEQ ID NO: 6786 - DNA, 20 bp, human
ggtggagaggagctgtggac

SEQ ID NO: 6787 - DNA, 20 bp, human
ggcagtgccgaggtgtaggg

SEQ ID NO: 6788 - DNA, 20 bp, human
ggtcggccaagtcagcaccc

SEQ ID NO: 6789 - DNA, 20 bp, human
gggccaagtcagcaccccgg

SEQ ID NO: 6790 - DNA, 20 bp, human
gcgtccggccgcggttaagg

SEQ ID NO: 6791 - DNA, 20 bp, human
gcgcctggccggtacctgag

SEQ ID NO: 6792 - DNA, 20 bp, human
gggggtgcagagaaattgtg

SEQ ID NO: 6793 - DNA, 20 bp, human
gagcacgacgcgatcatggc

SEQ ID NO: 6794 - DNA, 20 bp, human
gacagacaggagcccggcca

SEQ ID NO: 6795 - DNA, 20 bp, human
gacctgagagggcgcggaag

SEQ ID NO: 6796 - DNA, 20 bp, human
gtatcccgcttggtctctgg

SEQ ID NO: 6797 - DNA, 20 bp, human
gcttagggtgaagctaatgt

SEQ ID NO: 6798 - DNA, 20 bp, human
gtgtggcacacgcccaggag

SEQ ID NO: 6799 - DNA, 20 bp, human
gtctgggcgatggtgcatcc

SEQ ID NO: 6800 - DNA, 20 bp, human
gcgacggcctaaagtatcta

SEQ ID NO: 6801 - DNA, 20 bp, human
ggccgagacctactgcggag

SEQ ID NO: 6802 - DNA, 20 bp, human
ggccagggatccaaagccac

SEQ ID NO: 6803 - DNA, 20 bp, human
gggcccgccgagacctactg

SEQ ID NO: 6804 - DNA, 20 bp, human
ggtcttggcgcggagttcat

SEQ ID NO: 6805 - DNA, 20 bp, human
gccaagaccccagacctcgt

SEQ ID NO: 6806 - DNA, 20 bp, human
ggcagatagggtagaggaaa

SEQ ID NO: 6807 - DNA, 20 bp, human
gtctgcagcagatagggtag

SEQ ID NO: 6808 - DNA, 20 bp, human
ggccgaagtccagaaaacag

SEQ ID NO: 6809 - DNA, 20 bp, human
gatgtacacgcagctgactc

SEQ ID NO: 6810 - DNA, 20 bp, human
gatggcagcgaggaaagcaa

SEQ ID NO: 6811 - DNA, 20 bp, human
gaggcacggaaggagtgtgc

SEQ ID NO: 6812 - DNA, 20 bp, human
gcaccctatgtgagtcagaa

SEQ ID NO: 6813 - DNA, 20 bp, human
gatataaccggattcaacat

SEQ ID NO: 6814 - DNA, 20 bp, human
gcagtgggagaagatataac

SEQ ID NO: 6815 - DNA, 20 bp, human
gctgccattctgactcacat

SEQ ID NO: 6816 - DNA, 20 bp, human
gactgacactgtaggatctg

SEQ ID NO: 6817 - DNA, 20 bp, human
gagcggcagttgtccatctc

SEQ ID NO: 6818 - DNA, 20 bp, human
gggaagagcatggacagcat

SEQ ID NO: 6819 - DNA, 20 bp, human
gattcggatactgacactgt

SEQ ID NO: 6820 - DNA, 20 bp, human
ggtagctgcaggacccatgc

SEQ ID NO: 6821 - DNA, 20 bp, human
gtcattgacggacccagcca

SEQ ID NO: 6822 - DNA, 20 bp, human
gacagtcctgctcacttggg

SEQ ID NO: 6823 - DNA, 20 bp, human
ggcaatatcaggtccagcat

SEQ ID NO: 6824 - DNA, 20 bp, human
gctgctacgctgccatggct

SEQ ID NO: 6825 - DNA, 20 bp, human
gaggaggaaagtgtagctgc

SEQ ID NO: 6826 - DNA, 20 bp, human
gaggcaagcctggccactgt

SEQ ID NO: 6827 - DNA, 20 bp, human
gacagagctcggccagacag

SEQ ID NO: 6828 - DNA, 20 bp, human
gtgtctgctcagagccctag

SEQ ID NO: 6829 - DNA, 20 bp, human
ggagggcagggctcagactt

SEQ ID NO: 6830 - DNA, 20 bp, human
gactgcagaacaacacgcag

SEQ ID NO: 6831 - DNA, 20 bp, human
ggtctggccgagctctgtcc

SEQ ID NO: 6832 - DNA, 20 bp, human
gcaaggcaggaggcggatag

SEQ ID NO: 6833 - DNA, 20 bp, human
gagaaggtacggggcatggg

SEQ ID NO: 6834 - DNA, 20 bp, human
ggggcatgggaggtttgcag

SEQ ID NO: 6835 - DNA, 20 bp, human
ggcagctacaaacctctgtc

SEQ ID NO: 6836 - DNA, 20 bp, human
gagagggaatcactattcag

SEQ ID NO: 6837 - DNA, 20 bp, human
gtccagcagagaaagcgttg

SEQ ID NO: 6838 - DNA, 20 bp, human
gaaactgtagtatattccaa

SEQ ID NO: 6839 - DNA, 20 bp, human
gagtggaagttctggtctgt

SEQ ID NO: 6840 - DNA, 20 bp, human
gtgttcatctgtgactttaa

SEQ ID NO: 6841 - DNA, 20 bp, human
gttgaatccaagctgtaaga

SEQ ID NO: 6842 - DNA, 20 bp, human
ggccacaacgctttctctgc

SEQ ID NO: 6843 - DNA, 20 bp, human
gagtagtatagtggaagttc

SEQ ID NO: 6844 - DNA, 20 bp, human
ggtaattttaagtagtatag

SEQ ID NO: 6845 - DNA, 20 bp, human
gcttgagtctactgagaaag

SEQ ID NO: 6846 - DNA, 20 bp, human
gggagttgggagttcaaatg

SEQ ID NO: 6847 - DNA, 20 bp, human
ggccacgctcggcaggtcca

SEQ ID NO: 6848 - DNA, 20 bp, human
ggccaaacgaggcatgtccg

SEQ ID NO: 6849 - DNA, 20 bp, human
gccagctctgcggccatgag

SEQ ID NO: 6850 - DNA, 20 bp, human
ggggcttggggtccatcctc

SEQ ID NO: 6851 - DNA, 20 bp, human
ggcatgtaaaggctccacaa

SEQ ID NO: 6852 - DNA, 20 bp, human
gaccctgaccctccagctgg

SEQ ID NO: 6853 - DNA, 20 bp, human
gcctgccgagcgtggcactg

SEQ ID NO: 6854 - DNA, 20 bp, human
gcaaatgaggctgctgcgga

SEQ ID NO: 6855 - DNA, 20 bp, human
gtatcgcttggagccaaacg

SEQ ID NO: 6856 - DNA, 20 bp, human
ggcctccttcagttgggaca

SEQ ID NO: 6857 - DNA, 20 bp, human
gttttcaatttcaagcaacg

SEQ ID NO: 6858 - DNA, 20 bp, human
gatatagagttaagaagtct

SEQ ID NO: 6859 - DNA, 20 bp, human
ggactttgtccataagacga

SEQ ID NO: 6860 - DNA, 20 bp, human
ggaattgtcttgatcaattc

SEQ ID NO: 6861 - DNA, 20 bp, human
ggccaatggcctccttcagt

SEQ ID NO: 6862 - DNA, 20 bp, human
gacgtggaactgttttcttc

SEQ ID NO: 6863 - DNA, 20 bp, human
gaccttttctgggcaaatat

SEQ ID NO: 6864 - DNA, 20 bp, human
gacatagcaaatcttgattt

SEQ ID NO: 6865 - DNA, 20 bp, human
gcaaatcttgattttggctc

SEQ ID NO: 6866 - DNA, 20 bp, human
ggctctcaggggctaacggg

SEQ ID NO: 6867 - DNA, 20 bp, human
gcaggctgtgaaggacctca

SEQ ID NO: 6868 - DNA, 20 bp, human
gccgcctgtcagggaaccga

SEQ ID NO: 6869 - DNA, 20 bp, human
gtgctactgagcgctcaggg

SEQ ID NO: 6870 - DNA, 20 bp, human
gtgagcgctcagtagcacgg

SEQ ID NO: 6871 - DNA, 20 bp, human
gtggagacgcggaggaccgg

SEQ ID NO: 6872 - DNA, 20 bp, human
gggctacctaagaggatgag

SEQ ID NO: 6873 - DNA, 20 bp, human
ggtggcggcgcagagcatca

SEQ ID NO: 6874 - DNA, 20 bp, human
gccggctctcaggggctaac

SEQ ID NO: 6875 - DNA, 20 bp, human
gcgtgcgggtccgcctgtca

SEQ ID NO: 6876 - DNA, 20 bp, human
gctgaggaaactataaactg

SEQ ID NO: 6877 - DNA, 20 bp, human
gtatttcattgaaaagttgt

SEQ ID NO: 6878 - DNA, 20 bp, human
gaactgtgtacatcattcta

SEQ ID NO: 6879 - DNA, 20 bp, human
ggtcttcagttaaaaacctc

SEQ ID NO: 6880 - DNA, 20 bp, human
gtcaaatattgtcctgtgag

SEQ ID NO: 6881 - DNA, 20 bp, human
gtttgaaatatgaaagtttg

SEQ ID NO: 6882 - DNA, 20 bp, human
gggagacatcatatttttct

SEQ ID NO: 6883 - DNA, 20 bp, human
gtaagaataagagtgaggct

SEQ ID NO: 6884 - DNA, 20 bp, human
gacatttaagaataagagtg

SEQ ID NO: 6885 - DNA, 20 bp, human
gaatatcagtcagctctttg

SEQ ID NO: 6886 - DNA, 20 bp, human
gcccaggctgagagtgtaaa

SEQ ID NO: 6887 - DNA, 20 bp, human
ggcagagcccagagcgtggg

SEQ ID NO: 6888 - DNA, 20 bp, human
gactgcagagcccagagcgt

SEQ ID NO: 6889 - DNA, 20 bp, human
gggcctctgagctagagacg

SEQ ID NO: 6890 - DNA, 20 bp, human
gccccaagccaagctgtggt

SEQ ID NO: 6891 - DNA, 20 bp, human
gggaagagccgagggtccag

SEQ ID NO: 6892 - DNA, 20 bp, human
ggaggaggtaagaagtgtca

SEQ ID NO: 6893 - DNA, 20 bp, human
gctgcagcctcccacgctct

SEQ ID NO: 6894 - DNA, 20 bp, human
gcaccagagcctgataacac

SEQ ID NO: 6895 - DNA, 20 bp, human
gatcacgcctggctgcccca

SEQ ID NO: 6896 - DNA, 20 bp, human
gtctgacaggggagctgaat

SEQ ID NO: 6897 - DNA, 20 bp, human
gggcttggaaggaaagctat

SEQ ID NO: 6898 - DNA, 20 bp, human
gaagcttgagtctctgacag

SEQ ID NO: 6899 - DNA, 20 bp, human
ggagactcaagctttgagaa

SEQ ID NO: 6900 - DNA, 20 bp, human
gcagcaagcgcatggagtcg

SEQ ID NO: 6901 - DNA, 20 bp, human
gttcactcagcaggctgcta

SEQ ID NO: 6902 - DNA, 20 bp, human
gagcgtggtcatgcaggtga

SEQ ID NO: 6903 - DNA, 20 bp, human
gagtgaactgaacaagaagc

SEQ ID NO: 6904 - DNA, 20 bp, human
ggcggccaactgctgtgagg

SEQ ID NO: 6905 - DNA, 20 bp, human
gctgctaaggttggcaactt

SEQ ID NO: 6906 - DNA, 20 bp, human
gcgctgaagcgggtcccgga

SEQ ID NO: 6907 - DNA, 20 bp, human
ggtccgcccggtgccctgag

SEQ ID NO: 6908 - DNA, 20 bp, human
ggcagcgtgccagaaaggta

SEQ ID NO: 6909 - DNA, 20 bp, human
ggcgtgccagaaaggtaggg

SEQ ID NO: 6910 - DNA, 20 bp, human
gcggaaggtgaggggcgcta

SEQ ID NO: 6911 - DNA, 20 bp, human
gacgtgcgccggcgctgaag

SEQ ID NO: 6912 - DNA, 20 bp, human
gagggagcagcgtgccagaa

SEQ ID NO: 6913 - DNA, 20 bp, human
gggaggggaagggtcgcggg

SEQ ID NO: 6914 - DNA, 20 bp, human
gctgcttggcttcctgactt

SEQ ID NO: 6915 - DNA, 20 bp, human
gcgtgcttggcgcgcacccg

SEQ ID NO: 6916 - DNA, 20 bp, human
gcgcggaagcccacagaata

SEQ ID NO: 6917 - DNA, 20 bp, human
ggggccttgggggcttgagg

SEQ ID NO: 6918 - DNA, 20 bp, human
ggcccgccgaagggccttgg

SEQ ID NO: 6919 - DNA, 20 bp, human
gcgggcccctgctgaaagac

SEQ ID NO: 6920 - DNA, 20 bp, human
gagcccccaaggcccttcgg

SEQ ID NO: 6921 - DNA, 20 bp, human
gtcagcaggggcccgccgaa

SEQ ID NO: 6922 - DNA, 20 bp, human
gcatgccggtctttcagcag

SEQ ID NO: 6923 - DNA, 20 bp, human
ggctaaggcagggagcccac

SEQ ID NO: 6924 - DNA, 20 bp, human
gaaactggcttcagcgagta

SEQ ID NO: 6925 - DNA, 20 bp, human
gacccgcctcgcctccccgt

SEQ ID NO: 6926 - DNA, 20 bp, human
ggttcaacggcagtagtcag

SEQ ID NO: 6927 - DNA, 20 bp, human
gcagctcagaaaagcgacag

SEQ ID NO: 6928 - DNA, 20 bp, human
gacgtggattgtgaagcaaa

SEQ ID NO: 6929 - DNA, 20 bp, human
gggtgaagtgaatagagata

SEQ ID NO: 6930 - DNA, 20 bp, human
gggaagagtgttaagcaacg

SEQ ID NO: 6931 - DNA, 20 bp, human
gaaggagccatggctcataa

SEQ ID NO: 6932 - DNA, 20 bp, human
gtccggcgatttaccttctt

SEQ ID NO: 6933 - DNA, 20 bp, human
gtgaggaccgtggccactga

SEQ ID NO: 6934 - DNA, 20 bp, human
gtcataatggatacactgac

SEQ ID NO: 6935 - DNA, 20 bp, human
gtgtggattactgaggaccg

SEQ ID NO: 6936 - DNA, 20 bp, human
gcctgtaaaggttcaggtag

SEQ ID NO: 6937 - DNA, 20 bp, human
gtcccgggatcggaagaaaa

SEQ ID NO: 6938 - DNA, 20 bp, human
gccgcaaacggtcccgggat

SEQ ID NO: 6939 - DNA, 20 bp, human
gccaggcaagatatatgctc

SEQ ID NO: 6940 - DNA, 20 bp, human
gtacggtaaatgcattacga

SEQ ID NO: 6941 - DNA, 20 bp, human
gcactctcctgtaaaggttc

SEQ ID NO: 6942 - DNA, 20 bp, human
gtgtaaaaggtgatatcctc

SEQ ID NO: 6943 - DNA, 20 bp, human
gccagctgtcttcttcacta

SEQ ID NO: 6944 - DNA, 20 bp, human
gtcctcaggcacctctaatc

SEQ ID NO: 6945 - DNA, 20 bp, human
gcatctgttagaagcattaa

SEQ ID NO: 6946 - DNA, 20 bp, human
gccccgcgagaagccatctg

SEQ ID NO: 6947 - DNA, 20 bp, human
ggccctcagggcctccgcaa

SEQ ID NO: 6948 - DNA, 20 bp, human
gcgcgagaagccatctgagg

SEQ ID NO: 6949 - DNA, 20 bp, human
gcgcaccggaaggaactgag

SEQ ID NO: 6950 - DNA, 20 bp, human
gggccttgaatccgccctca

SEQ ID NO: 6951 - DNA, 20 bp, human
gggccctgagggcggattca

SEQ ID NO: 6952 - DNA, 20 bp, human
gggcttgactggacagacgt

SEQ ID NO: 6953 - DNA, 20 bp, human
gagcagctcgcgtcagccat

SEQ ID NO: 6954 - DNA, 20 bp, human
ggattcaatgagctgtagtg

SEQ ID NO: 6955 - DNA, 20 bp, human
gcgtccgcggcgttcccgtg

SEQ ID NO: 6956 - DNA, 20 bp, human
gcgggcaccagcgcgcgcag

SEQ ID NO: 6957 - DNA, 20 bp, human
gctgcggagcggcaggatgc

SEQ ID NO: 6958 - DNA, 20 bp, human
gacacagacgccccacacgg

SEQ ID NO: 6959 - DNA, 20 bp, human
gatcttcgctgcggccatat

SEQ ID NO: 6960 - DNA, 20 bp, human
ggcgtctgtgtggctccgag

SEQ ID NO: 6961 - DNA, 20 bp, human
gcaggcagactcacggccgt

SEQ ID NO: 6962 - DNA, 20 bp, human
gagggcgccaacctcacccc

SEQ ID NO: 6963 - DNA, 20 bp, human
gccccgagtcccagacgcac

SEQ ID NO: 6964 - DNA, 20 bp, human
ggccacacagacgccccaca

SEQ ID NO: 6965 - DNA, 20 bp, human
ggaacggccacctccgtgtg

SEQ ID NO: 6966 - DNA, 20 bp, human
gcggacacagatccagaccc

SEQ ID NO: 6967 - DNA, 20 bp, human
ggacgctgcaggagggaaac

SEQ ID NO: 6968 - DNA, 20 bp, human
gacctccggacgctgcagga

SEQ ID NO: 6969 - DNA, 20 bp, human
ggcggccgccaagggtctca

SEQ ID NO: 6970 - DNA, 20 bp, human
gtccctcctgcagcgtccgg

SEQ ID NO: 6971 - DNA, 20 bp, human
ggggtcgaagggacttgaga

SEQ ID NO: 6972 - DNA, 20 bp, human
ggactcacggagctcgtgtc

SEQ ID NO: 6973 - DNA, 20 bp, human
gtgcaggagggaaactggcg

SEQ ID NO: 6974 - DNA, 20 bp, human
ggacctcgtcccgggactca

SEQ ID NO: 6975 - DNA, 20 bp, human
gcggactcgatcctgcgctc

SEQ ID NO: 6976 - DNA, 20 bp, human
ggctggcgcgcgggacagca

SEQ ID NO: 6977 - DNA, 20 bp, human
gcgtcagaggacgagagcag

SEQ ID NO: 6978 - DNA, 20 bp, human
gctccgggagcccaaggtcg

SEQ ID NO: 6979 - DNA, 20 bp, human
gtagcaaagtccttcaatat

SEQ ID NO: 6980 - DNA, 20 bp, human
ggatcgcccggaagactaag

SEQ ID NO: 6981 - DNA, 20 bp, human
gcctgctggggcgaccgggg

SEQ ID NO: 6982 - DNA, 20 bp, human
gtgaatgatgtcccttgggt

SEQ ID NO: 6983 - DNA, 20 bp, human
ggctgaaacccgcaaaagtt

SEQ ID NO: 6984 - DNA, 20 bp, human
gaggcgtgaatgatgtccct

SEQ ID NO: 6985 - DNA, 20 bp, human
gtccccggaaggcgagcgcg

SEQ ID NO: 6986 - DNA, 20 bp, human
gatggaggcgtctctaacca

SEQ ID NO: 6987 - DNA, 20 bp, human
gaggcgtctctaaccagggt

SEQ ID NO: 6988 - DNA, 20 bp, human
gctggtgagcatccatggtc

SEQ ID NO: 6989 - DNA, 20 bp, human
gctcagtcctgtgtctctca

SEQ ID NO: 6990 - DNA, 20 bp, human
ggcaagagttggcattaaca

SEQ ID NO: 6991 - DNA, 20 bp, human
gcatggagacaagtaatccc

SEQ ID NO: 6992 - DNA, 20 bp, human
ggttagctggtgagcatcca

SEQ ID NO: 6993 - DNA, 20 bp, human
gagcatccatggtcaggcag

SEQ ID NO: 6994 - DNA, 20 bp, human
gtatataaagcaaggaaacc

SEQ ID NO: 6995 - DNA, 20 bp, human
gtgagctcttgagttgaaag

SEQ ID NO: 6996 - DNA, 20 bp, human
gagctccggagaggctagac

SEQ ID NO: 6997 - DNA, 20 bp, human
gtgtcataggaaccgcgctc

SEQ ID NO: 6998 - DNA, 20 bp, human
gggcagtgccgggccagaca

SEQ ID NO: 6999 - DNA, 20 bp, human
gccagacatggcggaaggta

SEQ ID NO: 7000 - DNA, 20 bp, human
gggaagacacggagctgtgg

SEQ ID NO: 7001 - DNA, 20 bp, human
gccgggccagacatggcgga

SEQ ID NO: 7002 - DNA, 20 bp, human
ggaagtgcgcggctcaaccg

SEQ ID NO: 7003 - DNA, 20 bp, human
ggccccgagggcagcacggg

SEQ ID NO: 7004 - DNA, 20 bp, human
gaccccggcccgagaagctc

SEQ ID NO: 7005 - DNA, 20 bp, human
ggcgggagggacgttgtcat

SEQ ID NO: 7006 - DNA, 20 bp, human
gatctgccgggaaaaaaaag

SEQ ID NO: 7007 - DNA, 20 bp, human
ggcggcgccttctccgagcg

SEQ ID NO: 7008 - DNA, 20 bp, human
gggccccagagcgcttataa

SEQ ID NO: 7009 - DNA, 20 bp, human
ggtccgggcgtgtaaggcca

SEQ ID NO: 7010 - DNA, 20 bp, human
ggcaccaagaaccggatcag

SEQ ID NO: 7011 - DNA, 20 bp, human
gctatgttggtgatgcccag

SEQ ID NO: 7012 - DNA, 20 bp, human
gtcggggagcaggtaagccc

SEQ ID NO: 7013 - DNA, 20 bp, human
gtgccgggaaaaaaaagagg

SEQ ID NO: 7014 - DNA, 20 bp, human
gctgccgcgaggggactctg

SEQ ID NO: 7015 - DNA, 20 bp, human
gccgaagtcgatggctatgt

SEQ ID NO: 7016 - DNA, 20 bp, human
ggaacgagaagagcagcaag

SEQ ID NO: 7017 - DNA, 20 bp, human
gggacgaagtgtccgaggta

SEQ ID NO: 7018 - DNA, 20 bp, human
gttaggcagtgagaagttag

SEQ ID NO: 7019 - DNA, 20 bp, human
gcaccgccgccgctgatctc

SEQ ID NO: 7020 - DNA, 20 bp, human
gagccagtggcgagtcgagg

SEQ ID NO: 7021 - DNA, 20 bp, human
gccagaccgacccctcccgg

SEQ ID NO: 7022 - DNA, 20 bp, human
gtcacagaagggctccacca

SEQ ID NO: 7023 - DNA, 20 bp, human
gcgctgctgggacgggggaa

SEQ ID NO: 7024 - DNA, 20 bp, human
ggccgaccgctgtcacagaa

SEQ ID NO: 7025 - DNA, 20 bp, human
gtcgttcccgagatcagcgg

SEQ ID NO: 7026 - DNA, 20 bp, human
ggaacgagaagagcagcaag

SEQ ID NO: 7027 - DNA, 20 bp, human
gggacgaagtgtccgaggta

SEQ ID NO: 7028 - DNA, 20 bp, human
gttaggcagtgagaagttag

SEQ ID NO: 7029 - DNA, 20 bp, human
gcaccgccgccgctgatctc

SEQ ID NO: 7030 - DNA, 20 bp, human
gagccagtggcgagtcgagg

SEQ ID NO: 7031 - DNA, 20 bp, human
gccagaccgacccctcccgg

SEQ ID NO: 7032 - DNA, 20 bp, human
gtcacagaagggctccacca

SEQ ID NO: 7033 - DNA, 20 bp, human
gcgctgctgggacgggggaa

SEQ ID NO: 7034 - DNA, 20 bp, human
ggccgaccgctgtcacagaa

SEQ ID NO: 7035 - DNA, 20 bp, human
gtcgttcccgagatcagcgg

SEQ ID NO: 7036 - DNA, 20 bp, human
gcacccgggccggcgaggaa

SEQ ID NO: 7037 - DNA, 20 bp, human
ggccgaaggcgcccgcggcg

SEQ ID NO: 7038 - DNA, 20 bp, human
gggcgaggctcagactgggt

SEQ ID NO: 7039 - DNA, 20 bp, human
gggcgactaggagactaggg

SEQ ID NO: 7040 - DNA, 20 bp, human
gagctcggctgtagaggcag

SEQ ID NO: 7041 - DNA, 20 bp, human
gcagccgagctggtgacctc

SEQ ID NO: 7042 - DNA, 20 bp, human
gccgcggcgaggctcagact

SEQ ID NO: 7043 - DNA, 20 bp, human
ggactgcaggtccagtgaaa

SEQ ID NO: 7044 - DNA, 20 bp, human
ggtcaccagctcggctgtag

SEQ ID NO: 7045 - DNA, 20 bp, human
gctgggagaaaagccctgta

SEQ ID NO: 7046 - DNA, 20 bp, human
gggaggctcaggctactggg

SEQ ID NO: 7047 - DNA, 20 bp, human
gcgccgcgcactccccgctg

SEQ ID NO: 7048 - DNA, 20 bp, human
gttggttagggagacaggta

SEQ ID NO: 7049 - DNA, 20 bp, human
gtagactcaacagaggtcaa

SEQ ID NO: 7050 - DNA, 20 bp, human
gttcccctctcccggacccg

SEQ ID NO: 7051 - DNA, 20 bp, human
ggcggctccttcggccaccc

SEQ ID NO: 7052 - DNA, 20 bp, human
gctgctgcctgggtggccga

SEQ ID NO: 7053 - DNA, 20 bp, human
gggctgaggactgtcccccg

SEQ ID NO: 7054 - DNA, 20 bp, human
gcgaggctggcagtacctgg

SEQ ID NO: 7055 - DNA, 20 bp, human
ggacaggtatgggtgtgcct

SEQ ID NO: 7056 - DNA, 20 bp, human
gtgcgcttcggacccagcca

SEQ ID NO: 7057 - DNA, 20 bp, human
gagggaacttgggggtccaa

SEQ ID NO: 7058 - DNA, 20 bp, human
gggcctggcccgggatgatg

SEQ ID NO: 7059 - DNA, 20 bp, human
gggcctccgagcacatgccc

SEQ ID NO: 7060 - DNA, 20 bp, human
gaggggcgccccatcatccc

SEQ ID NO: 7061 - DNA, 20 bp, human
gagtaggaaatcgaccgacc

SEQ ID NO: 7062 - DNA, 20 bp, human
gccgcaacctgcgagccagg

SEQ ID NO: 7063 - DNA, 20 bp, human
gagtctgggaatccgggaag

SEQ ID NO: 7064 - DNA, 20 bp, human
ggtgctagaggacggcgcag

SEQ ID NO: 7065 - DNA, 20 bp, human
gaggggctagggctcgaggg

SEQ ID NO: 7066 - DNA, 20 bp, human
gcggggcgcgggcttctcgg

SEQ ID NO: 7067 - DNA, 20 bp, human
gttccccggaggctgctcca

SEQ ID NO: 7068 - DNA, 20 bp, human
gcggctggcggcggccgagt

SEQ ID NO: 7069 - DNA, 20 bp, human
gcaactgctgccggctccag

SEQ ID NO: 7070 - DNA, 20 bp, human
gccgggcggcggcgatgctg

SEQ ID NO: 7071 - DNA, 20 bp, human
gggggccacgccgggttcgg

SEQ ID NO: 7072 - DNA, 20 bp, human
gctggcggcggccgagtggg

SEQ ID NO: 7073 - DNA, 20 bp, human
gcaggccagcgccgcccact

SEQ ID NO: 7074 - DNA, 20 bp, human
ggccgcccccgcctcaggta

SEQ ID NO: 7075 - DNA, 20 bp, human
ggggcccggcgaggcgttag

SEQ ID NO: 7076 - DNA, 20 bp, human
gctgggggcgtggggttagg

SEQ ID NO: 7077 - DNA, 20 bp, human
ggaaacgcgacgctctccgt

SEQ ID NO: 7078 - DNA, 20 bp, human
gaggtacgcggtgcagacgg

SEQ ID NO: 7079 - DNA, 20 bp, human
gtggcgaaggccttccaggt

SEQ ID NO: 7080 - DNA, 20 bp, human
gtcggcgggcgccatgggac

SEQ ID NO: 7081 - DNA, 20 bp, human
ggcaccaacggtggaggtac

SEQ ID NO: 7082 - DNA, 20 bp, human
gggcccaaaagcagactctt

SEQ ID NO: 7083 - DNA, 20 bp, human
gcagccgggtcgtcgaacac

SEQ ID NO: 7084 - DNA, 20 bp, human
gcgacgcgcaccaacggtgg

SEQ ID NO: 7085 - DNA, 20 bp, human
gctgcaccgcgtacctcatg

SEQ ID NO: 7086 - DNA, 20 bp, human
ggacactgagtagccaaccg

SEQ ID NO: 7087 - DNA, 20 bp, human
gtgtccgccagcccgcggga

SEQ ID NO: 7088 - DNA, 20 bp, human
gacaagaggggtagttacag

SEQ ID NO: 7089 - DNA, 20 bp, human
ggggaacgccagccgcaatg

SEQ ID NO: 7090 - DNA, 20 bp, human
gggaagctcgcattaaccta

SEQ ID NO: 7091 - DNA, 20 bp, human
gaagtcatcgggaaaggtac

SEQ ID NO: 7092 - DNA, 20 bp, human
gcaggaggagaaggagctac

SEQ ID NO: 7093 - DNA, 20 bp, human
ggagaagcgaagcgtttccg

SEQ ID NO: 7094 - DNA, 20 bp, human
gccgcgggctggcggacagc

SEQ ID NO: 7095 - DNA, 20 bp, human
gagcgaagcgtttccgcggt

SEQ ID NO: 7096 - DNA, 20 bp, human
ggatgggcctcggagcgtaa

SEQ ID NO: 7097 - DNA, 20 bp, human
gccgctgtctcccgctggag

SEQ ID NO: 7098 - DNA, 20 bp, human
gccggagtactacacagaca

SEQ ID NO: 7099 - DNA, 20 bp, human
ggagtctacggagataaagt

SEQ ID NO: 7100 - DNA, 20 bp, human
ggctgtgcccgaaaagtccc

SEQ ID NO: 7101 - DNA, 20 bp, human
gaggatcaggaagaaacgag

SEQ ID NO: 7102 - DNA, 20 bp, human
ggcaagagtctcccctccag

SEQ ID NO: 7103 - DNA, 20 bp, human
gtgtagtactccggcaggat

SEQ ID NO: 7104 - DNA, 20 bp, human
gttctgggtcaccagagcag

SEQ ID NO: 7105 - DNA, 20 bp, human
ggagtaggaggtgtgaccgg

SEQ ID NO: 7106 - DNA, 20 bp, human
gcccagcagggccaactcca

SEQ ID NO: 7107 - DNA, 20 bp, human
gtaagctgaccggtgtggag

SEQ ID NO: 7108 - DNA, 20 bp, human
gactccttcagccaacatga

SEQ ID NO: 7109 - DNA, 20 bp, human
gctatataagctgaccggtg

SEQ ID NO: 7110 - DNA, 20 bp, human
ggtactgaaagtagaggaac

SEQ ID NO: 7111 - DNA, 20 bp, human
ggcccggaaactttacaata

SEQ ID NO: 7112 - DNA, 20 bp, human
gtatgtttttctgtcgtgga

SEQ ID NO: 7113 - DNA, 20 bp, human
ggccttattgtaaagtttcc

SEQ ID NO: 7114 - DNA, 20 bp, human
ggctttcaggtgtaatgcaa

SEQ ID NO: 7115 - DNA, 20 bp, human
gactctgaaaatgtcatata

SEQ ID NO: 7116 - DNA, 20 bp, human
gagcctgtgggacgcgaccg

SEQ ID NO: 7117 - DNA, 20 bp, human
gagcggagcgcgcacagagg

SEQ ID NO: 7118 - DNA, 20 bp, human
gcgccgcggtcgcgtcccac

SEQ ID NO: 7119 - DNA, 20 bp, human
gtggcctagaggacgcgtcg

SEQ ID NO: 7120 - DNA, 20 bp, human
gctgaggtgcgggggacgtg

SEQ ID NO: 7121 - DNA, 20 bp, human
gggggcggaagcgggatcga

SEQ ID NO: 7122 - DNA, 20 bp, human
gacggcgcctgtgccccgag

SEQ ID NO: 7123 - DNA, 20 bp, human
gaggcgccctaggcccctcg

SEQ ID NO: 7124 - DNA, 20 bp, human
gcctagaggacgcgtcgggg

SEQ ID NO: 7125 - DNA, 20 bp, human
gctgtgccccgaggggccta

SEQ ID NO: 7126 - DNA, 20 bp, human
gggcccgagcggcaaggcgg

SEQ ID NO: 7127 - DNA, 20 bp, human
gtccatcgcgcaccgtctca

SEQ ID NO: 7128 - DNA, 20 bp, human
gatcgcgcaccgtctcaggg

SEQ ID NO: 7129 - DNA, 20 bp, human
gacggtgcgcgatggaccga

SEQ ID NO: 7130 - DNA, 20 bp, human
gaccaccgcccccagaccag

SEQ ID NO: 7131 - DNA, 20 bp, human
gccgcgcggcccgggaaacg

SEQ ID NO: 7132 - DNA, 20 bp, human
gaccgtctcagggcggcctc

SEQ ID NO: 7133 - DNA, 20 bp, human
gcggctccgcgacggctcag

SEQ ID NO: 7134 - DNA, 20 bp, human
ggggcccggggcgatcgtga

SEQ ID NO: 7135 - DNA, 20 bp, human
gggtgcggacgctactgatg

SEQ ID NO: 7136 - DNA, 20 bp, human
gggagcagcgcagaactgag

SEQ ID NO: 7137 - DNA, 20 bp, human
gcgctgtcctgggagcgagg

SEQ ID NO: 7138 - DNA, 20 bp, human
ggtgagagacggaccgagac

SEQ ID NO: 7139 - DNA, 20 bp, human
gccgggcttgaaaacatctc

SEQ ID NO: 7140 - DNA, 20 bp, human
gggcgtggcgacaggaaagg

SEQ ID NO: 7141 - DNA, 20 bp, human
gctcctcgcgacgccgggag

SEQ ID NO: 7142 - DNA, 20 bp, human
ggctccggcggctttacagg

SEQ ID NO: 7143 - DNA, 20 bp, human
gccgcgccggggggcactaa

SEQ ID NO: 7144 - DNA, 20 bp, human
ggtcactgtcaggcgagcta

SEQ ID NO: 7145 - DNA, 20 bp, human
ggtgggagccgccaactggg

SEQ ID NO: 7146 - DNA, 20 bp, human
gtccagactaggaggtgcag

SEQ ID NO: 7147 - DNA, 20 bp, human
ggattccccgaagtccccac

SEQ ID NO: 7148 - DNA, 20 bp, human
gcacacctgcaaagtggaag

SEQ ID NO: 7149 - DNA, 20 bp, human
ggctcgcggacagacttctg

SEQ ID NO: 7150 - DNA, 20 bp, human
gccattggctctgaagtcag

SEQ ID NO: 7151 - DNA, 20 bp, human
gtgccccaaacagggaagtg

SEQ ID NO: 7152 - DNA, 20 bp, human
gctggggatcccggggacag

SEQ ID NO: 7153 - DNA, 20 bp, human
gcggcgagcaagcgagcgta

SEQ ID NO: 7154 - DNA, 20 bp, human
gccgccggggccgagacttg

SEQ ID NO: 7155 - DNA, 20 bp, human
ggactaccggcagctcgaga

SEQ ID NO: 7156 - DNA, 20 bp, human
ggcggccggcgcgggatacg

SEQ ID NO: 7157 - DNA, 20 bp, human
gggagggagcgggcactcgg

SEQ ID NO: 7158 - DNA, 20 bp, human
gcgcgggatacggggatgtg

SEQ ID NO: 7159 - DNA, 20 bp, human
gccgccaggaaggggcccga

SEQ ID NO: 7160 - DNA, 20 bp, human
ggccacacgaggtagtgcag

SEQ ID NO: 7161 - DNA, 20 bp, human
gctgcgggcgcgcgtccctg

SEQ ID NO: 7162 - DNA, 20 bp, human
gcaccgcgagctggagaagg

SEQ ID NO: 7163 - DNA, 20 bp, human
gcggctcgggcatgtgcgag

SEQ ID NO: 7164 - DNA, 20 bp, human
gcaacgcctccgccaggaag

SEQ ID NO: 7165 - DNA, 20 bp, human
gtccgctgcactacctcgtg

SEQ ID NO: 7166 - DNA, 20 bp, human
gtgccttacaccgaaaaaca

SEQ ID NO: 7167 - DNA, 20 bp, human
gcggtgtaaggcagcgacgg

SEQ ID NO: 7168 - DNA, 20 bp, human
gactgagatcctggtgtcgt

SEQ ID NO: 7169 - DNA, 20 bp, human
ggacggcgagactgagatcc

SEQ ID NO: 7170 - DNA, 20 bp, human
gctggtaaaggtaccgccga

SEQ ID NO: 7171 - DNA, 20 bp, human
gccagaagcaggattggcaa

SEQ ID NO: 7172 - DNA, 20 bp, human
gcggcacaaggcgattagag

SEQ ID NO: 7173 - DNA, 20 bp, human
ggaagcaggattggcaaggg

SEQ ID NO: 7174 - DNA, 20 bp, human
gcccggggatgaggaagcgg

SEQ ID NO: 7175 - DNA, 20 bp, human
gggagaagatccgctcactg

SEQ ID NO: 7176 - DNA, 20 bp, human
ggcggcccccgcagcagtag

SEQ ID NO: 7177 - DNA, 20 bp, human
gtggctgccagcgtcaggag

SEQ ID NO: 7178 - DNA, 20 bp, human
gacctggggtaggaagaccg

SEQ ID NO: 7179 - DNA, 20 bp, human
ggacaccggccaggtcccag

SEQ ID NO: 7180 - DNA, 20 bp, human
gtaggagttcggggagagag

SEQ ID NO: 7181 - DNA, 20 bp, human
gtcagccggcaagcacttag

SEQ ID NO: 7182 - DNA, 20 bp, human
gtcggtgaccgcgggacctg

SEQ ID NO: 7183 - DNA, 20 bp, human
ggcttgggtcagcaaggatg

SEQ ID NO: 7184 - DNA, 20 bp, human
gccagaggctcaggcgcgag

SEQ ID NO: 7185 - DNA, 20 bp, human
gtgggcttgggatcgtgcag

SEQ ID NO: 7186 - DNA, 20 bp, human
gcaggaacgccggcccccag

SEQ ID NO: 7187 - DNA, 20 bp, human
gggagaagccgagggcgagt

SEQ ID NO: 7188 - DNA, 20 bp, human
gctgccggggacaaagccgg

SEQ ID NO: 7189 - DNA, 20 bp, human
ggccccgcgcgccccgaacc

SEQ ID NO: 7190 - DNA, 20 bp, human
gacaaagccgggggcgtgag

SEQ ID NO: 7191 - DNA, 20 bp, human
gtgcggggcaggtcacgctt

SEQ ID NO: 7192 - DNA, 20 bp, human
gccaaagtggagggtccggg

SEQ ID NO: 7193 - DNA, 20 bp, human
ggcggcgggcgggacaccgg

SEQ ID NO: 7194 - DNA, 20 bp, human
gccgcaaagccccaaagtgg

SEQ ID NO: 7195 - DNA, 20 bp, human
gcggggcaggttgcgtgaag

SEQ ID NO: 7196 - DNA, 20 bp, human
ggaagggagccccccggcgg

SEQ ID NO: 7197 - DNA, 20 bp, human
ggcggcagtagaggtgaccg

SEQ ID NO: 7198 - DNA, 20 bp, human
ggtagaggtgaccgaggcgg

SEQ ID NO: 7199 - DNA, 20 bp, human
gggagaagggagccccccgg

SEQ ID NO: 7200 - DNA, 20 bp, human
gctggggccgacacagcaat

SEQ ID NO: 7201 - DNA, 20 bp, human
ggtgagagctggcggagcgg

SEQ ID NO: 7202 - DNA, 20 bp, human
gcgcgacttcggccgcactg

SEQ ID NO: 7203 - DNA, 20 bp, human
gccgcggcggcggaggtcgg

SEQ ID NO: 7204 - DNA, 20 bp, human
gaacaacagcgaggaagaag

SEQ ID NO: 7205 - DNA, 20 bp, human
gaccagcagtaacaacagcg

SEQ ID NO: 7206 - DNA, 20 bp, human
ggctttcactgctcctgcaa

SEQ ID NO: 7207 - DNA, 20 bp, human
gtgtcagaatttccctaaat

SEQ ID NO: 7208 - DNA, 20 bp, human
gactgaattagaagaattta

SEQ ID NO: 7209 - DNA, 20 bp, human
gatggcttcaggagatcagt

SEQ ID NO: 7210 - DNA, 20 bp, human
gcttagtgaaaaaaactaac

SEQ ID NO: 7211 - DNA, 20 bp, human
gtgatgaacattttaaaggt

SEQ ID NO: 7212 - DNA, 20 bp, human
gaatttaaggaagcctttgc

SEQ ID NO: 7213 - DNA, 20 bp, human
gtccttgatgaacattttaa

SEQ ID NO: 7214 - DNA, 20 bp, human
gtaatttgataatgtaattt

SEQ ID NO: 7215 - DNA, 20 bp, human
gacggcttcactaaaaaaga

SEQ ID NO: 7216 - DNA, 20 bp, human
gctgggctcactctatcgag

SEQ ID NO: 7217 - DNA, 20 bp, human
gcactctatcgagaggtcgg

SEQ ID NO: 7218 - DNA, 20 bp, human
ggctcactctatcgagaggt

SEQ ID NO: 7219 - DNA, 20 bp, human
gggtttccccgcaccgcctg

SEQ ID NO: 7220 - DNA, 20 bp, human
gtaggggtggatcgctgggt

SEQ ID NO: 7221 - DNA, 20 bp, human
gtctcgaatttggagctggg

SEQ ID NO: 7222 - DNA, 20 bp, human
ggggagggggatctcgaatt

SEQ ID NO: 7223 - DNA, 20 bp, human
ggatttaggggtggatcgct

SEQ ID NO: 7224 - DNA, 20 bp, human
ggggatctcgaatttggagc

SEQ ID NO: 7225 - DNA, 20 bp, human
gtagagtgagcccagtaaag

SEQ ID NO: 7226 - DNA, 20 bp, human
gaccatggaggactccgagg

SEQ ID NO: 7227 - DNA, 20 bp, human
gggcaccatggaggactccg

SEQ ID NO: 7228 - DNA, 20 bp, human
gctgcagaggcggttatgga

SEQ ID NO: 7229 - DNA, 20 bp, human
gcacagcgctcatcgagcag

SEQ ID NO: 7230 - DNA, 20 bp, human
gactggttgggccttagcca

SEQ ID NO: 7231 - DNA, 20 bp, human
gcactgtgtcccaagagcag

SEQ ID NO: 7232 - DNA, 20 bp, human
ggatctcctcagaccccctt

SEQ ID NO: 7233 - DNA, 20 bp, human
gtcagtcactggggcatcac

SEQ ID NO: 7234 - DNA, 20 bp, human
gcctgggccttgagagacag

SEQ ID NO: 7235 - DNA, 20 bp, human
gtcctgtcccagggtattac

SEQ ID NO: 7236 - DNA, 20 bp, human
ggcccagcccaatgaaacaa

SEQ ID NO: 7237 - DNA, 20 bp, human
gctgctggaaaagcactgac

SEQ ID NO: 7238 - DNA, 20 bp, human
gccctagaagtccaagctgg

SEQ ID NO: 7239 - DNA, 20 bp, human
ggtgatgtacctcagagtat

SEQ ID NO: 7240 - DNA, 20 bp, human
gatcaacaagaataacacat

SEQ ID NO: 7241 - DNA, 20 bp, human
gaggtgaagtaagcctgtga

SEQ ID NO: 7242 - DNA, 20 bp, human
gaagattcaaggagctgtag

SEQ ID NO: 7243 - DNA, 20 bp, human
gtcccatgctggtccttcac

SEQ ID NO: 7244 - DNA, 20 bp, human
gatgggaatcctatactctg

SEQ ID NO: 7245 - DNA, 20 bp, human
gagctccttgaatcttctgg

SEQ ID NO: 7246 - DNA, 20 bp, human
gggcgtacagcagacgctgg

SEQ ID NO: 7247 - DNA, 20 bp, human
gaggagatggacttcgagag

SEQ ID NO: 7248 - DNA, 20 bp, human
ggcattgcacccaacctgag

SEQ ID NO: 7249 - DNA, 20 bp, human
gggcctggtgagaaccacga

SEQ ID NO: 7250 - DNA, 20 bp, human
gggagcagaatctgcaccag

SEQ ID NO: 7251 - DNA, 20 bp, human
gctcggcgtacagcagacgc

SEQ ID NO: 7252 - DNA, 20 bp, human
ggcgcggtgaaggagagcag

SEQ ID NO: 7253 - DNA, 20 bp, human
gggcacccggggctaaacaa

SEQ ID NO: 7254 - DNA, 20 bp, human
ggagaaccacgagggccgcg

SEQ ID NO: 7255 - DNA, 20 bp, human
gctcagtacacgggaaccgt

SEQ ID NO: 7256 - DNA, 20 bp, human
gtggtaaggatgtgggacgg

SEQ ID NO: 7257 - DNA, 20 bp, human
gcagcattcagcagttggta

SEQ ID NO: 7258 - DNA, 20 bp, human
gtcctatcaagccggtccca

SEQ ID NO: 7259 - DNA, 20 bp, human
gggaccggcttgataggagg

SEQ ID NO: 7260 - DNA, 20 bp, human
gcaagagagggaagtcgaat

SEQ ID NO: 7261 - DNA, 20 bp, human
gaaggatgtgggacggaggt

SEQ ID NO: 7262 - DNA, 20 bp, human
gacggaggtgggaggcaccc

SEQ ID NO: 7263 - DNA, 20 bp, human
ggtgaaagaggaacaggaaa

SEQ ID NO: 7264 - DNA, 20 bp, human
gctcatgtgaggtggtgagg

SEQ ID NO: 7265 - DNA, 20 bp, human
gaccctgggaccggcttgat

SEQ ID NO: 7266 - DNA, 20 bp, human
gcgcacggggttccaagagg

SEQ ID NO: 7267 - DNA, 20 bp, human
ggggcgcacggggttccaag

SEQ ID NO: 7268 - DNA, 20 bp, human
gccgccggctgcatctccag

SEQ ID NO: 7269 - DNA, 20 bp, human
gacatttagagggcattggg

SEQ ID NO: 7270 - DNA, 20 bp, human
gacccgggaaagatggtcgg

SEQ ID NO: 7271 - DNA, 20 bp, human
gagggtctggagggaccgcg

SEQ ID NO: 7272 - DNA, 20 bp, human
gtcccgggtctggaatgggg

SEQ ID NO: 7273 - DNA, 20 bp, human
gcccttggccgactcggagg

SEQ ID NO: 7274 - DNA, 20 bp, human
ggtcagccggggacggggaa

SEQ ID NO: 7275 - DNA, 20 bp, human
ggcgcccttggccgactcgg

SEQ ID NO: 7276 - DNA, 20 bp, human
gcctcccaaaggaaactccg

SEQ ID NO: 7277 - DNA, 20 bp, human
ggctggccgcagcctcccaa

SEQ ID NO: 7278 - DNA, 20 bp, human
ggccgcgcgaaggagcccaa

SEQ ID NO: 7279 - DNA, 20 bp, human
gctccagtggcactcagtcc

SEQ ID NO: 7280 - DNA, 20 bp, human
gcgcttgcttggtaacccgg

SEQ ID NO: 7281 - DNA, 20 bp, human
ggtaacccggagggagagat

SEQ ID NO: 7282 - DNA, 20 bp, human
gtcctgcccgcctactccag

SEQ ID NO: 7283 - DNA, 20 bp, human
gtgggtggctcccacaaaag

SEQ ID NO: 7284 - DNA, 20 bp, human
gcaaggtgtcaccgtcccag

SEQ ID NO: 7285 - DNA, 20 bp, human
ggagtgccactggagtaggc

SEQ ID NO: 7286 - DNA, 20 bp, human
gtcccagcagcggacgaggg

SEQ ID NO: 7287 - DNA, 20 bp, human
gatcgccgcgcgagggtggt

SEQ ID NO: 7288 - DNA, 20 bp, human
gccacggcggagtaaggggt

SEQ ID NO: 7289 - DNA, 20 bp, human
gtgccgccgtcgcccaggat

SEQ ID NO: 7290 - DNA, 20 bp, human
gctcgctgcgtcgacaccgg

SEQ ID NO: 7291 - DNA, 20 bp, human
ggcgagggtggtgggcatcg

SEQ ID NO: 7292 - DNA, 20 bp, human
gcgccccacggcggagtaag

SEQ ID NO: 7293 - DNA, 20 bp, human
gcgacgcagcgaggctcgga

SEQ ID NO: 7294 - DNA, 20 bp, human
gagcctcgctgcgtcgacac

SEQ ID NO: 7295 - DNA, 20 bp, human
gaggtcccagcagcggacga

SEQ ID NO: 7296 - DNA, 20 bp, human
gtcccacagaagcattccaa

SEQ ID NO: 7297 - DNA, 20 bp, human
gtccgttggaatgcttctgt

SEQ ID NO: 7298 - DNA, 20 bp, human
ggaatcctagtagaacaagc

SEQ ID NO: 7299 - DNA, 20 bp, human
gactaggcatttcatcctgt

SEQ ID NO: 7300 - DNA, 20 bp, human
gtgctccagcaaaagggcac

SEQ ID NO: 7301 - DNA, 20 bp, human
gtccatcaggcagttgtctg

SEQ ID NO: 7302 - DNA, 20 bp, human
gcttcagactgttgctccgt

SEQ ID NO: 7303 - DNA, 20 bp, human
gactgtggcggttttcacag

SEQ ID NO: 7304 - DNA, 20 bp, human
gaatctgaaaaggataactg

SEQ ID NO: 7305 - DNA, 20 bp, human
gctgaaaaggataactgtgg

SEQ ID NO: 7306 - DNA, 20 bp, human
ggtgcgaagcctctcaggca

SEQ ID NO: 7307 - DNA, 20 bp, human
gttcggcccggccctgtgtg

SEQ ID NO: 7308 - DNA, 20 bp, human
gagagccccgggagagtgaa

SEQ ID NO: 7309 - DNA, 20 bp, human
gtcgccgggtaacaggtcgg

SEQ ID NO: 7310 - DNA, 20 bp, human
gctctcggcgttccgcagag

SEQ ID NO: 7311 - DNA, 20 bp, human
gcatgagtgcgaagcctctc

SEQ ID NO: 7312 - DNA, 20 bp, human
ggcgcgcgcacactacacat

SEQ ID NO: 7313 - DNA, 20 bp, human
ggcggaacgccgagagcccc

SEQ ID NO: 7314 - DNA, 20 bp, human
ggagtctgtgcccggcgacg

SEQ ID NO: 7315 - DNA, 20 bp, human
gctgtcgccgggtaacaggt

SEQ ID NO: 7316 - DNA, 20 bp, human
gcccggcacgaccttgacag

SEQ ID NO: 7317 - DNA, 20 bp, human
ggcggcagagatctcctcca

SEQ ID NO: 7318 - DNA, 20 bp, human
gggcacgaccttgacagcgg

SEQ ID NO: 7319 - DNA, 20 bp, human
gtatacaagacgcccagaag

SEQ ID NO: 7320 - DNA, 20 bp, human
gatcgccccttcagagtcgg

SEQ ID NO: 7321 - DNA, 20 bp, human
gtccccagagtggacgatgt

SEQ ID NO: 7322 - DNA, 20 bp, human
gtgcctcccggggacaagtc

SEQ ID NO: 7323 - DNA, 20 bp, human
gttcagagtcgggggctggg

SEQ ID NO: 7324 - DNA, 20 bp, human
gctttttacgggtatcgagg

SEQ ID NO: 7325 - DNA, 20 bp, human
gtagctggctgaaagggctc

SEQ ID NO: 7326 - DNA, 20 bp, human
gtgaacactccggcctctgt

SEQ ID NO: 7327 - DNA, 20 bp, human
ggctggagaagatgacagta

SEQ ID NO: 7328 - DNA, 20 bp, human
gctaacgttagagcagctaa

SEQ ID NO: 7329 - DNA, 20 bp, human
gtcagaatttctcccgacag

SEQ ID NO: 7330 - DNA, 20 bp, human
ggggtgcgggaactgaagac

SEQ ID NO: 7331 - DNA, 20 bp, human
gccccgcacgcccttgccag

SEQ ID NO: 7332 - DNA, 20 bp, human
gcatctacttcggggatcta

SEQ ID NO: 7333 - DNA, 20 bp, human
gcggggccaagtccagaagc

SEQ ID NO: 7334 - DNA, 20 bp, human
gaagggtaagcgggaagcga

SEQ ID NO: 7335 - DNA, 20 bp, human
gaatttctcccgacagaggc

SEQ ID NO: 7336 - DNA, 20 bp, human
ggggctgctgaggaggacgc

SEQ ID NO: 7337 - DNA, 20 bp, human
gacttgtcgcagggctgctg

SEQ ID NO: 7338 - DNA, 20 bp, human
ggcagccctgcgacaagtcc

SEQ ID NO: 7339 - DNA, 20 bp, human
gggagccgggacttgtcgca

SEQ ID NO: 7340 - DNA, 20 bp, human
gggcgtccaggccccagact

SEQ ID NO: 7341 - DNA, 20 bp, human
gggggtagcagtctgcgagg

SEQ ID NO: 7342 - DNA, 20 bp, human
ggaccagaacatgtgcttgt

SEQ ID NO: 7343 - DNA, 20 bp, human
gggcggggtagcagtctgcg

SEQ ID NO: 7344 - DNA, 20 bp, human
gcgccgctcgtcgcagacag

SEQ ID NO: 7345 - DNA, 20 bp, human
gtagctggttgggggtaggt

SEQ ID NO: 7346 - DNA, 20 bp, human
gcttccttcggtggcagcgg

SEQ ID NO: 7347 - DNA, 20 bp, human
gtctgggatgcttccttcgg

SEQ ID NO: 7348 - DNA, 20 bp, human
gttccaggcggcgggccgag

SEQ ID NO: 7349 - DNA, 20 bp, human
gatgcttccttcggtggcag

SEQ ID NO: 7350 - DNA, 20 bp, human
gtcggtggcagtccccgcag

SEQ ID NO: 7351 - DNA, 20 bp, human
gcaggatgaggcgtccccat

SEQ ID NO: 7352 - DNA, 20 bp, human
gtggaaacgagagacgcggg

SEQ ID NO: 7353 - DNA, 20 bp, human
gagcgcccctctgcagtact

SEQ ID NO: 7354 - DNA, 20 bp, human
gccagacaccgggaaggtaa

SEQ ID NO: 7355 - DNA, 20 bp, human
gtctatggaaacgagagacg

SEQ ID NO: 7356 - DNA, 20 bp, human
ggtcccctccctaggatcca

SEQ ID NO: 7357 - DNA, 20 bp, human
gagtgtctccctggatccta

SEQ ID NO: 7358 - DNA, 20 bp, human
gttccaggcagggaaccaga

SEQ ID NO: 7359 - DNA, 20 bp, human
gggtggtcacgtctcaggag

SEQ ID NO: 7360 - DNA, 20 bp, human
gtctaaaacacagaatggag

SEQ ID NO: 7361 - DNA, 20 bp, human
gggttcgtagggtatctatg

SEQ ID NO: 7362 - DNA, 20 bp, human
gggagggatagtccacctgg

SEQ ID NO: 7363 - DNA, 20 bp, human
gagtgagactcacggagaga

SEQ ID NO: 7364 - DNA, 20 bp, human
ggagctgctgcaaacacctc

SEQ ID NO: 7365 - DNA, 20 bp, human
gctccctggatcctagggag

SEQ ID NO: 7366 - DNA, 20 bp, human
gggcggaaaccggcaccagg

SEQ ID NO: 7367 - DNA, 20 bp, human
ggctccagctcggcggaaac

SEQ ID NO: 7368 - DNA, 20 bp, human
gtggcccgcgcgctccagct

SEQ ID NO: 7369 - DNA, 20 bp, human
gcccgcgcgctccagctcgg

SEQ ID NO: 7370 - DNA, 20 bp, human
gccgcctgcgccaacaacgt

SEQ ID NO: 7371 - DNA, 20 bp, human
gcgcgggccacggcttctct

SEQ ID NO: 7372 - DNA, 20 bp, human
gcaggagggtcgccgtctcc

SEQ ID NO: 7373 - DNA, 20 bp, human
ggcgcggagagcgtcccgga

SEQ ID NO: 7374 - DNA, 20 bp, human
gccggaaagcgtcccggaga

SEQ ID NO: 7375 - DNA, 20 bp, human
ggctcaaagaaaaaagtctc

SEQ ID NO: 7376 - DNA, 20 bp, human
ggcgcagatactgacaccaa

SEQ ID NO: 7377 - DNA, 20 bp, human
gagggtgcatgtatgtgggt

SEQ ID NO: 7378 - DNA, 20 bp, human
gctgtagggtgcatgtatgt

SEQ ID NO: 7379 - DNA, 20 bp, human
gactgacaccaagggaatcc

SEQ ID NO: 7380 - DNA, 20 bp, human
gagcgccccgggcacagcgc

SEQ ID NO: 7381 - DNA, 20 bp, human
gccaagtgtggataagacaa

SEQ ID NO: 7382 - DNA, 20 bp, human
ggttcagcatcctagaaagg

SEQ ID NO: 7383 - DNA, 20 bp, human
gggcacagcgccggctcggg

SEQ ID NO: 7384 - DNA, 20 bp, human
ggggggcacccggattccct

SEQ ID NO: 7385 - DNA, 20 bp, human
gtggcaagctaaaacaggtt

SEQ ID NO: 7386 - DNA, 20 bp, human
ggcgggtcgcagagagagat

SEQ ID NO: 7387 - DNA, 20 bp, human
gtaccagggttggggagaca

SEQ ID NO: 7388 - DNA, 20 bp, human
gggcgttgcagaatcagctg

SEQ ID NO: 7389 - DNA, 20 bp, human
gggatcagcgtaccagggtt

SEQ ID NO: 7390 - DNA, 20 bp, human
gggaaccgaagcttgcgaag

SEQ ID NO: 7391 - DNA, 20 bp, human
gcaaaggaggagagggccta

SEQ ID NO: 7392 - DNA, 20 bp, human
gcgcaggaagtggaaagtag

SEQ ID NO: 7393 - DNA, 20 bp, human
gccggtctcactccagatga

SEQ ID NO: 7394 - DNA, 20 bp, human
gcgacccgcttcgcaagctt

SEQ ID NO: 7395 - DNA, 20 bp, human
ggccggcgagagttcaccga

SEQ ID NO: 7396 - DNA, 20 bp, human
ggaccctctgtgcggcccta

SEQ ID NO: 7397 - DNA, 20 bp, human
gcagctcagacggcgcccta

SEQ ID NO: 7398 - DNA, 20 bp, human
ggccgggaggaggacatcga

SEQ ID NO: 7399 - DNA, 20 bp, human
gcgcggagtccaagccccag

SEQ ID NO: 7400 - DNA, 20 bp, human
gaaccgagaaccagtgggaa

SEQ ID NO: 7401 - DNA, 20 bp, human
gactggaaccgagaaccagt

SEQ ID NO: 7402 - DNA, 20 bp, human
ggcgctttcaaacctctctc

SEQ ID NO: 7403 - DNA, 20 bp, human
gacagagggtcgggcagtgc

SEQ ID NO: 7404 - DNA, 20 bp, human
ggtcgggcagtgccggagag

SEQ ID NO: 7405 - DNA, 20 bp, human
gggcggaacccgcatccccg

SEQ ID NO: 7406 - DNA, 20 bp, human
gggaggtgaatcagtaacag

SEQ ID NO: 7407 - DNA, 20 bp, human
ggcaggaggaagcgagctca

SEQ ID NO: 7408 - DNA, 20 bp, human
gagcgagctcaaggcgctgt

SEQ ID NO: 7409 - DNA, 20 bp, human
gtcaaggcgctgtcggagaa

SEQ ID NO: 7410 - DNA, 20 bp, human
gtcctcccacccaaggaaag

SEQ ID NO: 7411 - DNA, 20 bp, human
ggaaacgcgcctggttccag

SEQ ID NO: 7412 - DNA, 20 bp, human
gaggagacgcgtagctggta

SEQ ID NO: 7413 - DNA, 20 bp, human
gttcttgcaagtcaatacca

SEQ ID NO: 7414 - DNA, 20 bp, human
gctgaggtcgtcctggaaaa

SEQ ID NO: 7415 - DNA, 20 bp, human
gcgcgcctggttccaggggt

SEQ ID NO: 7416 - DNA, 20 bp, human
gctgcgcagccccagacctc

SEQ ID NO: 7417 - DNA, 20 bp, human
gcggccgaagaccaagccgg

SEQ ID NO: 7418 - DNA, 20 bp, human
gagcgaggccacctgggtcc

SEQ ID NO: 7419 - DNA, 20 bp, human
gcctatagcctggacccagg

SEQ ID NO: 7420 - DNA, 20 bp, human
gtcgccgagcgaggccacct

SEQ ID NO: 7421 - DNA, 20 bp, human
gcaggtaagcgcacccccag

SEQ ID NO: 7422 - DNA, 20 bp, human
gaacccgcagctgcaggtag

SEQ ID NO: 7423 - DNA, 20 bp, human
gcagccccagacctccggct

SEQ ID NO: 7424 - DNA, 20 bp, human
gagccggccgaagaccaagc

SEQ ID NO: 7425 - DNA, 20 bp, human
gagctgctctcggcgccagc

SEQ ID NO: 7426 - DNA, 20 bp, human
ggcagttgcgacagagtgtg

SEQ ID NO: 7427 - DNA, 20 bp, human
gccgggaggcagccagccta

SEQ ID NO: 7428 - DNA, 20 bp, human
gcgctctggagcaagacctg

SEQ ID NO: 7429 - DNA, 20 bp, human
gctgctctaccaagccacag

SEQ ID NO: 7430 - DNA, 20 bp, human
ggggctgctgacaaatgaac

SEQ ID NO: 7431 - DNA, 20 bp, human
gccagagcagcggtctccga

SEQ ID NO: 7432 - DNA, 20 bp, human
ggcctgcccgcagacctagt

SEQ ID NO: 7433 - DNA, 20 bp, human
gggtgcctggctccctacac

SEQ ID NO: 7434 - DNA, 20 bp, human
gggcaacacgagaaaactcg

SEQ ID NO: 7435 - DNA, 20 bp, human
gtcccggtgccgatccacca

SEQ ID NO: 7436 - DNA, 20 bp, human
gtgccgtcttccataatcgt

SEQ ID NO: 7437 - DNA, 20 bp, human
gagccgacgattatggaaga

SEQ ID NO: 7438 - DNA, 20 bp, human
gggaagacggcaagcgggag

SEQ ID NO: 7439 - DNA, 20 bp, human
ggattatggaagacggcaag

SEQ ID NO: 7440 - DNA, 20 bp, human
gcagccagcgcaccacttgt

SEQ ID NO: 7441 - DNA, 20 bp, human
gccagcgcaccacttgtagg

SEQ ID NO: 7442 - DNA, 20 bp, human
ggcgctgagagtctgtgcgg

SEQ ID NO: 7443 - DNA, 20 bp, human
gctgcagtgccgcctacaag

SEQ ID NO: 7444 - DNA, 20 bp, human
ggcgacgcagtggcgaagtg

SEQ ID NO: 7445 - DNA, 20 bp, human
ggctagggggtgcccggctg

SEQ ID NO: 7446 - DNA, 20 bp, human
gccttgtcatccataatggt

SEQ ID NO: 7447 - DNA, 20 bp, human
gggctccttgtcatccataa

SEQ ID NO: 7448 - DNA, 20 bp, human
gggatgacaaggagccgaag

SEQ ID NO: 7449 - DNA, 20 bp, human
ggaagccatccgagcacaag

SEQ ID NO: 7450 - DNA, 20 bp, human
gtgacaaggagccgaagagg

SEQ ID NO: 7451 - DNA, 20 bp, human
ggctgtcttctatcgtgatc

SEQ ID NO: 7452 - DNA, 20 bp, human
ggtcttctatcgtgatctgg

SEQ ID NO: 7453 - DNA, 20 bp, human
gattaaaccgtatcatctga

SEQ ID NO: 7454 - DNA, 20 bp, human
gggcgggaggacgggatctg

SEQ ID NO: 7455 - DNA, 20 bp, human
gcgagcacaagcggtccctg

SEQ ID NO: 7456 - DNA, 20 bp, human
gtcgggcgtaaccggagctg

SEQ ID NO: 7457 - DNA, 20 bp, human
gcgcgaggccatccgccgat

SEQ ID NO: 7458 - DNA, 20 bp, human
gagtccttggaagtgcagag

SEQ ID NO: 7459 - DNA, 20 bp, human
ggcagcagcgcagtgcacag

SEQ ID NO: 7460 - DNA, 20 bp, human
gcccgagggcccctccacaa

SEQ ID NO: 7461 - DNA, 20 bp, human
ggtgcgcagggtaagtcagt

SEQ ID NO: 7462 - DNA, 20 bp, human
gcacccgcggggccggacag

SEQ ID NO: 7463 - DNA, 20 bp, human
gcggcgagcgcgaactcgag

SEQ ID NO: 7464 - DNA, 20 bp, human
ggagaggccgcagcacgctg

SEQ ID NO: 7465 - DNA, 20 bp, human
gcggccgggtccgctctccc

SEQ ID NO: 7466 - DNA, 20 bp, human
gcgtcccccgctactcggga

SEQ ID NO: 7467 - DNA, 20 bp, human
gggccgaggcgtcgccatcc

SEQ ID NO: 7468 - DNA, 20 bp, human
gggagcagaatctgcaccag

SEQ ID NO: 7469 - DNA, 20 bp, human
gagcagggcccgtccgcgca

SEQ ID NO: 7470 - DNA, 20 bp, human
ggcattgcacccaacctgag

SEQ ID NO: 7471 - DNA, 20 bp, human
gggcggatcgactgacgccg

SEQ ID NO: 7472 - DNA, 20 bp, human
ggcgacgcctcggccctgcg

SEQ ID NO: 7473 - DNA, 20 bp, human
ggcgtcagtcgatccgcccc

SEQ ID NO: 7474 - DNA, 20 bp, human
ggcctcggccctgcgcggac

SEQ ID NO: 7475 - DNA, 20 bp, human
gcggcccaaggaggaggcgt

SEQ ID NO: 7476 - DNA, 20 bp, human
ggcagccggtcggaaggcgt

SEQ ID NO: 7477 - DNA, 20 bp, human
gcgggggaggcctagggtca

SEQ ID NO: 7478 - DNA, 20 bp, human
gcccggagccggccttcggg

SEQ ID NO: 7479 - DNA, 20 bp, human
gtagggtcagggcagccggt

SEQ ID NO: 7480 - DNA, 20 bp, human
gagggcaccagagtcccagt

SEQ ID NO: 7481 - DNA, 20 bp, human
ggtcagggcagccggtcgga

SEQ ID NO: 7482 - DNA, 20 bp, human
gcacactgaacagggtcccc

SEQ ID NO: 7483 - DNA, 20 bp, human
gggagggagcggaagtcccg

SEQ ID NO: 7484 - DNA, 20 bp, human
gtgccccgagtggaccacgt

SEQ ID NO: 7485 - DNA, 20 bp, human
gctgccccacgccttccgac

SEQ ID NO: 7486 - DNA, 20 bp, human
ggactccgagaaagtaccag

SEQ ID NO: 7487 - DNA, 20 bp, human
gccgagaaagtaccagcgga

SEQ ID NO: 7488 - DNA, 20 bp, human
ggcgactcctctggtgtgag

SEQ ID NO: 7489 - DNA, 20 bp, human
gtcctgcagcgaccctggag

SEQ ID NO: 7490 - DNA, 20 bp, human
ggaacagccagagaagaccg

SEQ ID NO: 7491 - DNA, 20 bp, human
gtccctcccaaggaccactg

SEQ ID NO: 7492 - DNA, 20 bp, human
gtccctgcgaatcgccgtag

SEQ ID NO: 7493 - DNA, 20 bp, human
gaggaagtaagtggagaccg

SEQ ID NO: 7494 - DNA, 20 bp, human
gcactgccgcagcgtctcta

SEQ ID NO: 7495 - DNA, 20 bp, human
gaccaaactaccgactccag

SEQ ID NO: 7496 - DNA, 20 bp, human
gaggctgtgagcagaagcta

SEQ ID NO: 7497 - DNA, 20 bp, human
gagagacggatggaatggta

SEQ ID NO: 7498 - DNA, 20 bp, human
gcaggtagagacggatggaa

SEQ ID NO: 7499 - DNA, 20 bp, human
gagggagcctgaacatacac

SEQ ID NO: 7500 - DNA, 20 bp, human
gttaaacaggtagagacgga

SEQ ID NO: 7501 - DNA, 20 bp, human
gtcccttgatgaggttacca

SEQ ID NO: 7502 - DNA, 20 bp, human
gcaccttggtaacctcatca

SEQ ID NO: 7503 - DNA, 20 bp, human
gccagaccagcctagacaca

SEQ ID NO: 7504 - DNA, 20 bp, human
gcagctagaatgtaaggcac

SEQ ID NO: 7505 - DNA, 20 bp, human
ggtggtttcaccatgtgtct

SEQ ID NO: 7506 - DNA, 20 bp, human
gtggttcaggcaatcttcag

SEQ ID NO: 7507 - DNA, 20 bp, human
gagattgcctgaaccaatgg

SEQ ID NO: 7508 - DNA, 20 bp, human
gatcttcagcggtgatccag

SEQ ID NO: 7509 - DNA, 20 bp, human
gtgagcatccggatctcctc

SEQ ID NO: 7510 - DNA, 20 bp, human
gactctggtaagagatactg

SEQ ID NO: 7511 - DNA, 20 bp, human
ggctgcaaacacaagagaat

SEQ ID NO: 7512 - DNA, 20 bp, human
gttgcagccaccattggttc

SEQ ID NO: 7513 - DNA, 20 bp, human
gaccagatatcaagagtcca

SEQ ID NO: 7514 - DNA, 20 bp, human
gaccatggactcttgatatc

SEQ ID NO: 7515 - DNA, 20 bp, human
gtactcaggccctgttagcc

SEQ ID NO: 7516 - DNA, 20 bp, human
gccgggtgtggtgagtctag

SEQ ID NO: 7517 - DNA, 20 bp, human
ggccgttgctatggtaaccg

SEQ ID NO: 7518 - DNA, 20 bp, human
gggatcgcagaaggtcccta

SEQ ID NO: 7519 - DNA, 20 bp, human
ggttgctatggtaaccgagg

SEQ ID NO: 7520 - DNA, 20 bp, human
gaccccgccggcagccgcaa

SEQ ID NO: 7521 - DNA, 20 bp, human
gctcaaggagaaggacccca

SEQ ID NO: 7522 - DNA, 20 bp, human
gcaggccgaagagcaaactc

SEQ ID NO: 7523 - DNA, 20 bp, human
gcctgcccgagcagcctgga

SEQ ID NO: 7524 - DNA, 20 bp, human
gagcaacggcgcaacacgcg

SEQ ID NO: 7525 - DNA, 20 bp, human
gtgccggcggggtaggagac

SEQ ID NO: 7526 - DNA, 20 bp, human
ggaacgagcagcagcgacag

SEQ ID NO: 7527 - DNA, 20 bp, human
gtacttggcccggggcctgt

SEQ ID NO: 7528 - DNA, 20 bp, human
ggacagcggcagcttcaagg

SEQ ID NO: 7529 - DNA, 20 bp, human
gtagcccaggcgctgcccac

SEQ ID NO: 7530 - DNA, 20 bp, human
gcggtgcaggagatatcaag

SEQ ID NO: 7531 - DNA, 20 bp, human
gtgtggtccggggaacccct

SEQ ID NO: 7532 - DNA, 20 bp, human
gtggctcgcggttaatcggg

SEQ ID NO: 7533 - DNA, 20 bp, human
gacctccagtgctacaggga

SEQ ID NO: 7534 - DNA, 20 bp, human
ggcttcaaggaggcggtgac

SEQ ID NO: 7535 - DNA, 20 bp, human
gtcaaggaggcggtgacggg

SEQ ID NO: 7536 - DNA, 20 bp, human
ggccgtaaacctgaattccg

SEQ ID NO: 7537 - DNA, 20 bp, human
ggcaggctaggagacgaacc

SEQ ID NO: 7538 - DNA, 20 bp, human
gcgggaagagcgggccgagt

SEQ ID NO: 7539 - DNA, 20 bp, human
gccggaagtgagatgcaagg

SEQ ID NO: 7540 - DNA, 20 bp, human
gaaaagcgaggtccgggaca

SEQ ID NO: 7541 - DNA, 20 bp, human
gcccttcaatggaactgaaa

SEQ ID NO: 7542 - DNA, 20 bp, human
gttgaagggtccttgatcta

SEQ ID NO: 7543 - DNA, 20 bp, human
gcgaggttccagttaactct

SEQ ID NO: 7544 - DNA, 20 bp, human
gccaccagccgggagctcac

SEQ ID NO: 7545 - DNA, 20 bp, human
gtgaattccgcgggagagaa

SEQ ID NO: 7546 - DNA, 20 bp, human
ggactgagagtccctaacag

SEQ ID NO: 7547 - DNA, 20 bp, human
gagggaagagggcaaatctg

SEQ ID NO: 7548 - DNA, 20 bp, human
gctgctgggaaagctggaac

SEQ ID NO: 7549 - DNA, 20 bp, human
gtggggccgaggtaaccggg

SEQ ID NO: 7550 - DNA, 20 bp, human
ggctcccacccggccgacgg

SEQ ID NO: 7551 - DNA, 20 bp, human
ggcaccgccgtcggccgggt

SEQ ID NO: 7552 - DNA, 20 bp, human
gtcagggcagtaactgtctc

SEQ ID NO: 7553 - DNA, 20 bp, human
gacggcggtgcgagggaaga

SEQ ID NO: 7554 - DNA, 20 bp, human
gcgaggggtcgcctcccggt

SEQ ID NO: 7555 - DNA, 20 bp, human
ggttactgccctgacggcgg

SEQ ID NO: 7556 - DNA, 20 bp, human
gggccgctccgtgtccccgg

SEQ ID NO: 7557 - DNA, 20 bp, human
gggcggctccaccggggaca

SEQ ID NO: 7558 - DNA, 20 bp, human
gctccaccggggacacggag

SEQ ID NO: 7559 - DNA, 20 bp, human
ggtccgcatcgagctcccgg

SEQ ID NO: 7560 - DNA, 20 bp, human
gcgccgccgggagctcgatg

SEQ ID NO: 7561 - DNA, 20 bp, human
gctagagtggagcccctcca

SEQ ID NO: 7562 - DNA, 20 bp, human
gagatggcctggaccagggg

SEQ ID NO: 7563 - DNA, 20 bp, human
gcggagcggaaccggtgtgg

SEQ ID NO: 7564 - DNA, 20 bp, human
ggtgatgctgaggatcccca

SEQ ID NO: 7565 - DNA, 20 bp, human
ggcctaggccgcacatcccc

SEQ ID NO: 7566 - DNA, 20 bp, human
gtgaggtggtctgcgaggtc

SEQ ID NO: 7567 - DNA, 20 bp, human
ggccccgcgatggcctccgc

SEQ ID NO: 7568 - DNA, 20 bp, human
gcacggcctaggcacctctc

SEQ ID NO: 7569 - DNA, 20 bp, human
gtggcccccgcctggctggt

SEQ ID NO: 7570 - DNA, 20 bp, human
gtgcccgcggaggccatcgc

SEQ ID NO: 7571 - DNA, 20 bp, human
ggcgggcgggctccggaagc

SEQ ID NO: 7572 - DNA, 20 bp, human
gtggtctgcgaggtcgggca

SEQ ID NO: 7573 - DNA, 20 bp, human
gaccactccgagcagcgtag

SEQ ID NO: 7574 - DNA, 20 bp, human
ggctgcagggagcgagaacc

SEQ ID NO: 7575 - DNA, 20 bp, human
gggctgtgggcaacgtggaa

SEQ ID NO: 7576 - DNA, 20 bp, human
gctgacagcacgactcaggg

SEQ ID NO: 7577 - DNA, 20 bp, human
gtcgctgacagcacgactca

SEQ ID NO: 7578 - DNA, 20 bp, human
gcggagggaagtaggtccgt

SEQ ID NO: 7579 - DNA, 20 bp, human
gctcgttcccgaccgaccaa

SEQ ID NO: 7580 - DNA, 20 bp, human
gactcagggcggagggaagt

SEQ ID NO: 7581 - DNA, 20 bp, human
gaccggcggctcgggcccac

SEQ ID NO: 7582 - DNA, 20 bp, human
ggtaggtccgttggtcggtc

SEQ ID NO: 7583 - DNA, 20 bp, human
gcagcacgactcagggcgga

SEQ ID NO: 7584 - DNA, 20 bp, human
ggggaagtaggtccgttggt

SEQ ID NO: 7585 - DNA, 20 bp, human
gggctcaggccgagacagag

SEQ ID NO: 7586 - DNA, 20 bp, human
gagcatccaggtctctagag

SEQ ID NO: 7587 - DNA, 20 bp, human
gtgggtgagtgaggattcac

SEQ ID NO: 7588 - DNA, 20 bp, human
gagccgaatgcgaactgcat

SEQ ID NO: 7589 - DNA, 20 bp, human
gaaatctgaatgggtgagtg

SEQ ID NO: 7590 - DNA, 20 bp, human
ggaaggggtgctgaaatcca

SEQ ID NO: 7591 - DNA, 20 bp, human
ggagctgcaggttgttgtca

SEQ ID NO: 7592 - DNA, 20 bp, human
gggccacctgccttggatct

SEQ ID NO: 7593 - DNA, 20 bp, human
gcaccaacagaaatctgaat

SEQ ID NO: 7594 - DNA, 20 bp, human
ggctttgcacatgctctgtc

SEQ ID NO: 7595 - DNA, 20 bp, human
gagaatggcaaaaagcatcc

SEQ ID NO: 7596 - DNA, 20 bp, human
gcaagcgagcaggagaacga

SEQ ID NO: 7597 - DNA, 20 bp, human
gtcggccacaggtaacccgc

SEQ ID NO: 7598 - DNA, 20 bp, human
gatggaacttcgggcgaggg

SEQ ID NO: 7599 - DNA, 20 bp, human
gctggaggcacggcgctggg

SEQ ID NO: 7600 - DNA, 20 bp, human
ggcgcgggcggctggaggca

SEQ ID NO: 7601 - DNA, 20 bp, human
ggcagcgctctcggctcctg

SEQ ID NO: 7602 - DNA, 20 bp, human
gggctcctgcgggttacctg

SEQ ID NO: 7603 - DNA, 20 bp, human
gcaactgatgccaggcgaag

SEQ ID NO: 7604 - DNA, 20 bp, human
gcgacctgaggcgcccaccc

SEQ ID NO: 7605 - DNA, 20 bp, human
gcccgaagttccatattcca

SEQ ID NO: 7606 - DNA, 20 bp, human
gaggagctggacctgatggt

SEQ ID NO: 7607 - DNA, 20 bp, human
gcgcaggacgaagacgtcag

SEQ ID NO: 7608 - DNA, 20 bp, human
gagacgtcaggggccaagtc

SEQ ID NO: 7609 - DNA, 20 bp, human
gaccgtgcgggagctcaaag

SEQ ID NO: 7610 - DNA, 20 bp, human
gctgtggccaggaccctaag

SEQ ID NO: 7611 - DNA, 20 bp, human
gggctccagtacctcgacga

SEQ ID NO: 7612 - DNA, 20 bp, human
gagattgggaagtccctctg

SEQ ID NO: 7613 - DNA, 20 bp, human
gggtgcggctggaggagacg

SEQ ID NO: 7614 - DNA, 20 bp, human
ggagtccgccgagcccaccc

SEQ ID NO: 7615 - DNA, 20 bp, human
ggcaggagccaccttcgtcg

SEQ ID NO: 7616 - DNA, 20 bp, human
gtgtgtgacatgtgtagggg

SEQ ID NO: 7617 - DNA, 20 bp, human
gtaagggccgtgagcttagt

SEQ ID NO: 7618 - DNA, 20 bp, human
gttgtgtgtgacatgtgtag

SEQ ID NO: 7619 - DNA, 20 bp, human
gatggtcttccagtcacaca

SEQ ID NO: 7620 - DNA, 20 bp, human
gagttgggcagaatggtgat

SEQ ID NO: 7621 - DNA, 20 bp, human
ggaagactgcactacgatcg

SEQ ID NO: 7622 - DNA, 20 bp, human
gcttccagtcacacagggtc

SEQ ID NO: 7623 - DNA, 20 bp, human
gtctcatggggaatataacc

SEQ ID NO: 7624 - DNA, 20 bp, human
gggtgaacccactaagctca

SEQ ID NO: 7625 - DNA, 20 bp, human
ggcagatgggccatcttcca

SEQ ID NO: 7626 - DNA, 20 bp, human
ggagacgcatggctacctgg

SEQ ID NO: 7627 - DNA, 20 bp, human
gaaatcccgggtaccgagtc

SEQ ID NO: 7628 - DNA, 20 bp, human
gggaagaatcgtgacaagga

SEQ ID NO: 7629 - DNA, 20 bp, human
gggacaagaagaacaggtaa

SEQ ID NO: 7630 - DNA, 20 bp, human
gggaggaggcctggggatat

SEQ ID NO: 7631 - DNA, 20 bp, human
gtctgccggactcggtaccc

SEQ ID NO: 7632 - DNA, 20 bp, human
gggtaggggagatacggtgt

SEQ ID NO: 7633 - DNA, 20 bp, human
gcgacagggacaagaagaac

SEQ ID NO: 7634 - DNA, 20 bp, human
gtttcggggtaggggagata

SEQ ID NO: 7635 - DNA, 20 bp, human
gaggatggcttctcaaatcc

SEQ ID NO: 7636 - DNA, 20 bp, human
gccgcggggcgcgagaacag

SEQ ID NO: 7637 - DNA, 20 bp, human
gggagcggcgcgccccgcca

SEQ ID NO: 7638 - DNA, 20 bp, human
gcgctcccccgcagcgacgg

SEQ ID NO: 7639 - DNA, 20 bp, human
gtgccactcacccgcaccca

SEQ ID NO: 7640 - DNA, 20 bp, human
gtggaggcaggcgtgcacgg

SEQ ID NO: 7641 - DNA, 20 bp, human
ggcctggcagttccgcacgg

SEQ ID NO: 7642 - DNA, 20 bp, human
ggaacaggggcgcccccgtg

SEQ ID NO: 7643 - DNA, 20 bp, human
gccccgctcccccgcagcga

SEQ ID NO: 7644 - DNA, 20 bp, human
gagaggtatcagagcgcggg

SEQ ID NO: 7645 - DNA, 20 bp, human
gtggcccgccaccagacgtc

SEQ ID NO: 7646 - DNA, 20 bp, human
gccttctgcaggctttgggg

SEQ ID NO: 7647 - DNA, 20 bp, human
ggtgcacctctcctccacgc

SEQ ID NO: 7648 - DNA, 20 bp, human
gtgctccaggccgtgtggag

SEQ ID NO: 7649 - DNA, 20 bp, human
gctgctgctgaaaagctgaa

SEQ ID NO: 7650 - DNA, 20 bp, human
gccctctgtcctggttccca

SEQ ID NO: 7651 - DNA, 20 bp, human
gaagtggtaactggaatggg

SEQ ID NO: 7652 - DNA, 20 bp, human
gtggcctgggacacggctgg

SEQ ID NO: 7653 - DNA, 20 bp, human
gcctggtgacgcagctgctg

SEQ ID NO: 7654 - DNA, 20 bp, human
gggccagaacccgtctacag

SEQ ID NO: 7655 - DNA, 20 bp, human
gatggagctggactccgaag

SEQ ID NO: 7656 - DNA, 20 bp, human
gggacggggctacaccggag

SEQ ID NO: 7657 - DNA, 20 bp, human
gggcgggacgtacctgggag

SEQ ID NO: 7658 - DNA, 20 bp, human
gcggagggcgggacgtacct

SEQ ID NO: 7659 - DNA, 20 bp, human
gcgcgggtggacgcccggga

SEQ ID NO: 7660 - DNA, 20 bp, human
gggactcttagggggaaaag

SEQ ID NO: 7661 - DNA, 20 bp, human
ggcccgctgcccaggaacgg

SEQ ID NO: 7662 - DNA, 20 bp, human
ggccgctgcggggacagaag

SEQ ID NO: 7663 - DNA, 20 bp, human
gccacgggacggggctacac

SEQ ID NO: 7664 - DNA, 20 bp, human
gtgttgtgaggccgaaccca

SEQ ID NO: 7665 - DNA, 20 bp, human
gcgtcccgtggagaccaggg

SEQ ID NO: 7666 - DNA, 20 bp, human
gtggcatggacacaacactc

SEQ ID NO: 7667 - DNA, 20 bp, human
gacaggcagtcctaaccatc

SEQ ID NO: 7668 - DNA, 20 bp, human
gatggacacaacactccgga

SEQ ID NO: 7669 - DNA, 20 bp, human
gcacaacactccggatggtt

SEQ ID NO: 7670 - DNA, 20 bp, human
gcacaaggattggttactaa

SEQ ID NO: 7671 - DNA, 20 bp, human
ggtgcctctaccagaaagat

SEQ ID NO: 7672 - DNA, 20 bp, human
gctgtcttgtgtgaaatttg

SEQ ID NO: 7673 - DNA, 20 bp, human
gggagtcagtttccatggca

SEQ ID NO: 7674 - DNA, 20 bp, human
gatgctttcacaactccaaa

SEQ ID NO: 7675 - DNA, 20 bp, human
gtttcctatctttctggtag

SEQ ID NO: 7676 - DNA, 20 bp, human
gctctgccctggcatccggc

SEQ ID NO: 7677 - DNA, 20 bp, human
gggctgccggccggatgcca

SEQ ID NO: 7678 - DNA, 20 bp, human
ggagattgtctggtaaccat

SEQ ID NO: 7679 - DNA, 20 bp, human
gccagaaataagacaagtgg

SEQ ID NO: 7680 - DNA, 20 bp, human
gagagccagcgcgggaggac

SEQ ID NO: 7681 - DNA, 20 bp, human
gctttcgtcaggtactggag

SEQ ID NO: 7682 - DNA, 20 bp, human
gttccactttcgtcaggtac

SEQ ID NO: 7683 - DNA, 20 bp, human
gctgacgaaagtggaaatgc

SEQ ID NO: 7684 - DNA, 20 bp, human
gccgtaactgccataacggc

SEQ ID NO: 7685 - DNA, 20 bp, human
gctcgcgcagccggccgtta

SEQ ID NO: 7686 - DNA, 20 bp, human
gccaagcacgccggctctag

SEQ ID NO: 7687 - DNA, 20 bp, human
gagcacgccggctctagcgg

SEQ ID NO: 7688 - DNA, 20 bp, human
gcagatgctgaggcgttcaa

SEQ ID NO: 7689 - DNA, 20 bp, human
gtgtggcagcacatctccaa

SEQ ID NO: 7690 - DNA, 20 bp, human
gtggtctttgctaggtctgg

SEQ ID NO: 7691 - DNA, 20 bp, human
gtgctgaggcgttcaaagga

SEQ ID NO: 7692 - DNA, 20 bp, human
gacgccggctctagcggtgg

SEQ ID NO: 7693 - DNA, 20 bp, human
gagaatatgctccggaactg

SEQ ID NO: 7694 - DNA, 20 bp, human
gatgcgcagaccaagcacgc

SEQ ID NO: 7695 - DNA, 20 bp, human
gtgaggcgttcaaaggaagg

SEQ ID NO: 7696 - DNA, 20 bp, human
gccgcggctcgtgaataagg

SEQ ID NO: 7697 - DNA, 20 bp, human
gccgcggccggatcgcaggg

SEQ ID NO: 7698 - DNA, 20 bp, human
ggcaccgccgccctgcgatc

SEQ ID NO: 7699 - DNA, 20 bp, human
ggactctgcccggtgacgtg

SEQ ID NO: 7700 - DNA, 20 bp, human
gaagggggttgggccatcga

SEQ ID NO: 7701 - DNA, 20 bp, human
gccacgacggacgcacggga

SEQ ID NO: 7702 - DNA, 20 bp, human
gtcggcctccccacgtcacc

SEQ ID NO: 7703 - DNA, 20 bp, human
ggacggggactcaccatggg

SEQ ID NO: 7704 - DNA, 20 bp, human
ggcctgcacggccagacgtc

SEQ ID NO: 7705 - DNA, 20 bp, human
ggcggctcagagcgcggctg

SEQ ID NO: 7706 - DNA, 20 bp, human
ggctgcagccgagcctgctc

SEQ ID NO: 7707 - DNA, 20 bp, human
gggcaacgcaccccccaaac

SEQ ID NO: 7708 - DNA, 20 bp, human
gcgcgggccagggtaccgga

SEQ ID NO: 7709 - DNA, 20 bp, human
gtggggacccaagagacggg

SEQ ID NO: 7710 - DNA, 20 bp, human
gctctccagtctgctcaggt

SEQ ID NO: 7711 - DNA, 20 bp, human
gggggtgcgttgcccggaga

SEQ ID NO: 7712 - DNA, 20 bp, human
gtgtccccagccggtttggg

SEQ ID NO: 7713 - DNA, 20 bp, human
gcccggctgcgaagaatggt

SEQ ID NO: 7714 - DNA, 20 bp, human
ggcccggagacggaaagttt

SEQ ID NO: 7715 - DNA, 20 bp, human
gcaggacccccgatctctct

SEQ ID NO: 7716 - DNA, 20 bp, human
ggactgcgtgtatggagagg

SEQ ID NO: 7717 - DNA, 20 bp, human
gaagctgcgccccgaagagg

SEQ ID NO: 7718 - DNA, 20 bp, human
gaccaggtgcaataaccgtg

SEQ ID NO: 7719 - DNA, 20 bp, human
gagaaggtaggagccaccga

SEQ ID NO: 7720 - DNA, 20 bp, human
gacagactgcgtgtatggag

SEQ ID NO: 7721 - DNA, 20 bp, human
gtggtggagaaactcctgtc

SEQ ID NO: 7722 - DNA, 20 bp, human
gaatctgctaaggtaaggac

SEQ ID NO: 7723 - DNA, 20 bp, human
gaggcatcaatctgactggg

SEQ ID NO: 7724 - DNA, 20 bp, human
gtttgtgggatcataaccca

SEQ ID NO: 7725 - DNA, 20 bp, human
gaggtgcaataaccgtgagg

SEQ ID NO: 7726 - DNA, 20 bp, human
gactgtcacgcccacagagg

SEQ ID NO: 7727 - DNA, 20 bp, human
gggcgacggcagcccgaggg

SEQ ID NO: 7728 - DNA, 20 bp, human
gccgtggaaccgcatcgcaa

SEQ ID NO: 7729 - DNA, 20 bp, human
ggttggcgacggcagcccga

SEQ ID NO: 7730 - DNA, 20 bp, human
gtggcggcgagctgtttggg

SEQ ID NO: 7731 - DNA, 20 bp, human
gcatccccacaggaacgcta

SEQ ID NO: 7732 - DNA, 20 bp, human
gagcgtggcggcgagctgtt

SEQ ID NO: 7733 - DNA, 20 bp, human
gcttccggggcgggtgccgg

SEQ ID NO: 7734 - DNA, 20 bp, human
gcctcccgcaactacttccg

SEQ ID NO: 7735 - DNA, 20 bp, human
gcaggtgccggcaagtgctg

SEQ ID NO: 7736 - DNA, 20 bp, human
gtccaggcagagcaaggtgt

SEQ ID NO: 7737 - DNA, 20 bp, human
gctctgcctggagagacatc

SEQ ID NO: 7738 - DNA, 20 bp, human
gcttggccagatgtctctcc

SEQ ID NO: 7739 - DNA, 20 bp, human
gaggactggcactataggag

SEQ ID NO: 7740 - DNA, 20 bp, human
gatcccttagccacaatcag

SEQ ID NO: 7741 - DNA, 20 bp, human
ggagacatctggccaagttc

SEQ ID NO: 7742 - DNA, 20 bp, human
gggtaggctgccaagagagt

SEQ ID NO: 7743 - DNA, 20 bp, human
gcaaggaagagtgtcaccag

SEQ ID NO: 7744 - DNA, 20 bp, human
gactatcactagcagcttgg

SEQ ID NO: 7745 - DNA, 20 bp, human
gcactgaggactggcactat

SEQ ID NO: 7746 - DNA, 20 bp, human
gtcatgcaggcggccaggtg

SEQ ID NO: 7747 - DNA, 20 bp, human
gcgggggcccgggaccagag

SEQ ID NO: 7748 - DNA, 20 bp, human
ggagcgcgctccagccgtag

SEQ ID NO: 7749 - DNA, 20 bp, human
ggcctgcgggcggtatccgg

SEQ ID NO: 7750 - DNA, 20 bp, human
gccagcgccgggcaccactc

SEQ ID NO: 7751 - DNA, 20 bp, human
gcctcgtccgagcaatccac

SEQ ID NO: 7752 - DNA, 20 bp, human
gcggcggcgatgggcgaggg

SEQ ID NO: 7753 - DNA, 20 bp, human
ggcagcaggaagcgcaccag

SEQ ID NO: 7754 - DNA, 20 bp, human
ggcgtgtgaccagggcgaca

SEQ ID NO: 7755 - DNA, 20 bp, human
gtgctgcgcgcgtgtgacca

SEQ ID NO: 7756 - DNA, 20 bp, human
gggacaaaaatgatagccag

SEQ ID NO: 7757 - DNA, 20 bp, human
ggattgggatgcactagcac

SEQ ID NO: 7758 - DNA, 20 bp, human
gtttcaaagattctcctgga

SEQ ID NO: 7759 - DNA, 20 bp, human
gtgtcactgtctagcctcaa

SEQ ID NO: 7760 - DNA, 20 bp, human
gggaatttttctagccatcc

SEQ ID NO: 7761 - DNA, 20 bp, human
gcctgatactgtggcactgt

SEQ ID NO: 7762 - DNA, 20 bp, human
ggcaaacttgacaatggttg

SEQ ID NO: 7763 - DNA, 20 bp, human
gttgctggtttccgtaatat

SEQ ID NO: 7764 - DNA, 20 bp, human
gtttccgtaatataggaata

SEQ ID NO: 7765 - DNA, 20 bp, human
gactttttcaaagattctcc

SEQ ID NO: 7766 - DNA, 20 bp, human
gaaacgtcccgggagctgag

SEQ ID NO: 7767 - DNA, 20 bp, human
ggagcggctcgcaagtcctc

SEQ ID NO: 7768 - DNA, 20 bp, human
gaaatccggcaatcgacctg

SEQ ID NO: 7769 - DNA, 20 bp, human
ggaagacgcaccaaacgtcc

SEQ ID NO: 7770 - DNA, 20 bp, human
ggagcagcgaagaggacaac

SEQ ID NO: 7771 - DNA, 20 bp, human
gaggcaggagacgcagcagt

SEQ ID NO: 7772 - DNA, 20 bp, human
ggagatcgacgcaggagccg

SEQ ID NO: 7773 - DNA, 20 bp, human
gttgttgtgttgcagaaatc

SEQ ID NO: 7774 - DNA, 20 bp, human
ggtgcaggagaaaccaagtc

SEQ ID NO: 7775 - DNA, 20 bp, human
gtcactacggagcagcgaag

SEQ ID NO: 7776 - DNA, 20 bp, human
gcagaggccgagtccgtcac

SEQ ID NO: 7777 - DNA, 20 bp, human
gagggacatggtaaaaacgg

SEQ ID NO: 7778 - DNA, 20 bp, human
gcactggaagccgagaggag

SEQ ID NO: 7779 - DNA, 20 bp, human
gggagaggacagctggttgt

SEQ ID NO: 7780 - DNA, 20 bp, human
gcccagaggttgacagagga

SEQ ID NO: 7781 - DNA, 20 bp, human
ggtcctacagataaaactca

SEQ ID NO: 7782 - DNA, 20 bp, human
gctacagataaaactcaggg

SEQ ID NO: 7783 - DNA, 20 bp, human
ggtgtctcctggaaaaaacc

SEQ ID NO: 7784 - DNA, 20 bp, human
gaccagctgtcctctcctct

SEQ ID NO: 7785 - DNA, 20 bp, human
gaaaccaggagtctgaggcg

SEQ ID NO: 7786 - DNA, 20 bp, human
gtcggctacctgccgtccga

SEQ ID NO: 7787 - DNA, 20 bp, human
gtctgcgccatcgaggacat

SEQ ID NO: 7788 - DNA, 20 bp, human
gcccgaagccgcctcacccg

SEQ ID NO: 7789 - DNA, 20 bp, human
gtccgagggcacggtgagtg

SEQ ID NO: 7790 - DNA, 20 bp, human
gcgcacaggcggccacgatg

SEQ ID NO: 7791 - DNA, 20 bp, human
gggcgtccaagttcctgacc

SEQ ID NO: 7792 - DNA, 20 bp, human
gtacctgccgtccgagggca

SEQ ID NO: 7793 - DNA, 20 bp, human
ggagcgcgccgcgaacgctg

SEQ ID NO: 7794 - DNA, 20 bp, human
gcggcgcgatcggccccgag

SEQ ID NO: 7795 - DNA, 20 bp, human
gaggtagccgatgtcctcga

SEQ ID NO: 7796 - DNA, 20 bp, human
ggagagccggcgagaaccgg

SEQ ID NO: 7797 - DNA, 20 bp, human
gcagcgctccacgtcttcgg

SEQ ID NO: 7798 - DNA, 20 bp, human
gtccgagagccggcgagaac

SEQ ID NO: 7799 - DNA, 20 bp, human
gttgagtcctgagagaaagg

SEQ ID NO: 7800 - DNA, 20 bp, human
ggcggtgaggcggaaatttg

SEQ ID NO: 7801 - DNA, 20 bp, human
gggacccgcctccgaagacg

SEQ ID NO: 7802 - DNA, 20 bp, human
gggccgggcgaaagagtgct

SEQ ID NO: 7803 - DNA, 20 bp, human
gccggcgagaaccggaggcc

SEQ ID NO: 7804 - DNA, 20 bp, human
gggcgaaagagtgctcggtg

SEQ ID NO: 7805 - DNA, 20 bp, human
gcaggggtgctggcaccggg

SEQ ID NO: 7806 - DNA, 20 bp, human
gcccgggagtcgccatgatg

SEQ ID NO: 7807 - DNA, 20 bp, human
gggggtctgcgtccacatca

SEQ ID NO: 7808 - DNA, 20 bp, human
gaaactgagaggccactcca

SEQ ID NO: 7809 - DNA, 20 bp, human
gctacaggtggtaggaggga

SEQ ID NO: 7810 - DNA, 20 bp, human
gctaccacctgtaggagacc

SEQ ID NO: 7811 - DNA, 20 bp, human
gactcagcaacggtccgctg

SEQ ID NO: 7812 - DNA, 20 bp, human
gggtcctggtctcctacagg

SEQ ID NO: 7813 - DNA, 20 bp, human
gcaggacttgtaacaaggag

SEQ ID NO: 7814 - DNA, 20 bp, human
gtccagggtagggactctga

SEQ ID NO: 7815 - DNA, 20 bp, human
ggtaaacaaccagccggact

SEQ ID NO: 7816 - DNA, 20 bp, human
gccttggagcgtctagagtc

SEQ ID NO: 7817 - DNA, 20 bp, human
gctctagacgctccaaggtc

SEQ ID NO: 7818 - DNA, 20 bp, human
ggattgcagtgcgctcgctg

SEQ ID NO: 7819 - DNA, 20 bp, human
gcttagggagctgcccgaga

SEQ ID NO: 7820 - DNA, 20 bp, human
gtgccggctacagcaggtgt

SEQ ID NO: 7821 - DNA, 20 bp, human
ggcacagtgcctgggagtat

SEQ ID NO: 7822 - DNA, 20 bp, human
ggtgacgcccgcagggagag

SEQ ID NO: 7823 - DNA, 20 bp, human
gactcccaggcactgtgcgg

SEQ ID NO: 7824 - DNA, 20 bp, human
ggcaggcttatgcgacacag

SEQ ID NO: 7825 - DNA, 20 bp, human
gagcctggagagcgaagtgc

SEQ ID NO: 7826 - DNA, 20 bp, human
ggcagcgtgcagggaatctg

SEQ ID NO: 7827 - DNA, 20 bp, human
ggaacctccaggctccagtc

SEQ ID NO: 7828 - DNA, 20 bp, human
gcactaggctgggctaggaa

SEQ ID NO: 7829 - DNA, 20 bp, human
gcctccaggctccagtcggg

SEQ ID NO: 7830 - DNA, 20 bp, human
ggagtgcccctggcacactg

SEQ ID NO: 7831 - DNA, 20 bp, human
gctgcatacggcccgagggg

SEQ ID NO: 7832 - DNA, 20 bp, human
gttgctggcctcctcccgac

SEQ ID NO: 7833 - DNA, 20 bp, human
gggagggtgggcactaggct

SEQ ID NO: 7834 - DNA, 20 bp, human
gcaactgcatacggcccgag

SEQ ID NO: 7835 - DNA, 20 bp, human
gctttctgccgaagacacca

SEQ ID NO: 7836 - DNA, 20 bp, human
gtggcgagcaccgggaggag

SEQ ID NO: 7837 - DNA, 20 bp, human
ggcaggagtggaaaggatcc

SEQ ID NO: 7838 - DNA, 20 bp, human
gtggctgtggcgcccagaga

SEQ ID NO: 7839 - DNA, 20 bp, human
gccctgcggcctgagtccta

SEQ ID NO: 7840 - DNA, 20 bp, human
ggccgagcaggcacagggac

SEQ ID NO: 7841 - DNA, 20 bp, human
ggtcgagtggaagtacccgc

SEQ ID NO: 7842 - DNA, 20 bp, human
gccgcgccaagaggcgtcaa

SEQ ID NO: 7843 - DNA, 20 bp, human
ggatcctggcgagcaccggg

SEQ ID NO: 7844 - DNA, 20 bp, human
gccggatctcctggaagtgt

SEQ ID NO: 7845 - DNA, 20 bp, human
gccagagacggtggagtccg

SEQ ID NO: 7846 - DNA, 20 bp, human
ggcaggcgagaggcgtcctc

SEQ ID NO: 7847 - DNA, 20 bp, human
gctccggtcggtgggtgcct

SEQ ID NO: 7848 - DNA, 20 bp, human
ggctctgggctccggtcggt

SEQ ID NO: 7849 - DNA, 20 bp, human
gacgcctctcgcctgccgag

SEQ ID NO: 7850 - DNA, 20 bp, human
gggaggaagcccgctgtccc

SEQ ID NO: 7851 - DNA, 20 bp, human
ggcagactgaggccccggtg

SEQ ID NO: 7852 - DNA, 20 bp, human
gggcgctgtgctctccgcgg

SEQ ID NO: 7853 - DNA, 20 bp, human
gtcagtctccgggctccgct

SEQ ID NO: 7854 - DNA, 20 bp, human
ggccggggaaagccgagccg

SEQ ID NO: 7855 - DNA, 20 bp, human
gcttcctcccctgcccggag

SEQ ID NO: 7856 - DNA, 20 bp, human
ggcgcgggtccaccggtagt

SEQ ID NO: 7857 - DNA, 20 bp, human
gaggaagccgcgcaggtcgt

SEQ ID NO: 7858 - DNA, 20 bp, human
gcctgccgcgcgcctactac

SEQ ID NO: 7859 - DNA, 20 bp, human
ggccgcgcgcctactaccgg

SEQ ID NO: 7860 - DNA, 20 bp, human
gtaggcgcgcggcaggaagt

SEQ ID NO: 7861 - DNA, 20 bp, human
ggtcgtgggcgcgggtccac

SEQ ID NO: 7862 - DNA, 20 bp, human
gtccaccggtagtaggcgcg

SEQ ID NO: 7863 - DNA, 20 bp, human
gcccgcgcccacgacctgcg

SEQ ID NO: 7864 - DNA, 20 bp, human
gcgggcgcacgaggacgagg

SEQ ID NO: 7865 - DNA, 20 bp, human
gggcttcctcaacttcacgc

SEQ ID NO: 7866 - DNA, 20 bp, human
gcgaggacaggtcaggtcag

SEQ ID NO: 7867 - DNA, 20 bp, human
gaagcctggggctctcggag

SEQ ID NO: 7868 - DNA, 20 bp, human
gcgatcccgcagcccggggg

SEQ ID NO: 7869 - DNA, 20 bp, human
gcggggagccgcgggctcat

SEQ ID NO: 7870 - DNA, 20 bp, human
gacggacggcccgggcgacg

SEQ ID NO: 7871 - DNA, 20 bp, human
gcaccggccccatgagcccg

SEQ ID NO: 7872 - DNA, 20 bp, human
gtcaggtcaggggctacgga

SEQ ID NO: 7873 - DNA, 20 bp, human
ggtgcagccgcggagcgcgc

SEQ ID NO: 7874 - DNA, 20 bp, human
gcccagaactccggacgccg

SEQ ID NO: 7875 - DNA, 20 bp, human
ggagcccgcgtcaactacac

SEQ ID NO: 7876 - DNA, 20 bp, human
gccccacgcggaagtcaggt

SEQ ID NO: 7877 - DNA, 20 bp, human
ggtggccggagttccagctg

SEQ ID NO: 7878 - DNA, 20 bp, human
gcaaaccccagctggaactc

SEQ ID NO: 7879 - DNA, 20 bp, human
gttgcagctggcccctaagg

SEQ ID NO: 7880 - DNA, 20 bp, human
gcagagtcctgaacacgaga

SEQ ID NO: 7881 - DNA, 20 bp, human
gcgagccccacgcggaagtc

SEQ ID NO: 7882 - DNA, 20 bp, human
gggagagggcctgcccaccg

SEQ ID NO: 7883 - DNA, 20 bp, human
gaggtaggagcacccgccgc

SEQ ID NO: 7884 - DNA, 20 bp, human
gcggtcaccctcgcctgacc

SEQ ID NO: 7885 - DNA, 20 bp, human
gtcctgaacacgagatggag

SEQ ID NO: 7886 - DNA, 20 bp, human
gacaggtagtcacacaccaa

SEQ ID NO: 7887 - DNA, 20 bp, human
gagtcacacaccaagggcag

SEQ ID NO: 7888 - DNA, 20 bp, human
gctcccgcgtgtgcgagtgt

SEQ ID NO: 7889 - DNA, 20 bp, human
ggcgcgttttaggactttga

SEQ ID NO: 7890 - DNA, 20 bp, human
ggcgagtgtgcacccatcgg

SEQ ID NO: 7891 - DNA, 20 bp, human
ggcgcccgccggcccccgat

SEQ ID NO: 7892 - DNA, 20 bp, human
gcgggagcagcgatctccga

SEQ ID NO: 7893 - DNA, 20 bp, human
gcagccggaacatgctcgga

SEQ ID NO: 7894 - DNA, 20 bp, human
gtggcaaatgctcacatcag

SEQ ID NO: 7895 - DNA, 20 bp, human
ggccgcagatcccgcctcca

SEQ ID NO: 7896 - DNA, 20 bp, human
gcgggagcggagagaaacca

SEQ ID NO: 7897 - DNA, 20 bp, human
ggagctgaggaaccggaccc

SEQ ID NO: 7898 - DNA, 20 bp, human
gtgccgcccgcgggcccctg

SEQ ID NO: 7899 - DNA, 20 bp, human
gcagctcgtgggctcggacg

SEQ ID NO: 7900 - DNA, 20 bp, human
gggggaagagcgcagctcgt

SEQ ID NO: 7901 - DNA, 20 bp, human
gtcgtgggctcggacgggga

SEQ ID NO: 7902 - DNA, 20 bp, human
ggcagcgagggccgtcggaa

SEQ ID NO: 7903 - DNA, 20 bp, human
gcgtcggaagggtttgctag

SEQ ID NO: 7904 - DNA, 20 bp, human
gtgggctcggacggggaagg

SEQ ID NO: 7905 - DNA, 20 bp, human
gggccgccccaggggcccgc

SEQ ID NO: 7906 - DNA, 20 bp, human
gagcagtaacagagcctcag

SEQ ID NO: 7907 - DNA, 20 bp, human
gaatacttctaggcccactg

SEQ ID NO: 7908 - DNA, 20 bp, human
gttgtgggttcggggtttat

SEQ ID NO: 7909 - DNA, 20 bp, human
ggcagagaaagcgtgagaga

SEQ ID NO: 7910 - DNA, 20 bp, human
gatgtgcggttgtgggttcg

SEQ ID NO: 7911 - DNA, 20 bp, human
gggttgaattccgctggctc

SEQ ID NO: 7912 - DNA, 20 bp, human
gctttcaaatgtgcggttgt

SEQ ID NO: 7913 - DNA, 20 bp, human
gaaagctcaaccagctctgc

SEQ ID NO: 7914 - DNA, 20 bp, human
gcaaatgaaggcaaattgga

SEQ ID NO: 7915 - DNA, 20 bp, human
gtattaaatacaatcaacat

SEQ ID NO: 7916 - DNA, 20 bp, human
gagactgagcctccatgaca

SEQ ID NO: 7917 - DNA, 20 bp, human
gtctctgagcagccattgaa

SEQ ID NO: 7918 - DNA, 20 bp, human
ggagttaaggaacagatccc

SEQ ID NO: 7919 - DNA, 20 bp, human
gcgctagtgtgtggacaagg

SEQ ID NO: 7920 - DNA, 20 bp, human
gactgatggggaagcggtgg

SEQ ID NO: 7921 - DNA, 20 bp, human
gaggaacagatccccggagg

SEQ ID NO: 7922 - DNA, 20 bp, human
gttaaggaacagatccccgg

SEQ ID NO: 7923 - DNA, 20 bp, human
gaccaccaccagataggtgt

SEQ ID NO: 7924 - DNA, 20 bp, human
gtactggactgatggggaag

SEQ ID NO: 7925 - DNA, 20 bp, human
ggaagggttgaagtttctag

SEQ ID NO: 7926 - DNA, 20 bp, human
gcgcagctcggaacccgcca

SEQ ID NO: 7927 - DNA, 20 bp, human
ggccgccgggcgctggaacc

SEQ ID NO: 7928 - DNA, 20 bp, human
gggaggagtccagtgctgga

SEQ ID NO: 7929 - DNA, 20 bp, human
gcggccactctgtccctggt

SEQ ID NO: 7930 - DNA, 20 bp, human
ggagcctggggaggacggac

SEQ ID NO: 7931 - DNA, 20 bp, human
gaagctgcggcgggtggacc

SEQ ID NO: 7932 - DNA, 20 bp, human
ggaaaggaggagtccagtgc

SEQ ID NO: 7933 - DNA, 20 bp, human
gtccaggttccagcgcccgg

SEQ ID NO: 7934 - DNA, 20 bp, human
gtccccagcgggcctcgcag

SEQ ID NO: 7935 - DNA, 20 bp, human
gtggggaggacggacgggga

SEQ ID NO: 7936 - DNA, 20 bp, human
gcaactacaccctcagccag

SEQ ID NO: 7937 - DNA, 20 bp, human
gatggtggggaggcggctca

SEQ ID NO: 7938 - DNA, 20 bp, human
gaggcggctcagggagcctc

SEQ ID NO: 7939 - DNA, 20 bp, human
gaagcccttggccatggtga

SEQ ID NO: 7940 - DNA, 20 bp, human
gtggatgatgatgacgtcag

SEQ ID NO: 7941 - DNA, 20 bp, human
gcagtcttgtcaatgtcggg

SEQ ID NO: 7942 - DNA, 20 bp, human
ggtggtggctgaggcggacg

SEQ ID NO: 7943 - DNA, 20 bp, human
gatatagaagcccttggcca

SEQ ID NO: 7944 - DNA, 20 bp, human
gggcacagggtggtcctgcg

SEQ ID NO: 7945 - DNA, 20 bp, human
gtccttgcaggtgaaacgga

SEQ ID NO: 7946 - DNA, 20 bp, human
ggaactcgccacgaccctca

SEQ ID NO: 7947 - DNA, 20 bp, human
ggaggagcgcgccccaacaa

SEQ ID NO: 7948 - DNA, 20 bp, human
gcctcggcatcggcttccag

SEQ ID NO: 7949 - DNA, 20 bp, human
gtcatctgcgccgggcaagg

SEQ ID NO: 7950 - DNA, 20 bp, human
ggcgcagatgagcaccagag

SEQ ID NO: 7951 - DNA, 20 bp, human
ggcatcggagcggaaaccag

SEQ ID NO: 7952 - DNA, 20 bp, human
gggacaggagcgcatctcca

SEQ ID NO: 7953 - DNA, 20 bp, human
ggggtgggggggacaactcg

SEQ ID NO: 7954 - DNA, 20 bp, human
gtctgggacaaagaaccgtc

SEQ ID NO: 7955 - DNA, 20 bp, human
gagggggacgcagggaggat

SEQ ID NO: 7956 - DNA, 20 bp, human
gtggagagaagccacgccga

SEQ ID NO: 7957 - DNA, 20 bp, human
ggattcgtcaagagttccgg

SEQ ID NO: 7958 - DNA, 20 bp, human
gggcgacggcagaacaaact

SEQ ID NO: 7959 - DNA, 20 bp, human
gtggccctgggactcccggc

SEQ ID NO: 7960 - DNA, 20 bp, human
gaagctcaggagggtcgcaa

SEQ ID NO: 7961 - DNA, 20 bp, human
gcgggacccaccagctgaca

SEQ ID NO: 7962 - DNA, 20 bp, human
gcggcagaacaaactaggag

SEQ ID NO: 7963 - DNA, 20 bp, human
ggaggtcctgagaggacaaa

SEQ ID NO: 7964 - DNA, 20 bp, human
ggcccagacccggcccgagc

SEQ ID NO: 7965 - DNA, 20 bp, human
gggaactctccggaatcggg

SEQ ID NO: 7966 - DNA, 20 bp, human
gtgcaagaaggtagagataa

SEQ ID NO: 7967 - DNA, 20 bp, human
gttctctgaagatttcacac

SEQ ID NO: 7968 - DNA, 20 bp, human
gcacactggcagtggagact

SEQ ID NO: 7969 - DNA, 20 bp, human
ggaagaatgtgctttccctc

SEQ ID NO: 7970 - DNA, 20 bp, human
ggaagatttcacactggcag

SEQ ID NO: 7971 - DNA, 20 bp, human
gacaaccaaaactaactaaa

SEQ ID NO: 7972 - DNA, 20 bp, human
gtaagttaccatgagaaaga

SEQ ID NO: 7973 - DNA, 20 bp, human
gttacagagaaatcgtgatg

SEQ ID NO: 7974 - DNA, 20 bp, human
gattcttttaaggctaccag

SEQ ID NO: 7975 - DNA, 20 bp, human
gcttgggcttctgattttat

SEQ ID NO: 7976 - DNA, 20 bp, human
gcactgttcacctcagactc

SEQ ID NO: 7977 - DNA, 20 bp, human
gtaagaatccatttaattag

SEQ ID NO: 7978 - DNA, 20 bp, human
ggatggtaattgttaacctc

SEQ ID NO: 7979 - DNA, 20 bp, human
gagtgaaccttaattctttc

SEQ ID NO: 7980 - DNA, 20 bp, human
ggtgaagccagaaagaatta

SEQ ID NO: 7981 - DNA, 20 bp, human
ggaaaatgtaaaagcaaatc

SEQ ID NO: 7982 - DNA, 20 bp, human
gaaactgaagattaaagatt

SEQ ID NO: 7983 - DNA, 20 bp, human
gattttcttgcctgagtctg

SEQ ID NO: 7984 - DNA, 20 bp, human
gaatgtttctttcaaaaaat

SEQ ID NO: 7985 - DNA, 20 bp, human
gatatttaaattttatttct

SEQ ID NO: 7986 - DNA, 20 bp, human
gacgccgaggctgatctagg

SEQ ID NO: 7987 - DNA, 20 bp, human
gcggggcactcggggcactg

SEQ ID NO: 7988 - DNA, 20 bp, human
gcgccgggcggaaaactccg

SEQ ID NO: 7989 - DNA, 20 bp, human
ggcaccccgaccacacatga

SEQ ID NO: 7990 - DNA, 20 bp, human
gcagacgccgaggctgatct

SEQ ID NO: 7991 - DNA, 20 bp, human
gctcagtctgggcctgggta

SEQ ID NO: 7992 - DNA, 20 bp, human
ggtgcactcgccgtcccccc

SEQ ID NO: 7993 - DNA, 20 bp, human
gccccgacccctgagcccgg

SEQ ID NO: 7994 - DNA, 20 bp, human
gagcagccgtcagcgccggg

SEQ ID NO: 7995 - DNA, 20 bp, human
ggcgcctgggttctgcctag

SEQ ID NO: 7996 - DNA, 20 bp, human
gtgttgtaaactttgcctgt

SEQ ID NO: 7997 - DNA, 20 bp, human
gcaagagatattatgtccgg

SEQ ID NO: 7998 - DNA, 20 bp, human
gaattaaaaccaattcccaa

SEQ ID NO: 7999 - DNA, 20 bp, human
gtatggttaccctttaatat

SEQ ID NO: 8000 - DNA, 20 bp, human
gacacaagagatattatgtc

SEQ ID NO: 8001 - DNA, 20 bp, human
ggtaagtactcattgccttt

SEQ ID NO: 8002 - DNA, 20 bp, human
gttgctaaaaccaatattaa

SEQ ID NO: 8003 - DNA, 20 bp, human
gactcattgcctttgggaat

SEQ ID NO: 8004 - DNA, 20 bp, human
gtttaattttggttagcatg

SEQ ID NO: 8005 - DNA, 20 bp, human
gtttacaacagttttccccc

SEQ ID NO: 8006 - DNA, 20 bp, human
gcggcgcagcagtagcaagt

SEQ ID NO: 8007 - DNA, 20 bp, human
ggtaacttagagcagatggg

SEQ ID NO: 8008 - DNA, 20 bp, human
gggacctgcggctccctggg

SEQ ID NO: 8009 - DNA, 20 bp, human
ggctagctggcggcccatcg

SEQ ID NO: 8010 - DNA, 20 bp, human
ggacgctgggaagaagggta

SEQ ID NO: 8011 - DNA, 20 bp, human
ggtggagacgctgggaagaa

SEQ ID NO: 8012 - DNA, 20 bp, human
gggcagggcgtggccgccca

SEQ ID NO: 8013 - DNA, 20 bp, human
gtccacaccccgctagctgg

SEQ ID NO: 8014 - DNA, 20 bp, human
gatggggggcactttctaga

SEQ ID NO: 8015 - DNA, 20 bp, human
gggcactttctagagggcag

SEQ ID NO: 8016 - DNA, 20 bp, human
gtccgggcagccgccagcaa

SEQ ID NO: 8017 - DNA, 20 bp, human
ggtactaggagagtactcac

SEQ ID NO: 8018 - DNA, 20 bp, human
gctcctagtactggatacaa

SEQ ID NO: 8019 - DNA, 20 bp, human
gctgaactcacaataggtgg

SEQ ID NO: 8020 - DNA, 20 bp, human
ggcggctgcccggagtctac

SEQ ID NO: 8021 - DNA, 20 bp, human
gcgtttgcgctgatcaagga

SEQ ID NO: 8022 - DNA, 20 bp, human
gtgtgagttcagaagatcgt

SEQ ID NO: 8023 - DNA, 20 bp, human
gtatgctctgcagagcccgt

SEQ ID NO: 8024 - DNA, 20 bp, human
gcttctgaactcacaatagg

SEQ ID NO: 8025 - DNA, 20 bp, human
gggcagccgccagcaagggc

SEQ ID NO: 8026 - DNA, 20 bp, human
ggagcgaaggtgtcagccgc

SEQ ID NO: 8027 - DNA, 20 bp, human
ggacctgggtgacccaccca

SEQ ID NO: 8028 - DNA, 20 bp, human
gggaggccgagatggctaag

SEQ ID NO: 8029 - DNA, 20 bp, human
ggcgagtgcagctcgaccct

SEQ ID NO: 8030 - DNA, 20 bp, human
gaaagtgccgtgccatgggt

SEQ ID NO: 8031 - DNA, 20 bp, human
gggtcacccaggtcttggtg

SEQ ID NO: 8032 - DNA, 20 bp, human
gccccagtcctaaaggtcta

SEQ ID NO: 8033 - DNA, 20 bp, human
gattacagctagcagcgtaa

SEQ ID NO: 8034 - DNA, 20 bp, human
gtcggcctccccagtcctaa

SEQ ID NO: 8035 - DNA, 20 bp, human
gggccccaacccagctgcgt

SEQ ID NO: 8036 - DNA, 20 bp, human
gctcggtacgaggggtaaag

SEQ ID NO: 8037 - DNA, 20 bp, human
gcgctgtctggccctgagta

SEQ ID NO: 8038 - DNA, 20 bp, human
gggaggtcacaccctactca

SEQ ID NO: 8039 - DNA, 20 bp, human
gggacgcgggtcagagacca

SEQ ID NO: 8040 - DNA, 20 bp, human
gagcccggcctcggtacgag

SEQ ID NO: 8041 - DNA, 20 bp, human
gtacccctcgtaccgaggcc

SEQ ID NO: 8042 - DNA, 20 bp, human
ggttaggaggagttagctac

SEQ ID NO: 8043 - DNA, 20 bp, human
ggcagaggaggagcgcagcc

SEQ ID NO: 8044 - DNA, 20 bp, human
gaactgtaagaggtgttagg

SEQ ID NO: 8045 - DNA, 20 bp, human
gtcgctccgggtgggcgaga

SEQ ID NO: 8046 - DNA, 20 bp, human
gatgcagacgctgaaggatc

SEQ ID NO: 8047 - DNA, 20 bp, human
gtggcgactactcaggtcag

SEQ ID NO: 8048 - DNA, 20 bp, human
gagccgggcgacggtacgcg

SEQ ID NO: 8049 - DNA, 20 bp, human
gaaccgggacacagaaacgg

SEQ ID NO: 8050 - DNA, 20 bp, human
ggtgggtaaatccagcgcag

SEQ ID NO: 8051 - DNA, 20 bp, human
gtgtgccatggcgactactc

SEQ ID NO: 8052 - DNA, 20 bp, human
ggccgagatgcagacgctga

SEQ ID NO: 8053 - DNA, 20 bp, human
gtgtcccggtagctgcgaga

SEQ ID NO: 8054 - DNA, 20 bp, human
ggaccactcacccagactgt

SEQ ID NO: 8055 - DNA, 20 bp, human
gccgttgcttggatcagtct

SEQ ID NO: 8056 - DNA, 20 bp, human
ggggtcgcagacggacgcac

SEQ ID NO: 8057 - DNA, 20 bp, human
gggacccgcagagaagggtg

SEQ ID NO: 8058 - DNA, 20 bp, human
ggacgcagcgctcgctggat

SEQ ID NO: 8059 - DNA, 20 bp, human
ggcgcagcggagcaaatctg

SEQ ID NO: 8060 - DNA, 20 bp, human
gcggttgctgctgggctaac

SEQ ID NO: 8061 - DNA, 20 bp, human
gtcagctggacgccagtcaa

SEQ ID NO: 8062 - DNA, 20 bp, human
gggaccgggaggacagccgt

SEQ ID NO: 8063 - DNA, 20 bp, human
gcgccaggagcagggacggg

SEQ ID NO: 8064 - DNA, 20 bp, human
gggaggcctcgggtcgcaga

SEQ ID NO: 8065 - DNA, 20 bp, human
gtcaaaggacccgcagagaa

SEQ ID NO: 8066 - DNA, 20 bp, human
ggccgagggcaagaccaccg

SEQ ID NO: 8067 - DNA, 20 bp, human
ggctgagtagggaaacgcac

SEQ ID NO: 8068 - DNA, 20 bp, human
gccaccgaggcagacgaggt

SEQ ID NO: 8069 - DNA, 20 bp, human
gtcttgcgggagaccgggtt

SEQ ID NO: 8070 - DNA, 20 bp, human
gaaagccgtctggctggtag

SEQ ID NO: 8071 - DNA, 20 bp, human
gctccatcttgcgggagacc

SEQ ID NO: 8072 - DNA, 20 bp, human
gggcagtgctgaaagccgtc

SEQ ID NO: 8073 - DNA, 20 bp, human
gaagaccaccgaggcagacg

SEQ ID NO: 8074 - DNA, 20 bp, human
gtcccgcaagatggagccgg

SEQ ID NO: 8075 - DNA, 20 bp, human
gggcccagctgcctcgcggg

SEQ ID NO: 8076 - DNA, 20 bp, human
gcctgggaaaggtgcccccg

SEQ ID NO: 8077 - DNA, 20 bp, human
gctgtgtctcttcatctccc

SEQ ID NO: 8078 - DNA, 20 bp, human
gaaagccaggcagagcccgg

SEQ ID NO: 8079 - DNA, 20 bp, human
ggccgctcacttgggtgtgg

SEQ ID NO: 8080 - DNA, 20 bp, human
gcaggggtggggccactcaa

SEQ ID NO: 8081 - DNA, 20 bp, human
gaggtttgagaagagtccag

SEQ ID NO: 8082 - DNA, 20 bp, human
ggtgagcaggccgctcactt

SEQ ID NO: 8083 - DNA, 20 bp, human
gcccaggcctagagtgccca

SEQ ID NO: 8084 - DNA, 20 bp, human
ggagtgcccacggcagggat

SEQ ID NO: 8085 - DNA, 20 bp, human
gacccccacacccaagtgag

SEQ ID NO: 8086 - DNA, 20 bp, human
gcctgggaaaggtgcccccg

SEQ ID NO: 8087 - DNA, 20 bp, human
gctgtgtctcttcatctccc

SEQ ID NO: 8088 - DNA, 20 bp, human
gcaggggtggggccactcaa

SEQ ID NO: 8089 - DNA, 20 bp, human
gaggtttgagaagagtccag

SEQ ID NO: 8090 - DNA, 20 bp, human
ggagatgaagagacacaggt

SEQ ID NO: 8091 - DNA, 20 bp, human
gaggggagggacccttgcag

SEQ ID NO: 8092 - DNA, 20 bp, human
gagtggccccacccctgcaa

SEQ ID NO: 8093 - DNA, 20 bp, human
gtggggccactcaaaggagg

SEQ ID NO: 8094 - DNA, 20 bp, human
gtgctgggactccacacgtc

SEQ ID NO: 8095 - DNA, 20 bp, human
gttgagaagagtccagggga

SEQ ID NO: 8096 - DNA, 20 bp, human
gccggaggcagtgctcacac

SEQ ID NO: 8097 - DNA, 20 bp, human
ggaggtgccagaggtgaggt

SEQ ID NO: 8098 - DNA, 20 bp, human
ggtgagcactgcctccggtg

SEQ ID NO: 8099 - DNA, 20 bp, human
ggggcccagtacttactcag

SEQ ID NO: 8100 - DNA, 20 bp, human
ggccatagacctcagaaggg

SEQ ID NO: 8101 - DNA, 20 bp, human
gagggccatagacctcagaa

SEQ ID NO: 8102 - DNA, 20 bp, human
gacttactcagaggtgccag

SEQ ID NO: 8103 - DNA, 20 bp, human
gggatgcctggacagaaagg

SEQ ID NO: 8104 - DNA, 20 bp, human
gacgacacccacctcacctc

SEQ ID NO: 8105 - DNA, 20 bp, human
gagcacaggccggaatctct

SEQ ID NO: 8106 - DNA, 20 bp, human
gcaggcccagcctctcgaat

SEQ ID NO: 8107 - DNA, 20 bp, human
gccacacacaaagagctgga

SEQ ID NO: 8108 - DNA, 20 bp, human
gggccgaggactgaagagac

SEQ ID NO: 8109 - DNA, 20 bp, human
gggcctggactggtcatcgt

SEQ ID NO: 8110 - DNA, 20 bp, human
ggaaaacccaagttgcacag

SEQ ID NO: 8111 - DNA, 20 bp, human
gacaggtgtgcccattcgag

SEQ ID NO: 8112 - DNA, 20 bp, human
ggctccagcatccctcagtt

SEQ ID NO: 8113 - DNA, 20 bp, human
gagagccacacacaaagagc

SEQ ID NO: 8114 - DNA, 20 bp, human
gccctggaaaatccttacgg

SEQ ID NO: 8115 - DNA, 20 bp, human
ggaatagaggcgccaccgta

SEQ ID NO: 8116 - DNA, 20 bp, human
ggctggaagcagagcgaact

SEQ ID NO: 8117 - DNA, 20 bp, human
gattcgggagagtcaagaag

SEQ ID NO: 8118 - DNA, 20 bp, human
gcacacaggtgcgttctgat

SEQ ID NO: 8119 - DNA, 20 bp, human
gaaagaaacgtgggtataag

SEQ ID NO: 8120 - DNA, 20 bp, human
gaaggagggcacagagtgag

SEQ ID NO: 8121 - DNA, 20 bp, human
gacccagccgtgaaaggaca

SEQ ID NO: 8122 - DNA, 20 bp, human
ggaaaagcaaaaagaaacgt

SEQ ID NO: 8123 - DNA, 20 bp, human
gtgcgttctgatgggtattc

SEQ ID NO: 8124 - DNA, 20 bp, human
ggagatcagcttaagggcaa

SEQ ID NO: 8125 - DNA, 20 bp, human
gaggcaacagccggccaggg

SEQ ID NO: 8126 - DNA, 20 bp, human
gtggtcaccaaagaagatga

SEQ ID NO: 8127 - DNA, 20 bp, human
ggaaggccaggcatctgtca

SEQ ID NO: 8128 - DNA, 20 bp, human
gcagctccttcttggaccag

SEQ ID NO: 8129 - DNA, 20 bp, human
ggactctgcccaggaaggca

SEQ ID NO: 8130 - DNA, 20 bp, human
gtcaccgatgtggccccccg

SEQ ID NO: 8131 - DNA, 20 bp, human
ggccatggcggagccctccc

SEQ ID NO: 8132 - DNA, 20 bp, human
gacaccccggggggccacat

SEQ ID NO: 8133 - DNA, 20 bp, human
gaggagggcatactctgctg

SEQ ID NO: 8134 - DNA, 20 bp, human
gtgagaagcctgtggtattg

SEQ ID NO: 8135 - DNA, 20 bp, human
gctgggcagagtccccgggg

SEQ ID NO: 8136 - DNA, 20 bp, human
gactatcttgagatgcatgg

SEQ ID NO: 8137 - DNA, 20 bp, human
gtgtccaccaaagaggacga

SEQ ID NO: 8138 - DNA, 20 bp, human
ggagctgcagctgcccccca

SEQ ID NO: 8139 - DNA, 20 bp, human
gagggcaaagatggtaatga

SEQ ID NO: 8140 - DNA, 20 bp, human
gcacatcccgcatgtacgag

SEQ ID NO: 8141 - DNA, 20 bp, human
gggacagtgccaggaacgcc

SEQ ID NO: 8142 - DNA, 20 bp, human
gcagctcactcacattgggt

SEQ ID NO: 8143 - DNA, 20 bp, human
ggtcagcaaaacataggcca

SEQ ID NO: 8144 - DNA, 20 bp, human
gaggactatcttgagatgca

SEQ ID NO: 8145 - DNA, 20 bp, human
gttggggttgtccaccaaag

SEQ ID NO: 8146 - DNA, 20 bp, human
gtctcacgccagcaagacgg

SEQ ID NO: 8147 - DNA, 20 bp, human
gggaacctcagccagagtcc

SEQ ID NO: 8148 - DNA, 20 bp, human
ggaaggacacaggaaggcta

SEQ ID NO: 8149 - DNA, 20 bp, human
gtcccaggcatctgactacc

SEQ ID NO: 8150 - DNA, 20 bp, human
gaccagcaggacacaaacca

SEQ ID NO: 8151 - DNA, 20 bp, human
gtcccggtagtcagatgcct

SEQ ID NO: 8152 - DNA, 20 bp, human
gagtcagatgcctgggacta

SEQ ID NO: 8153 - DNA, 20 bp, human
ggctctgttggctcctggac

SEQ ID NO: 8154 - DNA, 20 bp, human
gggccagaatgaggagcacg

SEQ ID NO: 8155 - DNA, 20 bp, human
gggtgatgacggccagaatg

SEQ ID NO: 8156 - DNA, 20 bp, human
gctggttcgagggcccggag

SEQ ID NO: 8157 - DNA, 20 bp, human
gaccagcgcggacaccacaa

SEQ ID NO: 8158 - DNA, 20 bp, human
gcacgaaaggatgggacgaa

SEQ ID NO: 8159 - DNA, 20 bp, human
ggggagtgctgacccctgat

SEQ ID NO: 8160 - DNA, 20 bp, human
gagcgggaggcggaggttct

SEQ ID NO: 8161 - DNA, 20 bp, human
gaggatgggacgaacggcag

SEQ ID NO: 8162 - DNA, 20 bp, human
gcaagccccgccccactcgg

SEQ ID NO: 8163 - DNA, 20 bp, human
ggcggacaccacaatggacc

SEQ ID NO: 8164 - DNA, 20 bp, human
gtgggaagtagcgggcacct

SEQ ID NO: 8165 - DNA, 20 bp, human
gtcggacgcccggtccattg

SEQ ID NO: 8166 - DNA, 20 bp, human
ggtgtagggtgaccagtatg

SEQ ID NO: 8167 - DNA, 20 bp, human
gaggtggtacaggagtgttg

SEQ ID NO: 8168 - DNA, 20 bp, human
gcacaaacatgtccagtgta

SEQ ID NO: 8169 - DNA, 20 bp, human
gcccctttttctctctgggg

SEQ ID NO: 8170 - DNA, 20 bp, human
gagttacccacagccaggat

SEQ ID NO: 8171 - DNA, 20 bp, human
ggacattctccaggtggtac

SEQ ID NO: 8172 - DNA, 20 bp, human
gagggggacacatcattagc

SEQ ID NO: 8173 - DNA, 20 bp, human
gctaaaataaggattaagca

SEQ ID NO: 8174 - DNA, 20 bp, human
ggtaagtgacagcccctact

SEQ ID NO: 8175 - DNA, 20 bp, human
ggaaatgtattgatattata

SEQ ID NO: 8176 - DNA, 20 bp, human
gctaggagctgaggcgagaa

SEQ ID NO: 8177 - DNA, 20 bp, human
gacgaggcgctagggaacaa

SEQ ID NO: 8178 - DNA, 20 bp, human
gggctgcagcgagtaggcgg

SEQ ID NO: 8179 - DNA, 20 bp, human
gggaggcggtcactcacgct

SEQ ID NO: 8180 - DNA, 20 bp, human
ggcgagaagggccatgcgga

SEQ ID NO: 8181 - DNA, 20 bp, human
gcgaagaggaggagccacgg

SEQ ID NO: 8182 - DNA, 20 bp, human
gggcggctgcagcgagtagg

SEQ ID NO: 8183 - DNA, 20 bp, human
gagggccatgcggacggcga

SEQ ID NO: 8184 - DNA, 20 bp, human
gggcctccttcggcagctgg

SEQ ID NO: 8185 - DNA, 20 bp, human
gcggagggtaagcccgctgg

SEQ ID NO: 8186 - DNA, 20 bp, human
ggacgcaccgggagagcgag

SEQ ID NO: 8187 - DNA, 20 bp, human
gccgggagagcgagaggtgg

SEQ ID NO: 8188 - DNA, 20 bp, human
gccggcagcccggacgcacc

SEQ ID NO: 8189 - DNA, 20 bp, human
gcgagccaggagaagaagtg

SEQ ID NO: 8190 - DNA, 20 bp, human
gggcctcaggatggccatgg

SEQ ID NO: 8191 - DNA, 20 bp, human
ggcccggcaggtgacagccg

SEQ ID NO: 8192 - DNA, 20 bp, human
gaacgccctgaacaacgagg

SEQ ID NO: 8193 - DNA, 20 bp, human
ggccagtggggaattcctcg

SEQ ID NO: 8194 - DNA, 20 bp, human
gtaagtcctgtctctccggg

SEQ ID NO: 8195 - DNA, 20 bp, human
ggcctaagtcctgtctctcc

SEQ ID NO: 8196 - DNA, 20 bp, human
gatgaaaccagcagctccgg

SEQ ID NO: 8197 - DNA, 20 bp, human
ggctcagagaagacacgcgg

SEQ ID NO: 8198 - DNA, 20 bp, human
gtatctgacagacctgacac

SEQ ID NO: 8199 - DNA, 20 bp, human
gacacaagaacgctgatacg

SEQ ID NO: 8200 - DNA, 20 bp, human
ggggtcggccctccagaagt

SEQ ID NO: 8201 - DNA, 20 bp, human
gggttcaaggaggcccgtac

SEQ ID NO: 8202 - DNA, 20 bp, human
ggtggctcagagaagacacg

SEQ ID NO: 8203 - DNA, 20 bp, human
gcgcaggcggagggatcctg

SEQ ID NO: 8204 - DNA, 20 bp, human
gggccggtgagtgtcactcc

SEQ ID NO: 8205 - DNA, 20 bp, human
ggcccgccccgctaaacccc

SEQ ID NO: 8206 - DNA, 20 bp, human
gggagaaacactctctggtc

SEQ ID NO: 8207 - DNA, 20 bp, human
gggtcctgaagcttcagcga

SEQ ID NO: 8208 - DNA, 20 bp, human
gccgtaccaggaagcgctgg

SEQ ID NO: 8209 - DNA, 20 bp, human
gaaggcaccaccatcctgac

SEQ ID NO: 8210 - DNA, 20 bp, human
gtgcctgagatggaaatcgg

SEQ ID NO: 8211 - DNA, 20 bp, human
gagggatggggtaccaggta

SEQ ID NO: 8212 - DNA, 20 bp, human
ggcgcatgctcaataggaag

SEQ ID NO: 8213 - DNA, 20 bp, human
gcatcctgactggcagagtc

SEQ ID NO: 8214 - DNA, 20 bp, human
gcggaaggaggcccggatgt

SEQ ID NO: 8215 - DNA, 20 bp, human
gggagtggagaaacactctc

SEQ ID NO: 8216 - DNA, 20 bp, human
gtggcggcggcagcgacggt

SEQ ID NO: 8217 - DNA, 20 bp, human
gctccccgaaccggaagtgg

SEQ ID NO: 8218 - DNA, 20 bp, human
gagtggaggtgagctgtcgc

SEQ ID NO: 8219 - DNA, 20 bp, human
gggcggtgcagtcagttacc

SEQ ID NO: 8220 - DNA, 20 bp, human
gggaggtgagctgtcgcggg

SEQ ID NO: 8221 - DNA, 20 bp, human
gcagttacctggcaacgcgg

SEQ ID NO: 8222 - DNA, 20 bp, human
gcggctccccgaaccggaag

SEQ ID NO: 8223 - DNA, 20 bp, human
gcccgcgcggctccccgaac

SEQ ID NO: 8224 - DNA, 20 bp, human
gacggcgctggcggacatga

SEQ ID NO: 8225 - DNA, 20 bp, human
ggcttctgggtcctccaccg

SEQ ID NO: 8226 - DNA, 20 bp, human
ggggattcccagggattgca

SEQ ID NO: 8227 - DNA, 20 bp, human
gacagccgaggcggacatgg

SEQ ID NO: 8228 - DNA, 20 bp, human
ggccgaggcggacatggtgg

SEQ ID NO: 8229 - DNA, 20 bp, human
gtccagaatgaagacagccg

SEQ ID NO: 8230 - DNA, 20 bp, human
ggagcgccgggaggcgatgg

SEQ ID NO: 8231 - DNA, 20 bp, human
gccgaaggacttaggagtcg

SEQ ID NO: 8232 - DNA, 20 bp, human
gcaaggcagccacagatggg

SEQ ID NO: 8233 - DNA, 20 bp, human
gaaggacttaggagtcgggg

SEQ ID NO: 8234 - DNA, 20 bp, human
gggtggcggccgaaggactt

SEQ ID NO: 8235 - DNA, 20 bp, human
gtccccaggtattaacactg

SEQ ID NO: 8236 - DNA, 20 bp, human
gccggaggctgcaggatggt

SEQ ID NO: 8237 - DNA, 20 bp, human
ggtcccacttcggccaccgt

SEQ ID NO: 8238 - DNA, 20 bp, human
gggagtgggactggcgccta

SEQ ID NO: 8239 - DNA, 20 bp, human
gccgggctcgggaggaagag

SEQ ID NO: 8240 - DNA, 20 bp, human
ggtgggactggcgcctacgg

SEQ ID NO: 8241 - DNA, 20 bp, human
gggctcggcgcgtcccactt

SEQ ID NO: 8242 - DNA, 20 bp, human
gcctgtgcagcccgggaagg

SEQ ID NO: 8243 - DNA, 20 bp, human
ggcgcctacggtggccgaag

SEQ ID NO: 8244 - DNA, 20 bp, human
gggaagccgcccgaagcaga

SEQ ID NO: 8245 - DNA, 20 bp, human
gcagcccgggaagggggtct

SEQ ID NO: 8246 - DNA, 20 bp, human
gcaaggagcggagcagacaa

SEQ ID NO: 8247 - DNA, 20 bp, human
gcactgaccaagcccgggag

SEQ ID NO: 8248 - DNA, 20 bp, human
gagaggtgacaggcaaggag

SEQ ID NO: 8249 - DNA, 20 bp, human
gaggacacccggctggcata

SEQ ID NO: 8250 - DNA, 20 bp, human
gggtggcggccgaggactct

SEQ ID NO: 8251 - DNA, 20 bp, human
gtgtggggaggacacccggc

SEQ ID NO: 8252 - DNA, 20 bp, human
gggcaggcttaggcggagag

SEQ ID NO: 8253 - DNA, 20 bp, human
gggccgccgtaagtccctgg

SEQ ID NO: 8254 - DNA, 20 bp, human
gcacccggctggcatagggc

SEQ ID NO: 8255 - DNA, 20 bp, human
gtgcgggcgcggcgacccag

SEQ ID NO: 8256 - DNA, 20 bp, human
ggcgagcgctggagccggtg

SEQ ID NO: 8257 - DNA, 20 bp, human
gaggcgcccggcttagacca

SEQ ID NO: 8258 - DNA, 20 bp, human
gttcagtgccagggcattgt

SEQ ID NO: 8259 - DNA, 20 bp, human
gctggagaagcgagggcgag

SEQ ID NO: 8260 - DNA, 20 bp, human
gcctcacctgtcagccgcac

SEQ ID NO: 8261 - DNA, 20 bp, human
ggcgttgccgcaggaatccc

SEQ ID NO: 8262 - DNA, 20 bp, human
gcagcgcccagcaccgagcc

SEQ ID NO: 8263 - DNA, 20 bp, human
gcagactaagcactcggcta

SEQ ID NO: 8264 - DNA, 20 bp, human
ggatgtcgcgggggaccagg

SEQ ID NO: 8265 - DNA, 20 bp, human
gggcgcgtccgcaccgtctg

SEQ ID NO: 8266 - DNA, 20 bp, human
gcgctcacagttccggatgt

SEQ ID NO: 8267 - DNA, 20 bp, human
ggtccaagggcgatgggatg

SEQ ID NO: 8268 - DNA, 20 bp, human
gaccgggcggaaaggacccc

SEQ ID NO: 8269 - DNA, 20 bp, human
gtagagtggggggcacgtag

SEQ ID NO: 8270 - DNA, 20 bp, human
gctccaggcctggccggaca

SEQ ID NO: 8271 - DNA, 20 bp, human
gtagctagaggggtccggga

SEQ ID NO: 8272 - DNA, 20 bp, human
ggcctcttgaggtgacgaca

SEQ ID NO: 8273 - DNA, 20 bp, human
ggtccgggagggcttgaaag

SEQ ID NO: 8274 - DNA, 20 bp, human
ggggctggcaagcggggacc

SEQ ID NO: 8275 - DNA, 20 bp, human
gcccggggatgggagcatag

SEQ ID NO: 8276 - DNA, 20 bp, human
gcgcgcggcggcccagaaag

SEQ ID NO: 8277 - DNA, 20 bp, human
gccggggagccgcctaacca

SEQ ID NO: 8278 - DNA, 20 bp, human
gccctgaggcggccgtggtt

SEQ ID NO: 8279 - DNA, 20 bp, human
gctccccggcggctcctccg

SEQ ID NO: 8280 - DNA, 20 bp, human
gtatccgcaactgtgagtgg

SEQ ID NO: 8281 - DNA, 20 bp, human
gcgccgcgcgcgcgcacgta

SEQ ID NO: 8282 - DNA, 20 bp, human
gctaggggtgcggggtctag

SEQ ID NO: 8283 - DNA, 20 bp, human
gtgaggcggccgtggttagg

SEQ ID NO: 8284 - DNA, 20 bp, human
ggagcgccgcccgcaccctc

SEQ ID NO: 8285 - DNA, 20 bp, human
ggtggggtgtccagggtcta

SEQ ID NO: 8286 - DNA, 20 bp, human
gctgggtcggagaccggcgg

SEQ ID NO: 8287 - DNA, 20 bp, human
gcggagagaagggtaacacc

SEQ ID NO: 8288 - DNA, 20 bp, human
gtgccagggacaaagatggt

SEQ ID NO: 8289 - DNA, 20 bp, human
gagagcctggaggccgtggg

SEQ ID NO: 8290 - DNA, 20 bp, human
gtgtggcagcaggtagttgg

SEQ ID NO: 8291 - DNA, 20 bp, human
gaccgccctgaactcaccgg

SEQ ID NO: 8292 - DNA, 20 bp, human
ggggtcggggacggagagaa

SEQ ID NO: 8293 - DNA, 20 bp, human
ggtgagggaatcctcgggtg

SEQ ID NO: 8294 - DNA, 20 bp, human
ggtgcggtgagggaatcctc

SEQ ID NO: 8295 - DNA, 20 bp, human
ggagggtttagggggaccag

SEQ ID NO: 8296 - DNA, 20 bp, human
gcatcttgggatccggagag

SEQ ID NO: 8297 - DNA, 20 bp, human
gtgccggcccggccactctc

SEQ ID NO: 8298 - DNA, 20 bp, human
gggcactgcggtgaaagccg

SEQ ID NO: 8299 - DNA, 20 bp, human
ggcaaggcggcggcacaaag

SEQ ID NO: 8300 - DNA, 20 bp, human
gcatggcgtgagacctgtca

SEQ ID NO: 8301 - DNA, 20 bp, human
ggacctgtcacggtgcaagg

SEQ ID NO: 8302 - DNA, 20 bp, human
ggggggcgggcggacatctt

SEQ ID NO: 8303 - DNA, 20 bp, human
gtgggatccggagagtggcc

SEQ ID NO: 8304 - DNA, 20 bp, human
ggggcggacatcttgggatc

SEQ ID NO: 8305 - DNA, 20 bp, human
gaggcagcgggcagacgagc

SEQ ID NO: 8306 - DNA, 20 bp, human
gacagacctaggacaggcgg

SEQ ID NO: 8307 - DNA, 20 bp, human
gacagctccacaggggatgt

SEQ ID NO: 8308 - DNA, 20 bp, human
gctgagaacagacctaggac

SEQ ID NO: 8309 - DNA, 20 bp, human
ggtggagctgtgcaggtcac

SEQ ID NO: 8310 - DNA, 20 bp, human
ggatgttggcagcgattctg

SEQ ID NO: 8311 - DNA, 20 bp, human
gtcgctgccaacatcccctg

SEQ ID NO: 8312 - DNA, 20 bp, human
gtcgctctgagaacagacct

SEQ ID NO: 8313 - DNA, 20 bp, human
ggtggcccaagtcaagccaa

SEQ ID NO: 8314 - DNA, 20 bp, human
gagcctgccagcccctaggt

SEQ ID NO: 8315 - DNA, 20 bp, human
ggcttccagggtgcagccag

SEQ ID NO: 8316 - DNA, 20 bp, human
gggctcagggtgcagttgta

SEQ ID NO: 8317 - DNA, 20 bp, human
gcccagcggccccggtcccg

SEQ ID NO: 8318 - DNA, 20 bp, human
gactgggcagctccggctca

SEQ ID NO: 8319 - DNA, 20 bp, human
gggagctgcccagtcgccgc

SEQ ID NO: 8320 - DNA, 20 bp, human
gggaagtccgctctagctct

SEQ ID NO: 8321 - DNA, 20 bp, human
ggcctgacccagaccatccg

SEQ ID NO: 8322 - DNA, 20 bp, human
ggtgggtagcgagaaggcat

SEQ ID NO: 8323 - DNA, 20 bp, human
ggcgagaaggcattggaggt

SEQ ID NO: 8324 - DNA, 20 bp, human
gagtcttgtgggtagcgaga

SEQ ID NO: 8325 - DNA, 20 bp, human
ggggagagggcgtccgaaag

SEQ ID NO: 8326 - DNA, 20 bp, human
gcgcggtgctggcgggtgcg

SEQ ID NO: 8327 - DNA, 20 bp, human
gcaaaaggttccagtccaga

SEQ ID NO: 8328 - DNA, 20 bp, human
gcagggagccgtgacgagtc

SEQ ID NO: 8329 - DNA, 20 bp, human
gtcccgcgggtgggtaggtg

SEQ ID NO: 8330 - DNA, 20 bp, human
gaccttttggagagaacccc

SEQ ID NO: 8331 - DNA, 20 bp, human
gggcgcttccggactcgtca

SEQ ID NO: 8332 - DNA, 20 bp, human
gacgtgtcccgcgggtgggt

SEQ ID NO: 8333 - DNA, 20 bp, human
gtgttccgtgccctctggac

SEQ ID NO: 8334 - DNA, 20 bp, human
gggtaacgtgtcccgcgggt

SEQ ID NO: 8335 - DNA, 20 bp, human
gagaggccgaaggcccccga

SEQ ID NO: 8336 - DNA, 20 bp, human
gccgcctacagcgaagacaa

SEQ ID NO: 8337 - DNA, 20 bp, human
gtccgggctggcgaaggcgg

SEQ ID NO: 8338 - DNA, 20 bp, human
gcctacagcgaagacaaggg

SEQ ID NO: 8339 - DNA, 20 bp, human
gcgcggaggggggcagatag

SEQ ID NO: 8340 - DNA, 20 bp, human
gggccgggcgggcttccggt

SEQ ID NO: 8341 - DNA, 20 bp, human
ggctggcaccccggctccag

SEQ ID NO: 8342 - DNA, 20 bp, human
ggccccggggagcccgagta

SEQ ID NO: 8343 - DNA, 20 bp, human
gtcgccagcccggaccggac

SEQ ID NO: 8344 - DNA, 20 bp, human
gcgcgcggatttctcaatca

SEQ ID NO: 8345 - DNA, 20 bp, human
ggccgtactcgggctccccg

SEQ ID NO: 8346 - DNA, 20 bp, human
ggcagggccggagccctaag

SEQ ID NO: 8347 - DNA, 20 bp, human
gcaaatggcggacaagatgg

SEQ ID NO: 8348 - DNA, 20 bp, human
gggagggtggcccgagacgg

SEQ ID NO: 8349 - DNA, 20 bp, human
gactaagacagagcccgggc

SEQ ID NO: 8350 - DNA, 20 bp, human
gtccaactaagacagagccc

SEQ ID NO: 8351 - DNA, 20 bp, human
gtcccgaggcaaaagcccgt

SEQ ID NO: 8352 - DNA, 20 bp, human
gggggcccggagcgggatcg

SEQ ID NO: 8353 - DNA, 20 bp, human
gcggcggggtccaaggaccg

SEQ ID NO: 8354 - DNA, 20 bp, human
gaccatcttgagggccatcg

SEQ ID NO: 8355 - DNA, 20 bp, human
ggagtaaactgagggtccag

SEQ ID NO: 8356 - DNA, 20 bp, human
gtgttaatcaggcaatttcc

SEQ ID NO: 8357 - DNA, 20 bp, human
gccggcgccgaatcactgac

SEQ ID NO: 8358 - DNA, 20 bp, human
ggcttcggtaggagaggatc

SEQ ID NO: 8359 - DNA, 20 bp, human
gcggcttctccagcttcggt

SEQ ID NO: 8360 - DNA, 20 bp, human
gtctccagcttcggtaggag

SEQ ID NO: 8361 - DNA, 20 bp, human
gctcgccagcaaggccagaa

SEQ ID NO: 8362 - DNA, 20 bp, human
gtagtgagctggagtacaga

SEQ ID NO: 8363 - DNA, 20 bp, human
gcctgtgccagtcagtgatt

SEQ ID NO: 8364 - DNA, 20 bp, human
ggaagctggagaagccgaga

SEQ ID NO: 8365 - DNA, 20 bp, human
gcagggcctagaaaaatggt

SEQ ID NO: 8366 - DNA, 20 bp, human
ggtccgcgcctaggagcagt

SEQ ID NO: 8367 - DNA, 20 bp, human
gcaaggccaggtgaggagta

SEQ ID NO: 8368 - DNA, 20 bp, human
gcaggcagcccggggtgcga

SEQ ID NO: 8369 - DNA, 20 bp, human
gtccggggtgaagagcgcag

SEQ ID NO: 8370 - DNA, 20 bp, human
gcgcccactgctcctaggcg

SEQ ID NO: 8371 - DNA, 20 bp, human
ggcgggtggtcaaaacgcag

SEQ ID NO: 8372 - DNA, 20 bp, human
ggtcgtccctactcctcacc

SEQ ID NO: 8373 - DNA, 20 bp, human
ggcagccgggcggcctctca

SEQ ID NO: 8374 - DNA, 20 bp, human
gtcgcggaatggccacatcc

SEQ ID NO: 8375 - DNA, 20 bp, human
gggcccagagccggcggcga

SEQ ID NO: 8376 - DNA, 20 bp, human
ggcggctggatactcacgta

SEQ ID NO: 8377 - DNA, 20 bp, human
ggaccgcgcggcagggaggt

SEQ ID NO: 8378 - DNA, 20 bp, human
gcatgcagcccaccgacggg

SEQ ID NO: 8379 - DNA, 20 bp, human
gtccccctcgcccggatcag

SEQ ID NO: 8380 - DNA, 20 bp, human
gaagcatgcagcccaccgac

SEQ ID NO: 8381 - DNA, 20 bp, human
ggggccccgggaagtctcca

SEQ ID NO: 8382 - DNA, 20 bp, human
ggatcgcaggcgagattacg

SEQ ID NO: 8383 - DNA, 20 bp, human
ggcgcggtcagccaccgacg

SEQ ID NO: 8384 - DNA, 20 bp, human
gccgggcaaagccacgtcgg

SEQ ID NO: 8385 - DNA, 20 bp, human
gtctccagggagcgtcgcaa

SEQ ID NO: 8386 - DNA, 20 bp, human
ggccggtgctgagagaaccg

SEQ ID NO: 8387 - DNA, 20 bp, human
ggccacggttctctcagcac

SEQ ID NO: 8388 - DNA, 20 bp, human
gtggctggcaaagatgattc

SEQ ID NO: 8389 - DNA, 20 bp, human
gcatagtgggcgccctgaag

SEQ ID NO: 8390 - DNA, 20 bp, human
gcacgaaacgctggtagaag

SEQ ID NO: 8391 - DNA, 20 bp, human
gcgagatagaagcgacagtg

SEQ ID NO: 8392 - DNA, 20 bp, human
gcagcgagagcggggcagta

SEQ ID NO: 8393 - DNA, 20 bp, human
gacgggaaaatgtcacaaaa

SEQ ID NO: 8394 - DNA, 20 bp, human
ggccgagaggccaaagagga

SEQ ID NO: 8395 - DNA, 20 bp, human
gggagctttctgggagtagc

SEQ ID NO: 8396 - DNA, 20 bp, human
gtgcagaggggagactgaca

SEQ ID NO: 8397 - DNA, 20 bp, human
gctcaggctcggcttccgta

SEQ ID NO: 8398 - DNA, 20 bp, human
gcgtcctcggagccaaggta

SEQ ID NO: 8399 - DNA, 20 bp, human
ggatgtgggagcctgagtaa

SEQ ID NO: 8400 - DNA, 20 bp, human
ggcctgaagagcctagggtg

SEQ ID NO: 8401 - DNA, 20 bp, human
gagtagcgggagcgatctgt

SEQ ID NO: 8402 - DNA, 20 bp, human
gagcaggcagtgggatacgt

SEQ ID NO: 8403 - DNA, 20 bp, human
gctcccacatcaggacgaga

SEQ ID NO: 8404 - DNA, 20 bp, human
ggcagttagcacgcgaaggg

SEQ ID NO: 8405 - DNA, 20 bp, human
gcgcggcgctggaaatccgg

SEQ ID NO: 8406 - DNA, 20 bp, human
gcgggcggctacgggatcgc

SEQ ID NO: 8407 - DNA, 20 bp, human
ggcggctacgggatcgcggg

SEQ ID NO: 8408 - DNA, 20 bp, human
gaaacaggaagtgcctacgg

SEQ ID NO: 8409 - DNA, 20 bp, human
ggcatgaagccgggcggcta

SEQ ID NO: 8410 - DNA, 20 bp, human
gaagcttccaggcagacgaa

SEQ ID NO: 8411 - DNA, 20 bp, human
ggcggcgatgagcgacatag

SEQ ID NO: 8412 - DNA, 20 bp, human
ggcaggaaagtgaagcttcc

SEQ ID NO: 8413 - DNA, 20 bp, human
gacgttgagaaaacacacgg

SEQ ID NO: 8414 - DNA, 20 bp, human
gccctcacctccaagcacgt

SEQ ID NO: 8415 - DNA, 20 bp, human
gtcagtgtcagaactaactg

SEQ ID NO: 8416 - DNA, 20 bp, human
gtagatgagcgggtccccct

SEQ ID NO: 8417 - DNA, 20 bp, human
gtggagagtagacaagaaga

SEQ ID NO: 8418 - DNA, 20 bp, human
gcagtccgcggggacagtgg

SEQ ID NO: 8419 - DNA, 20 bp, human
ggaagagctcggccacatcc

SEQ ID NO: 8420 - DNA, 20 bp, human
ggacagtggcggccgggatg

SEQ ID NO: 8421 - DNA, 20 bp, human
gatgaagaattgggaaatca

SEQ ID NO: 8422 - DNA, 20 bp, human
gcgccagtccgcggggacag

SEQ ID NO: 8423 - DNA, 20 bp, human
gtgtggccgagctcttctac

SEQ ID NO: 8424 - DNA, 20 bp, human
gtgggaaatcatggccgttc

SEQ ID NO: 8425 - DNA, 20 bp, human
gtcttgtctactctccagaa

SEQ ID NO: 8426 - DNA, 20 bp, human
gtcgcccggggggaacggag

SEQ ID NO: 8427 - DNA, 20 bp, human
gacgcggtgcgggcctcctc

SEQ ID NO: 8428 - DNA, 20 bp, human
gtccgagggagcgggtcccg

SEQ ID NO: 8429 - DNA, 20 bp, human
gccggcagcagcagggacct

SEQ ID NO: 8430 - DNA, 20 bp, human
gagggacctggggggaacct

SEQ ID NO: 8431 - DNA, 20 bp, human
ggcagcagtacactatcccg

SEQ ID NO: 8432 - DNA, 20 bp, human
ggcgcactgggaggtggaac

SEQ ID NO: 8433 - DNA, 20 bp, human
gccgccgctccgttcccccc

SEQ ID NO: 8434 - DNA, 20 bp, human
gccgggaaggccgcctccgg

SEQ ID NO: 8435 - DNA, 20 bp, human
gccgcacaccgaccccaacg

SEQ ID NO: 8436 - DNA, 20 bp, human
gcggcatctgcgcggcgtct

SEQ ID NO: 8437 - DNA, 20 bp, human
gagagccctggtctcaccgt

SEQ ID NO: 8438 - DNA, 20 bp, human
gcggggccgacgccagagct

SEQ ID NO: 8439 - DNA, 20 bp, human
gcggctcccacggtgagacc

SEQ ID NO: 8440 - DNA, 20 bp, human
gcagcagggaaacctggatg

SEQ ID NO: 8441 - DNA, 20 bp, human
gctggggtgaccctgcggaa

SEQ ID NO: 8442 - DNA, 20 bp, human
gcggcgcccagctctggcgt

SEQ ID NO: 8443 - DNA, 20 bp, human
gggcccgcgcgcctcaccat

SEQ ID NO: 8444 - DNA, 20 bp, human
ggaagatgaggttcatgacg

SEQ ID NO: 8445 - DNA, 20 bp, human
gtcctgtcccgcgagggccc

SEQ ID NO: 8446 - DNA, 20 bp, human
gcggcgcaggatgagcctca

SEQ ID NO: 8447 - DNA, 20 bp, human
gtaccggagttgcagggtat

SEQ ID NO: 8448 - DNA, 20 bp, human
gagctattcgtggcaaacct

SEQ ID NO: 8449 - DNA, 20 bp, human
gaaggtcacgcagctattcg

SEQ ID NO: 8450 - DNA, 20 bp, human
gggtctgcgctgttcctcgg

SEQ ID NO: 8451 - DNA, 20 bp, human
gttctcaaggttataggttg

SEQ ID NO: 8452 - DNA, 20 bp, human
gtacctataccctgcaactc

SEQ ID NO: 8453 - DNA, 20 bp, human
gagaaaataccggagttgca

SEQ ID NO: 8454 - DNA, 20 bp, human
gatctcacggtgccacaaag

SEQ ID NO: 8455 - DNA, 20 bp, human
ggatcaaagttcctcataca

SEQ ID NO: 8456 - DNA, 20 bp, human
gttgctctcctgccacggag

SEQ ID NO: 8457 - DNA, 20 bp, human
gcgtggcaggagagcaatgg

SEQ ID NO: 8458 - DNA, 20 bp, human
gcggcgggtacacagtcagt

SEQ ID NO: 8459 - DNA, 20 bp, human
gcacggaggggagcgcttgg

SEQ ID NO: 8460 - DNA, 20 bp, human
gttgcgcctcaaggttacgg

SEQ ID NO: 8461 - DNA, 20 bp, human
gcggcccgggggttgaaagg

SEQ ID NO: 8462 - DNA, 20 bp, human
gtaaaatagcaggttcgcaa

SEQ ID NO: 8463 - DNA, 20 bp, human
gcagtgggtatctgtagcta

SEQ ID NO: 8464 - DNA, 20 bp, human
gagcgcttggtggcagtccg

SEQ ID NO: 8465 - DNA, 20 bp, human
gggcgacgcctcgacgacag

SEQ ID NO: 8466 - DNA, 20 bp, human
gcacgaacctcggaaactcc

SEQ ID NO: 8467 - DNA, 20 bp, human
gaccggggtgcggagctcct

SEQ ID NO: 8468 - DNA, 20 bp, human
ggttcgtgcgcgtctggtgg

SEQ ID NO: 8469 - DNA, 20 bp, human
gcggtcccggaagttgaccg

SEQ ID NO: 8470 - DNA, 20 bp, human
gggatgggtgctcaataaat

SEQ ID NO: 8471 - DNA, 20 bp, human
gaccagacgcgcacgaacct

SEQ ID NO: 8472 - DNA, 20 bp, human
gcacgggggtgggtctcaca

SEQ ID NO: 8473 - DNA, 20 bp, human
gctcgagggcgagtccagtc

SEQ ID NO: 8474 - DNA, 20 bp, human
gggagctggaggccatccga

SEQ ID NO: 8475 - DNA, 20 bp, human
gtctccctaggggcacacgg

SEQ ID NO: 8476 - DNA, 20 bp, human
gccggggctgcagagatcca

SEQ ID NO: 8477 - DNA, 20 bp, human
gtgactgctccgctgtccag

SEQ ID NO: 8478 - DNA, 20 bp, human
gggctgcagagatccagggg

SEQ ID NO: 8479 - DNA, 20 bp, human
gtccagaggcggagaagaag

SEQ ID NO: 8480 - DNA, 20 bp, human
gcttctccgcctctggacag

SEQ ID NO: 8481 - DNA, 20 bp, human
gctgctccgctgtccagagg

SEQ ID NO: 8482 - DNA, 20 bp, human
ggggcgcacgaagaccccca

SEQ ID NO: 8483 - DNA, 20 bp, human
gcaaccttcggaggtccctg

SEQ ID NO: 8484 - DNA, 20 bp, human
ggagaagaagaggtagcgag

SEQ ID NO: 8485 - DNA, 20 bp, human
ggacgtgactgctctatccc

SEQ ID NO: 8486 - DNA, 20 bp, human
gctgcggcgggagaagatgg

SEQ ID NO: 8487 - DNA, 20 bp, human
ggcgggcctgatgacagtca

SEQ ID NO: 8488 - DNA, 20 bp, human
gcggagccggagctgggcga

SEQ ID NO: 8489 - DNA, 20 bp, human
gccgaagcccggcatctcag

SEQ ID NO: 8490 - DNA, 20 bp, human
gcagctgcggcgggagaaga

SEQ ID NO: 8491 - DNA, 20 bp, human
gccatcagctagcgaggcgg

SEQ ID NO: 8492 - DNA, 20 bp, human
gtcagcgggcaccggacccc

SEQ ID NO: 8493 - DNA, 20 bp, human
ggaaccatcagctagcgagg

SEQ ID NO: 8494 - DNA, 20 bp, human
ggaggcagcaggcgacatcc

SEQ ID NO: 8495 - DNA, 20 bp, human
ggctgcctggaacaatagtg

SEQ ID NO: 8496 - DNA, 20 bp, human
gcagccacgctgagtcggga

SEQ ID NO: 8497 - DNA, 20 bp, human
gccgcccgcccacccgtcgt

SEQ ID NO: 8498 - DNA, 20 bp, human
ggcggacaagaggcgctgtg

SEQ ID NO: 8499 - DNA, 20 bp, human
gggccgccgctgggatatgg

SEQ ID NO: 8500 - DNA, 20 bp, human
ggccacccggcgcggacaag

SEQ ID NO: 8501 - DNA, 20 bp, human
gtcggcctcgcggactgagc

SEQ ID NO: 8502 - DNA, 20 bp, human
gtccccctcccacgacgggt

SEQ ID NO: 8503 - DNA, 20 bp, human
gaccgcggcaaggggccacc

SEQ ID NO: 8504 - DNA, 20 bp, human
gctgtacccccatatcccag

SEQ ID NO: 8505 - DNA, 20 bp, human
ggggaagcggccggtcagag

SEQ ID NO: 8506 - DNA, 20 bp, human
gcgcggcccgggctacgtcg

SEQ ID NO: 8507 - DNA, 20 bp, human
gtgaccagtcggtagagtca

SEQ ID NO: 8508 - DNA, 20 bp, human
gggaccccgctccccacgga

SEQ ID NO: 8509 - DNA, 20 bp, human
gctacgtcggggccgtccgt

SEQ ID NO: 8510 - DNA, 20 bp, human
gcccgggccgcgtccccaga

SEQ ID NO: 8511 - DNA, 20 bp, human
gctctgcgcggatagaggag

SEQ ID NO: 8512 - DNA, 20 bp, human
gccctcaagacgcggaaccc

SEQ ID NO: 8513 - DNA, 20 bp, human
gccccagaaggcgcagctcg

SEQ ID NO: 8514 - DNA, 20 bp, human
gagagtcagggtgtgaggtc

SEQ ID NO: 8515 - DNA, 20 bp, human
gggaactgcctctgaccagt

SEQ ID NO: 8516 - DNA, 20 bp, human
gccccgggcccagatgacgg

SEQ ID NO: 8517 - DNA, 20 bp, human
gcgggcccagatgacggagg

SEQ ID NO: 8518 - DNA, 20 bp, human
gcgctgagggcaacagaatg

SEQ ID NO: 8519 - DNA, 20 bp, human
gcgcgcggggaaggattccc

SEQ ID NO: 8520 - DNA, 20 bp, human
gaggtccgggaaggggacgt

SEQ ID NO: 8521 - DNA, 20 bp, human
gctgcgatggtgggtatgag

SEQ ID NO: 8522 - DNA, 20 bp, human
gatgcggcttgacagatcca

SEQ ID NO: 8523 - DNA, 20 bp, human
ggcggtggaagggcgacccg

SEQ ID NO: 8524 - DNA, 20 bp, human
gcgcccctagtcaccccgag

SEQ ID NO: 8525 - DNA, 20 bp, human
ggagtggaccctgcgatggt

SEQ ID NO: 8526 - DNA, 20 bp, human
gtcgacgcaagagggactaa

SEQ ID NO: 8527 - DNA, 20 bp, human
gccaggtcgctgccccgggg

SEQ ID NO: 8528 - DNA, 20 bp, human
gtcgcgagccgggtccagag

SEQ ID NO: 8529 - DNA, 20 bp, human
ggcgccccgcagagcagtcg

SEQ ID NO: 8530 - DNA, 20 bp, human
gtctgcgcgctgcgtgggaa

SEQ ID NO: 8531 - DNA, 20 bp, human
ggcccctggttagagacagt

SEQ ID NO: 8532 - DNA, 20 bp, human
gccccggcgtcggacccgac

SEQ ID NO: 8533 - DNA, 20 bp, human
gcgagcgcagcgggtcccca

SEQ ID NO: 8534 - DNA, 20 bp, human
gcggccgggaaagcgacgcg

SEQ ID NO: 8535 - DNA, 20 bp, human
gggtgcagactgccgcaccc

SEQ ID NO: 8536 - DNA, 20 bp, human
ggctccgggaagggcgagac

SEQ ID NO: 8537 - DNA, 20 bp, human
gcccaggccctgccaagccg

SEQ ID NO: 8538 - DNA, 20 bp, human
ggcccgttctggtctcaagt

SEQ ID NO: 8539 - DNA, 20 bp, human
gagactggagcagagccgct

SEQ ID NO: 8540 - DNA, 20 bp, human
ggctgtaaccgcatctgatc

SEQ ID NO: 8541 - DNA, 20 bp, human
gcatctgatctgggcgctcc

SEQ ID NO: 8542 - DNA, 20 bp, human
gcggctgcgggttcccccgg

SEQ ID NO: 8543 - DNA, 20 bp, human
gtccctcagcagccccggct

SEQ ID NO: 8544 - DNA, 20 bp, human
gtcctacttgagaccagaac

SEQ ID NO: 8545 - DNA, 20 bp, human
ggctccagtctcgcccttcc

SEQ ID NO: 8546 - DNA, 20 bp, human
gcaggaacaccggattagag

SEQ ID NO: 8547 - DNA, 20 bp, human
ggaacaccggattagagagg

SEQ ID NO: 8548 - DNA, 20 bp, human
gaatccgaaaggctactctg

SEQ ID NO: 8549 - DNA, 20 bp, human
gtgagagtgcgggccggcag

SEQ ID NO: 8550 - DNA, 20 bp, human
gctggcgccgcacaaatacg

SEQ ID NO: 8551 - DNA, 20 bp, human
gactactggcatgtacccag

SEQ ID NO: 8552 - DNA, 20 bp, human
ggaggacgagggaatccgaa

SEQ ID NO: 8553 - DNA, 20 bp, human
gctctctgtgtagggaccag

SEQ ID NO: 8554 - DNA, 20 bp, human
gtagctccagaggtcgcgct

SEQ ID NO: 8555 - DNA, 20 bp, human
gcgcgctgggctgagagtgc

SEQ ID NO: 8556 - DNA, 20 bp, human
gcagcccgccagggtgtcac

SEQ ID NO: 8557 - DNA, 20 bp, human
ggctgccggactcggaaatg

SEQ ID NO: 8558 - DNA, 20 bp, human
gatggaggtgctgccggact

SEQ ID NO: 8559 - DNA, 20 bp, human
ggtattggtgcagcccgcca

SEQ ID NO: 8560 - DNA, 20 bp, human
gtctccagtgacaccctggc

SEQ ID NO: 8561 - DNA, 20 bp, human
gtctgtctccagtgacaccc

SEQ ID NO: 8562 - DNA, 20 bp, human
gtgcagcatgccaaacgagg

SEQ ID NO: 8563 - DNA, 20 bp, human
gggcgcacgtgaccgacatg

SEQ ID NO: 8564 - DNA, 20 bp, human
gcctaccccatttccgagtc

SEQ ID NO: 8565 - DNA, 20 bp, human
ggcgacaaggacacatgcat

SEQ ID NO: 8566 - DNA, 20 bp, human
gcggagggcaagtagcaagg

SEQ ID NO: 8567 - DNA, 20 bp, human
gcccacctcccacaagatgg

SEQ ID NO: 8568 - DNA, 20 bp, human
gaccgtagggtcccgagcag

SEQ ID NO: 8569 - DNA, 20 bp, human
ggcaggtcccccccgagcag

SEQ ID NO: 8570 - DNA, 20 bp, human
gagtcgggccgagcaccgta

SEQ ID NO: 8571 - DNA, 20 bp, human
gcctcccacaagatggcgga

SEQ ID NO: 8572 - DNA, 20 bp, human
ggcagcggctaggcttccgg

SEQ ID NO: 8573 - DNA, 20 bp, human
gtggcggagggcaagtagca

SEQ ID NO: 8574 - DNA, 20 bp, human
gagggcaagtagcaaggggg

SEQ ID NO: 8575 - DNA, 20 bp, human
gccagggaggcgtacatagg

SEQ ID NO: 8576 - DNA, 20 bp, human
gtctcgcccagcgctaggag

SEQ ID NO: 8577 - DNA, 20 bp, human
gacctccctgaggtgatcgg

SEQ ID NO: 8578 - DNA, 20 bp, human
gtgcgcacacacccactcac

SEQ ID NO: 8579 - DNA, 20 bp, human
gggcggacaaagcccggtcc

SEQ ID NO: 8580 - DNA, 20 bp, human
gcaccatccggacctccctg

SEQ ID NO: 8581 - DNA, 20 bp, human
ggatggtgaagcccgtgagt

SEQ ID NO: 8582 - DNA, 20 bp, human
gcacctcagggaggtccgga

SEQ ID NO: 8583 - DNA, 20 bp, human
gcaaagcccggtccgggcct

SEQ ID NO: 8584 - DNA, 20 bp, human
ggccagtggtgtgtcttcgg

SEQ ID NO: 8585 - DNA, 20 bp, human
gtcctccgatcacctcaggg

SEQ ID NO: 8586 - DNA, 20 bp, human
gcttcttcggggaccaggta

SEQ ID NO: 8587 - DNA, 20 bp, human
ggcagtgaggaggggtccga

SEQ ID NO: 8588 - DNA, 20 bp, human
ggggcggccgcggctccatg

SEQ ID NO: 8589 - DNA, 20 bp, human
gggcccggagccctccccaa

SEQ ID NO: 8590 - DNA, 20 bp, human
ggcggaggctgcagagtcgg

SEQ ID NO: 8591 - DNA, 20 bp, human
gttcccggcaacggtctcta

SEQ ID NO: 8592 - DNA, 20 bp, human
gcggctgcgggggcatcctg

SEQ ID NO: 8593 - DNA, 20 bp, human
gccgcgtcggcgcagtgagg

SEQ ID NO: 8594 - DNA, 20 bp, human
gtcgcagcggcgcacgagag

SEQ ID NO: 8595 - DNA, 20 bp, human
gggaggctcggccctgcgca

SEQ ID NO: 8596 - DNA, 20 bp, human
ggcgccgctctgagctgcag

SEQ ID NO: 8597 - DNA, 20 bp, human
gctcagagcggcgcacgcgg

SEQ ID NO: 8598 - DNA, 20 bp, human
gaactcaccgtgaagcagga

SEQ ID NO: 8599 - DNA, 20 bp, human
gaggcgtcgggtctggatcg

SEQ ID NO: 8600 - DNA, 20 bp, human
gcttcacggtgagttcccga

SEQ ID NO: 8601 - DNA, 20 bp, human
ggagcgctcgagtggccctc

SEQ ID NO: 8602 - DNA, 20 bp, human
ggagcgctcccagccggcgg

SEQ ID NO: 8603 - DNA, 20 bp, human
ggccgggcgcggagaagtcg

SEQ ID NO: 8604 - DNA, 20 bp, human
gcagctcagagcggcgcacg

SEQ ID NO: 8605 - DNA, 20 bp, human
gccggctgggagcgctcgag

SEQ ID NO: 8606 - DNA, 20 bp, human
gagcggagctgcgcactcat

SEQ ID NO: 8607 - DNA, 20 bp, human
gcaagctctggtcccggcca

SEQ ID NO: 8608 - DNA, 20 bp, human
gggtgtgcgcgcctcgccgg

SEQ ID NO: 8609 - DNA, 20 bp, human
gcggcctcatttacagacag

SEQ ID NO: 8610 - DNA, 20 bp, human
gcatttacagacagaggccg

SEQ ID NO: 8611 - DNA, 20 bp, human
ggtggagacagcccccggcg

SEQ ID NO: 8612 - DNA, 20 bp, human
gtccaacttgccagaagagg

SEQ ID NO: 8613 - DNA, 20 bp, human
ggccaggggacggacatctg

SEQ ID NO: 8614 - DNA, 20 bp, human
gcaactatcaacagccggga

SEQ ID NO: 8615 - DNA, 20 bp, human
gcaccaggacgcaagcgtag

SEQ ID NO: 8616 - DNA, 20 bp, human
gagggtagcagacaacacag

SEQ ID NO: 8617 - DNA, 20 bp, human
ggaagcagtgaccaggatga

SEQ ID NO: 8618 - DNA, 20 bp, human
gggacagagatccaaagcag

SEQ ID NO: 8619 - DNA, 20 bp, human
gtgaataacctgaagtctaa

SEQ ID NO: 8620 - DNA, 20 bp, human
ggcatgaatatcagacgcta

SEQ ID NO: 8621 - DNA, 20 bp, human
gtccctgccttgggtattgt

SEQ ID NO: 8622 - DNA, 20 bp, human
ggagagtatagtctatacat

SEQ ID NO: 8623 - DNA, 20 bp, human
gtcttctcctacaataccca

SEQ ID NO: 8624 - DNA, 20 bp, human
gctataggctcgaaaacaca

SEQ ID NO: 8625 - DNA, 20 bp, human
gagctcattatccctgcctt

SEQ ID NO: 8626 - DNA, 20 bp, human
gactatggaacgtcaggtga

SEQ ID NO: 8627 - DNA, 20 bp, human
ggaggagactatggaacgtc

SEQ ID NO: 8628 - DNA, 20 bp, human
gggaagcagcgcggtcggac

SEQ ID NO: 8629 - DNA, 20 bp, human
gcggaggtcaccacgcagta

SEQ ID NO: 8630 - DNA, 20 bp, human
gggcttcggggagggtagaa

SEQ ID NO: 8631 - DNA, 20 bp, human
gagaagggcctacgagagaa

SEQ ID NO: 8632 - DNA, 20 bp, human
gcagtgcgtaagggtatata

SEQ ID NO: 8633 - DNA, 20 bp, human
gcagggaccacggggaccgc

SEQ ID NO: 8634 - DNA, 20 bp, human
ggcagtacggcggccaatac

SEQ ID NO: 8635 - DNA, 20 bp, human
gcctgggagcgagaagtcct

SEQ ID NO: 8636 - DNA, 20 bp, human
ggaggagctaggctgccatc

SEQ ID NO: 8637 - DNA, 20 bp, human
gacgcggtacagctgcccaa

SEQ ID NO: 8638 - DNA, 20 bp, human
gcgtatctgcaccggcccga

SEQ ID NO: 8639 - DNA, 20 bp, human
gatgagctcaggacaggtaa

SEQ ID NO: 8640 - DNA, 20 bp, human
gacggggatgagctcaggac

SEQ ID NO: 8641 - DNA, 20 bp, human
gaggtccgctacccacgtgg

SEQ ID NO: 8642 - DNA, 20 bp, human
gaagggcctatgatgcacgg

SEQ ID NO: 8643 - DNA, 20 bp, human
gcgtgggaaaaagggagcgg

SEQ ID NO: 8644 - DNA, 20 bp, human
gtctttgtgctcgggttagg

SEQ ID NO: 8645 - DNA, 20 bp, human
gccttctttgtgctcgggtt

SEQ ID NO: 8646 - DNA, 20 bp, human
gagttcgctcgcgcctaggt

SEQ ID NO: 8647 - DNA, 20 bp, human
ggctcgcgcctaggttggcg

SEQ ID NO: 8648 - DNA, 20 bp, human
ggcctggccaacttctgaac

SEQ ID NO: 8649 - DNA, 20 bp, human
gtcccagcccgcgccaacct

SEQ ID NO: 8650 - DNA, 20 bp, human
gccacgcgcaacatcttaaa

SEQ ID NO: 8651 - DNA, 20 bp, human
gttggggccggagaatgagt

SEQ ID NO: 8652 - DNA, 20 bp, human
ggcagggatgaagaattcgg

SEQ ID NO: 8653 - DNA, 20 bp, human
gggagatggagtgcaattag

SEQ ID NO: 8654 - DNA, 20 bp, human
gtgggaatctgactagatat

SEQ ID NO: 8655 - DNA, 20 bp, human
gtggtgagctggaacatcaa

SEQ ID NO: 8656 - DNA, 20 bp, human
gggcaacgcgaccccacgag

SEQ ID NO: 8657 - DNA, 20 bp, human
gatgtcacccccagaccccg

SEQ ID NO: 8658 - DNA, 20 bp, human
ggggagagcgtcgaagagag

SEQ ID NO: 8659 - DNA, 20 bp, human
gagcgtcgaagagagaggtg

SEQ ID NO: 8660 - DNA, 20 bp, human
gacgtcgctgggaggaatat

SEQ ID NO: 8661 - DNA, 20 bp, human
gtcggcttccgtagaggaag

SEQ ID NO: 8662 - DNA, 20 bp, human
gccagctggggagtccgcgt

SEQ ID NO: 8663 - DNA, 20 bp, human
gaagcctgggagcctgaatt

SEQ ID NO: 8664 - DNA, 20 bp, human
gtcgctgggaggaatatagg

SEQ ID NO: 8665 - DNA, 20 bp, human
gcccacctgaccagccatgg

SEQ ID NO: 8666 - DNA, 20 bp, human
ggcgatggtgaagacataaa

SEQ ID NO: 8667 - DNA, 20 bp, human
gtccgcggtggccatgactg

SEQ ID NO: 8668 - DNA, 20 bp, human
gtgactgcggccgtgttctt

SEQ ID NO: 8669 - DNA, 20 bp, human
gccccaacgggcccccgggt

SEQ ID NO: 8670 - DNA, 20 bp, human
ggccaccgcggaaaccgacc

SEQ ID NO: 8671 - DNA, 20 bp, human
gaccgcggaaaccgacccgg

SEQ ID NO: 8672 - DNA, 20 bp, human
gtgaggaagatgatacgcaa

SEQ ID NO: 8673 - DNA, 20 bp, human
gcggagatccggctccccaa

SEQ ID NO: 8674 - DNA, 20 bp, human
gtcgcgggtaaccccagcgg

SEQ ID NO: 8675 - DNA, 20 bp, human
ggagcatctcgcgtccccaa

SEQ ID NO: 8676 - DNA, 20 bp, human
ggtttggagaagttccgagg

SEQ ID NO: 8677 - DNA, 20 bp, human
ggcttcccgccgcactcccc

SEQ ID NO: 8678 - DNA, 20 bp, human
gagctggaggtgtaatagtg

SEQ ID NO: 8679 - DNA, 20 bp, human
gcgctgtgcgcggtgactgg

SEQ ID NO: 8680 - DNA, 20 bp, human
ggctgagttaggttacgcca

SEQ ID NO: 8681 - DNA, 20 bp, human
ggttacgccacggtgagaaa

SEQ ID NO: 8682 - DNA, 20 bp, human
gggtggcgccggtcaggaca

SEQ ID NO: 8683 - DNA, 20 bp, human
gtgggtttggagaagttccg

SEQ ID NO: 8684 - DNA, 20 bp, human
gcggtgactggcggctgcac

SEQ ID NO: 8685 - DNA, 20 bp, human
ggccacggtgagaaaaggct

SEQ ID NO: 8686 - DNA, 20 bp, human
gcgaggccccaggagatcag

SEQ ID NO: 8687 - DNA, 20 bp, human
gggagctgggcgccaaacgt

SEQ ID NO: 8688 - DNA, 20 bp, human
gcgccggctgagatatccag

SEQ ID NO: 8689 - DNA, 20 bp, human
gtcctgataaatacccggtg

SEQ ID NO: 8690 - DNA, 20 bp, human
gcccagaccagggacccgcg

SEQ ID NO: 8691 - DNA, 20 bp, human
gctggctgtgatgctcggga

SEQ ID NO: 8692 - DNA, 20 bp, human
gggcctcgctgccgtatccc

SEQ ID NO: 8693 - DNA, 20 bp, human
ggcggcctccaatctccgca

SEQ ID NO: 8694 - DNA, 20 bp, human
gctctcctcctgggaatacc

SEQ ID NO: 8695 - DNA, 20 bp, human
gagatgcggcgcgcaggtag

SEQ ID NO: 8696 - DNA, 20 bp, human
gtatgcccggcgctgatgaa

SEQ ID NO: 8697 - DNA, 20 bp, human
gtggggaggaagcggttcta

SEQ ID NO: 8698 - DNA, 20 bp, human
gcatcagcgccgggcatatg

SEQ ID NO: 8699 - DNA, 20 bp, human
ggctgatgaaaggaacgaat

SEQ ID NO: 8700 - DNA, 20 bp, human
gcgggcatatggggcgtcag

SEQ ID NO: 8701 - DNA, 20 bp, human
gcacttgtcagggtagctgc

SEQ ID NO: 8702 - DNA, 20 bp, human
gaacgcaggagggccgagaa

SEQ ID NO: 8703 - DNA, 20 bp, human
gtaagaataatcacttgtca

SEQ ID NO: 8704 - DNA, 20 bp, human
gggtcggcccgcagtgatgg

SEQ ID NO: 8705 - DNA, 20 bp, human
gtctggaacgctggccctgg

SEQ ID NO: 8706 - DNA, 20 bp, human
gtatgcccggcgctgatgaa

SEQ ID NO: 8707 - DNA, 20 bp, human
gtggggaggaagcggttcta

SEQ ID NO: 8708 - DNA, 20 bp, human
gcatcagcgccgggcatatg

SEQ ID NO: 8709 - DNA, 20 bp, human
ggctgatgaaaggaacgaat

SEQ ID NO: 8710 - DNA, 20 bp, human
gcgggcatatggggcgtcag

SEQ ID NO: 8711 - DNA, 20 bp, human
gcacttgtcagggtagctgc

SEQ ID NO: 8712 - DNA, 20 bp, human
gaacgcaggagggccgagaa

SEQ ID NO: 8713 - DNA, 20 bp, human
gtaagaataatcacttgtca

SEQ ID NO: 8714 - DNA, 20 bp, human
gggtcggcccgcagtgatgg

SEQ ID NO: 8715 - DNA, 20 bp, human
gtctggaacgctggccctgg

SEQ ID NO: 8716 - DNA, 20 bp, human
gcaccgagggagggcctcaa

SEQ ID NO: 8717 - DNA, 20 bp, human
gggccgggctctgagaggac

SEQ ID NO: 8718 - DNA, 20 bp, human
gccctgggaaaaaacaccga

SEQ ID NO: 8719 - DNA, 20 bp, human
gcgctgctgggagtaagtgt

SEQ ID NO: 8720 - DNA, 20 bp, human
ggctggggccgggctctgag

SEQ ID NO: 8721 - DNA, 20 bp, human
gctgtggagggcggaaacag

SEQ ID NO: 8722 - DNA, 20 bp, human
ggggcctcaaaggctccccg

SEQ ID NO: 8723 - DNA, 20 bp, human
ggggaaaaaacaccgaggga

SEQ ID NO: 8724 - DNA, 20 bp, human
ggagccggcgcggaactcca

SEQ ID NO: 8725 - DNA, 20 bp, human
gagaggaccggcgcagccgc

SEQ ID NO: 8726 - DNA, 20 bp, human
ggagcattctctctggcagc

SEQ ID NO: 8727 - DNA, 20 bp, human
gggcggggagagtgcgaata

SEQ ID NO: 8728 - DNA, 20 bp, human
gctctggcagccggggtcac

SEQ ID NO: 8729 - DNA, 20 bp, human
ggcggcgagctctttcttag

SEQ ID NO: 8730 - DNA, 20 bp, human
gggggagagtgcgaataggg

SEQ ID NO: 8731 - DNA, 20 bp, human
gcggagggaaaggagcacgc

SEQ ID NO: 8732 - DNA, 20 bp, human
gatgcagcccctggagtgag

SEQ ID NO: 8733 - DNA, 20 bp, human
gagagtgcgaatagggcgga

SEQ ID NO: 8734 - DNA, 20 bp, human
gtcgcgccgggctccccggg

SEQ ID NO: 8735 - DNA, 20 bp, human
gccttgaccgcggtgtgtgg

SEQ ID NO: 8736 - DNA, 20 bp, human
gaggagacaggcttcctcca

SEQ ID NO: 8737 - DNA, 20 bp, human
gagtgtcttaactgagacgg

SEQ ID NO: 8738 - DNA, 20 bp, human
gtcatagtcccggtacgtgt

SEQ ID NO: 8739 - DNA, 20 bp, human
gtcccggctgctccgaaaca

SEQ ID NO: 8740 - DNA, 20 bp, human
gggcaccacgggcaacggtc

SEQ ID NO: 8741 - DNA, 20 bp, human
gcttaactgagacgggggta

SEQ ID NO: 8742 - DNA, 20 bp, human
gtacgtgtaggtagcccaca

SEQ ID NO: 8743 - DNA, 20 bp, human
gttgcagaagaaggtcccaa

SEQ ID NO: 8744 - DNA, 20 bp, human
gagggtggaggaaattctgc

SEQ ID NO: 8745 - DNA, 20 bp, human
gaggggcagcgtcaccacga

SEQ ID NO: 8746 - DNA, 20 bp, human
ggctggacttctgggaccag

SEQ ID NO: 8747 - DNA, 20 bp, human
gggagctcctgtcaccgctg

SEQ ID NO: 8748 - DNA, 20 bp, human
gctatgctcgagatgggagg

SEQ ID NO: 8749 - DNA, 20 bp, human
gaggggacgtgagggcgcaa

SEQ ID NO: 8750 - DNA, 20 bp, human
gcgggccgggcgggagtgca

SEQ ID NO: 8751 - DNA, 20 bp, human
gctgggacgtcgcatgatgg

SEQ ID NO: 8752 - DNA, 20 bp, human
ggccggcgcggacatgtcca

SEQ ID NO: 8753 - DNA, 20 bp, human
ggcccggccccagcggtgac

SEQ ID NO: 8754 - DNA, 20 bp, human
ggctggcgggccccatgtcc

SEQ ID NO: 8755 - DNA, 20 bp, human
gggcgcaagggccgggacat

SEQ ID NO: 8756 - DNA, 20 bp, human
ggccgcgcgctagagcgacc

SEQ ID NO: 8757 - DNA, 20 bp, human
gagagcgacccggcgaggga

SEQ ID NO: 8758 - DNA, 20 bp, human
gggcactgggtccccggagg

SEQ ID NO: 8759 - DNA, 20 bp, human
gggccaaatgaaaggcgtcg

SEQ ID NO: 8760 - DNA, 20 bp, human
ggccgggtcgctctagcgcg

SEQ ID NO: 8761 - DNA, 20 bp, human
ggctctcaagctcacacact

SEQ ID NO: 8762 - DNA, 20 bp, human
ggtggccgccatccctcgcc

SEQ ID NO: 8763 - DNA, 20 bp, human
ggcgctggccggctacatcg

SEQ ID NO: 8764 - DNA, 20 bp, human
gggcgaaggagacgactctc

SEQ ID NO: 8765 - DNA, 20 bp, human
gtggccggctacatcgaggt

SEQ ID NO: 8766 - DNA, 20 bp, human
gtaccatgagcgaggcggac

SEQ ID NO: 8767 - DNA, 20 bp, human
gggcgccgctcagtgtgagg

SEQ ID NO: 8768 - DNA, 20 bp, human
ggccggcgccgctcagtgtg

SEQ ID NO: 8769 - DNA, 20 bp, human
ggcaaccgctatgcagggtg

SEQ ID NO: 8770 - DNA, 20 bp, human
ggcccgtaccatgagcgagg

SEQ ID NO: 8771 - DNA, 20 bp, human
ggacagcgcgaggggagcga

SEQ ID NO: 8772 - DNA, 20 bp, human
gtgacgacctgcggccgcag

SEQ ID NO: 8773 - DNA, 20 bp, human
gcggagagccgaggacaacg

SEQ ID NO: 8774 - DNA, 20 bp, human
gcggcagtaacagtaacctg

SEQ ID NO: 8775 - DNA, 20 bp, human
gagcccgtccgcctcgctca

SEQ ID NO: 8776 - DNA, 20 bp, human
gtggggagccagagtgaccg

SEQ ID NO: 8777 - DNA, 20 bp, human
gaggcctgaaccttgagctg

SEQ ID NO: 8778 - DNA, 20 bp, human
gcttagagactgcgagaagg

SEQ ID NO: 8779 - DNA, 20 bp, human
gctgcctgccccggtcactc

SEQ ID NO: 8780 - DNA, 20 bp, human
ggaagacctcaggtacccag

SEQ ID NO: 8781 - DNA, 20 bp, human
gtgcagccaggtgaggagaa

SEQ ID NO: 8782 - DNA, 20 bp, human
gtagggagccaaccatcggg

SEQ ID NO: 8783 - DNA, 20 bp, human
gctgcttagagactgcgaga

SEQ ID NO: 8784 - DNA, 20 bp, human
gcagagcgggagaagacctc

SEQ ID NO: 8785 - DNA, 20 bp, human
gggctgagatctgagccgaa

SEQ ID NO: 8786 - DNA, 20 bp, human
ggtggtgaagtacctgaggt

SEQ ID NO: 8787 - DNA, 20 bp, human
gctctgcgagctggatgtcc

SEQ ID NO: 8788 - DNA, 20 bp, human
gtgggacagtgactcctccc

SEQ ID NO: 8789 - DNA, 20 bp, human
gccctggcctaggcacaaag

SEQ ID NO: 8790 - DNA, 20 bp, human
ggcgcgacagagaacacgag

SEQ ID NO: 8791 - DNA, 20 bp, human
gcgagacccgtgcctacctc

SEQ ID NO: 8792 - DNA, 20 bp, human
gtgcctgaaggcagagtcaa

SEQ ID NO: 8793 - DNA, 20 bp, human
gttcagcgtggaccaactta

SEQ ID NO: 8794 - DNA, 20 bp, human
gcacggtggtgaagtacctg

SEQ ID NO: 8795 - DNA, 20 bp, human
gaagtacctgaggtaggcac

SEQ ID NO: 8796 - DNA, 20 bp, human
gacgctggctaggtaagata

SEQ ID NO: 8797 - DNA, 20 bp, human
gctggctaggtaagataagg

SEQ ID NO: 8798 - DNA, 20 bp, human
ggggcggcctaggaagaggg

SEQ ID NO: 8799 - DNA, 20 bp, human
gaggtatccagccagatctt

SEQ ID NO: 8800 - DNA, 20 bp, human
ggaggcctgggcttcagttg

SEQ ID NO: 8801 - DNA, 20 bp, human
ggtgtgagcagcatccaaag

SEQ ID NO: 8802 - DNA, 20 bp, human
gaaggacagagacgctggct

SEQ ID NO: 8803 - DNA, 20 bp, human
ggctgcgagcagcttcatgt

SEQ ID NO: 8804 - DNA, 20 bp, human
gctggggtgggtactggcag

SEQ ID NO: 8805 - DNA, 20 bp, human
ggacctggatataagagcac

SEQ ID NO: 8806 - DNA, 20 bp, human
ggcgcaggtgagctctcctg

SEQ ID NO: 8807 - DNA, 20 bp, human
gttgtagggaggatccagtg

SEQ ID NO: 8808 - DNA, 20 bp, human
gcagaggcccggccagttag

SEQ ID NO: 8809 - DNA, 20 bp, human
gctgcagactggatgatggt

SEQ ID NO: 8810 - DNA, 20 bp, human
gtctgagtagtgcaggatgg

SEQ ID NO: 8811 - DNA, 20 bp, human
gtggatcctccctacaatca

SEQ ID NO: 8812 - DNA, 20 bp, human
gtgaggccccgtctcctgtg

SEQ ID NO: 8813 - DNA, 20 bp, human
gcagggaaaatggcaggttg

SEQ ID NO: 8814 - DNA, 20 bp, human
gagctcccctgattgtaggg

SEQ ID NO: 8815 - DNA, 20 bp, human
gcaggtggccacggtgatgt

SEQ ID NO: 8816 - DNA, 20 bp, human
gatggctgccgtgctcacct

SEQ ID NO: 8817 - DNA, 20 bp, human
gacagaggttgaggcagcag

SEQ ID NO: 8818 - DNA, 20 bp, human
ggtcttctcagagcaggtaa

SEQ ID NO: 8819 - DNA, 20 bp, human
gcggccacccaggcacggaa

SEQ ID NO: 8820 - DNA, 20 bp, human
gcccacgttgaagtcagggt

SEQ ID NO: 8821 - DNA, 20 bp, human
ggcattgcaggtggcctcag

SEQ ID NO: 8822 - DNA, 20 bp, human
gtacggagttgtcaaggcgg

SEQ ID NO: 8823 - DNA, 20 bp, human
gtgcagatcccggccatcct

SEQ ID NO: 8824 - DNA, 20 bp, human
ggagcaggtaatggcaagca

SEQ ID NO: 8825 - DNA, 20 bp, human
gtgggtggccgaaaacgctg

SEQ ID NO: 8826 - DNA, 20 bp, human
ggcacccgctgggaagacgt

SEQ ID NO: 8827 - DNA, 20 bp, human
gcagcggcagcaaccgagaa

SEQ ID NO: 8828 - DNA, 20 bp, human
gggcccgacagggggaccac

SEQ ID NO: 8829 - DNA, 20 bp, human
ggggtgctagggcccgacag

SEQ ID NO: 8830 - DNA, 20 bp, human
gcagccccgcaggtcccggt

SEQ ID NO: 8831 - DNA, 20 bp, human
gagcctgcctccctcctgaa

SEQ ID NO: 8832 - DNA, 20 bp, human
gtccatcgccagctgcggtg

SEQ ID NO: 8833 - DNA, 20 bp, human
gacagggggaccaccggcac

SEQ ID NO: 8834 - DNA, 20 bp, human
gcgggtgtaggagagtgcac

SEQ ID NO: 8835 - DNA, 20 bp, human
gcactcagccccgcaggtcc

SEQ ID NO: 8836 - DNA, 20 bp, human
gaaaggtaaaatggatccgg

SEQ ID NO: 8837 - DNA, 20 bp, human
ggcacaacttatgactccag

SEQ ID NO: 8838 - DNA, 20 bp, human
gcaacttatgactccagagg

SEQ ID NO: 8839 - DNA, 20 bp, human
ggcaccatgacttctgagaa

SEQ ID NO: 8840 - DNA, 20 bp, human
gagaatacttgccaagcccc

SEQ ID NO: 8841 - DNA, 20 bp, human
gagtcatggtgctctgtctc

SEQ ID NO: 8842 - DNA, 20 bp, human
gttacctttctcagaagtca

SEQ ID NO: 8843 - DNA, 20 bp, human
gtaaaatggatccgggggct

SEQ ID NO: 8844 - DNA, 20 bp, human
gtgctgattcttgcatctgt

SEQ ID NO: 8845 - DNA, 20 bp, human
ggctacttaattttttatca

SEQ ID NO: 8846 - DNA, 20 bp, human
gctgtgacaatctcaaaggg

SEQ ID NO: 8847 - DNA, 20 bp, human
gtaccaggaggcctgaaggg

SEQ ID NO: 8848 - DNA, 20 bp, human
ggcaccagtgggcccggcag

SEQ ID NO: 8849 - DNA, 20 bp, human
ggcagtgagagtgcaccagt

SEQ ID NO: 8850 - DNA, 20 bp, human
gcagggtaagcctcagatgt

SEQ ID NO: 8851 - DNA, 20 bp, human
gtccatggcccagaaggaag

SEQ ID NO: 8852 - DNA, 20 bp, human
gagctgtcagcagctaaatc

SEQ ID NO: 8853 - DNA, 20 bp, human
gtgtggctcaggagtcactg

SEQ ID NO: 8854 - DNA, 20 bp, human
ggggctctctaatcagggag

SEQ ID NO: 8855 - DNA, 20 bp, human
gctaatcagggagaggtagg

SEQ ID NO: 8856 - DNA, 20 bp, human
gcacagaccaggaaccgaga

SEQ ID NO: 8857 - DNA, 20 bp, human
gagcaagtcgcaagagcggg

SEQ ID NO: 8858 - DNA, 20 bp, human
gcttgagcaagtcgcaagag

SEQ ID NO: 8859 - DNA, 20 bp, human
gccagtgaagacggtcagag

SEQ ID NO: 8860 - DNA, 20 bp, human
gtaggccaagtccagataca

SEQ ID NO: 8861 - DNA, 20 bp, human
gagcatccgggcccaggtat

SEQ ID NO: 8862 - DNA, 20 bp, human
gggcgcagaggtgctcggag

SEQ ID NO: 8863 - DNA, 20 bp, human
gttgcgacttgctcaaggcg

SEQ ID NO: 8864 - DNA, 20 bp, human
gctggaattggtaccatcgg

SEQ ID NO: 8865 - DNA, 20 bp, human
gtcttcaccaacattctctt

SEQ ID NO: 8866 - DNA, 20 bp, human
gcacagaccaggaaccgaga

SEQ ID NO: 8867 - DNA, 20 bp, human
gagcaagtcgcaagagcggg

SEQ ID NO: 8868 - DNA, 20 bp, human
gcttgagcaagtcgcaagag

SEQ ID NO: 8869 - DNA, 20 bp, human
gccagtgaagacggtcagag

SEQ ID NO: 8870 - DNA, 20 bp, human
gtaggccaagtccagataca

SEQ ID NO: 8871 - DNA, 20 bp, human
gagcatccgggcccaggtat

SEQ ID NO: 8872 - DNA, 20 bp, human
gggcgcagaggtgctcggag

SEQ ID NO: 8873 - DNA, 20 bp, human
gttgcgacttgctcaaggcg

SEQ ID NO: 8874 - DNA, 20 bp, human
gctggaattggtaccatcgg

SEQ ID NO: 8875 - DNA, 20 bp, human
gtcttcaccaacattctctt

SEQ ID NO: 8876 - DNA, 20 bp, human
gagcctgactgggattcgtg

SEQ ID NO: 8877 - DNA, 20 bp, human
ggggcggggagcaccagtcc

SEQ ID NO: 8878 - DNA, 20 bp, human
gttcaaaaaaagagcgggac

SEQ ID NO: 8879 - DNA, 20 bp, human
gcaggacaaagagcctgact

SEQ ID NO: 8880 - DNA, 20 bp, human
gcactcctgagctcagaaac

SEQ ID NO: 8881 - DNA, 20 bp, human
gctgggagaattgaaccaaa

SEQ ID NO: 8882 - DNA, 20 bp, human
ggagggtgcgggggtaggaa

SEQ ID NO: 8883 - DNA, 20 bp, human
ggcctgggctggtgcaggta

SEQ ID NO: 8884 - DNA, 20 bp, human
gctctttttttgaagctctg

SEQ ID NO: 8885 - DNA, 20 bp, human
gagtccgggcatgactttaa

SEQ ID NO: 8886 - DNA, 20 bp, human
gcagagctcccaggaatagt

SEQ ID NO: 8887 - DNA, 20 bp, human
gcagcgcttcagaaaagagt

SEQ ID NO: 8888 - DNA, 20 bp, human
gttcagaaaagagtgggaca

SEQ ID NO: 8889 - DNA, 20 bp, human
gtggcggacaaagcgtgcag

SEQ ID NO: 8890 - DNA, 20 bp, human
ggagtctcagcaggcggact

SEQ ID NO: 8891 - DNA, 20 bp, human
gtgtgcttcccactattcct

SEQ ID NO: 8892 - DNA, 20 bp, human
gctctgggctccctcccccc

SEQ ID NO: 8893 - DNA, 20 bp, human
ggcccgggcatgattttcgg

SEQ ID NO: 8894 - DNA, 20 bp, human
gcagcaggcggactgggctg

SEQ ID NO: 8895 - DNA, 20 bp, human
gcccagggccttgtgaatca

SEQ ID NO: 8896 - DNA, 20 bp, human
gcagagctcccaggaatagt

SEQ ID NO: 8897 - DNA, 20 bp, human
gcagcgcttcagaaaagagt

SEQ ID NO: 8898 - DNA, 20 bp, human
gttcagaaaagagtgggaca

SEQ ID NO: 8899 - DNA, 20 bp, human
gtggcggacaaagcgtgcag

SEQ ID NO: 8900 - DNA, 20 bp, human
ggagtctcagcaggcggact

SEQ ID NO: 8901 - DNA, 20 bp, human
gtgtgcttcccactattcct

SEQ ID NO: 8902 - DNA, 20 bp, human
gctctgggctccctcccccc

SEQ ID NO: 8903 - DNA, 20 bp, human
ggcccgggcatgattttcgg

SEQ ID NO: 8904 - DNA, 20 bp, human
gcagcaggcggactgggctg

SEQ ID NO: 8905 - DNA, 20 bp, human
gcccagggccttgtgaatca

SEQ ID NO: 8906 - DNA, 20 bp, human
gggagggctgtcctgaaacc

SEQ ID NO: 8907 - DNA, 20 bp, human
gaatggcggaaagaacacag

SEQ ID NO: 8908 - DNA, 20 bp, human
gcagagcaggaaaaagagcc

SEQ ID NO: 8909 - DNA, 20 bp, human
gcccccgccaccgaaagtca

SEQ ID NO: 8910 - DNA, 20 bp, human
ggccctgccatgactttcgg

SEQ ID NO: 8911 - DNA, 20 bp, human
ggccaccgaaagtcatggca

SEQ ID NO: 8912 - DNA, 20 bp, human
gaaggatgattagagcaatg

SEQ ID NO: 8913 - DNA, 20 bp, human
gagtggggcaaccacagagc

SEQ ID NO: 8914 - DNA, 20 bp, human
gtgtcctgaaacctggagcc

SEQ ID NO: 8915 - DNA, 20 bp, human
gagcctggctgggagtggcg

SEQ ID NO: 8916 - DNA, 20 bp, human
gacctgggctgggacagatg

SEQ ID NO: 8917 - DNA, 20 bp, human
gaggagcctggctgggagta

SEQ ID NO: 8918 - DNA, 20 bp, human
gtccagagttcaggaatggc

SEQ ID NO: 8919 - DNA, 20 bp, human
gccaaaggatgagtagagca

SEQ ID NO: 8920 - DNA, 20 bp, human
gcccctgaaagtcatggctg

SEQ ID NO: 8921 - DNA, 20 bp, human
gctgaaagtcatggctgggg

SEQ ID NO: 8922 - DNA, 20 bp, human
gaaggtggaattttgttcac

SEQ ID NO: 8923 - DNA, 20 bp, human
gaaggatgagtagagcaagg

SEQ ID NO: 8924 - DNA, 20 bp, human
gtgtcctaaaaccagaagct

SEQ ID NO: 8925 - DNA, 20 bp, human
gactttctgctccaagcttc

SEQ ID NO: 8926 - DNA, 20 bp, human
gtagtgcctcagacaagcag

SEQ ID NO: 8927 - DNA, 20 bp, human
gcagggcaaagagcctgggt

SEQ ID NO: 8928 - DNA, 20 bp, human
gacttgcccctgcttgtctg

SEQ ID NO: 8929 - DNA, 20 bp, human
gacagcagggcaaagagcct

SEQ ID NO: 8930 - DNA, 20 bp, human
ggagagcaccctcccaaggt

SEQ ID NO: 8931 - DNA, 20 bp, human
gaactgaactaaaggatgat

SEQ ID NO: 8932 - DNA, 20 bp, human
gtccagagcccaggaatggc

SEQ ID NO: 8933 - DNA, 20 bp, human
gtgccgcccactctgtccac

SEQ ID NO: 8934 - DNA, 20 bp, human
gtagtgctccccaccttggg

SEQ ID NO: 8935 - DNA, 20 bp, human
gggctagtgctccccacctt

SEQ ID NO: 8936 - DNA, 20 bp, human
gggtagccacacctcagcaa

SEQ ID NO: 8937 - DNA, 20 bp, human
ggaaagcccttgctgaggtg

SEQ ID NO: 8938 - DNA, 20 bp, human
gcagcaagggctttctaact

SEQ ID NO: 8939 - DNA, 20 bp, human
gtgtgagtggcccctggact

SEQ ID NO: 8940 - DNA, 20 bp, human
gctcccacggtcccagtcca

SEQ ID NO: 8941 - DNA, 20 bp, human
gatggaaagctgtcctccca

SEQ ID NO: 8942 - DNA, 20 bp, human
ggcagattgtccttatggtg

SEQ ID NO: 8943 - DNA, 20 bp, human
gcaggcttggatcacattcc

SEQ ID NO: 8944 - DNA, 20 bp, human
ggagtcctgaacccattaca

SEQ ID NO: 8945 - DNA, 20 bp, human
gtctgaagctacttgaaaca

SEQ ID NO: 8946 - DNA, 20 bp, human
gcagcccagggaggtatagc

SEQ ID NO: 8947 - DNA, 20 bp, human
gcccagggaggtatagccgg

SEQ ID NO: 8948 - DNA, 20 bp, human
gcccaggaggtaggagacaa

SEQ ID NO: 8949 - DNA, 20 bp, human
gagccagggcccccagggaa

SEQ ID NO: 8950 - DNA, 20 bp, human
gaaggtgccgagggaatcct

SEQ ID NO: 8951 - DNA, 20 bp, human
gagacaggatggacttcctc

SEQ ID NO: 8952 - DNA, 20 bp, human
gagagaggggagagtcattg

SEQ ID NO: 8953 - DNA, 20 bp, human
gtcctccggctatacctccc

SEQ ID NO: 8954 - DNA, 20 bp, human
gtaggagacaaaggtgccga

SEQ ID NO: 8955 - DNA, 20 bp, human
gctcaccagtgcccccctca

SEQ ID NO: 8956 - DNA, 20 bp, human
gggcagaggcagccaagtag

SEQ ID NO: 8957 - DNA, 20 bp, human
ggacgcgggatgtggaactg

SEQ ID NO: 8958 - DNA, 20 bp, human
ggagctggacggaagcacag

SEQ ID NO: 8959 - DNA, 20 bp, human
gggactcaaaagcctctact

SEQ ID NO: 8960 - DNA, 20 bp, human
gataggcctctcccagtgac

SEQ ID NO: 8961 - DNA, 20 bp, human
gcaacccaggacgcgggatg

SEQ ID NO: 8962 - DNA, 20 bp, human
gccagggagggaggaccttg

SEQ ID NO: 8963 - DNA, 20 bp, human
gaggcttttgagtccaggga

SEQ ID NO: 8964 - DNA, 20 bp, human
gggctgacaacccaggacgc

SEQ ID NO: 8965 - DNA, 20 bp, human
gtagaggccgaggaatctgc

SEQ ID NO: 8966 - DNA, 20 bp, human
gcccaacgctcacgggacag

SEQ ID NO: 8967 - DNA, 20 bp, human
ggacccacccgaccacgatg

SEQ ID NO: 8968 - DNA, 20 bp, human
gagacgctgagttaaggaag

SEQ ID NO: 8969 - DNA, 20 bp, human
gctccagcaaggattcaggt

SEQ ID NO: 8970 - DNA, 20 bp, human
ggagggaggcaggcggtcag

SEQ ID NO: 8971 - DNA, 20 bp, human
gccactcagaatgtagcagg

SEQ ID NO: 8972 - DNA, 20 bp, human
gttcctcagacgctgagtta

SEQ ID NO: 8973 - DNA, 20 bp, human
ggaggtgagagtgctgaacg

SEQ ID NO: 8974 - DNA, 20 bp, human
gtgagtttcttgcagagtgt

SEQ ID NO: 8975 - DNA, 20 bp, human
ggaggcaggcggtcagggga

SEQ ID NO: 8976 - DNA, 20 bp, human
gaggacagcctgccagagtc

SEQ ID NO: 8977 - DNA, 20 bp, human
ggccagagtctggtaagaaa

SEQ ID NO: 8978 - DNA, 20 bp, human
ggtcctcaccagctccggac

SEQ ID NO: 8979 - DNA, 20 bp, human
gactcagggtgcggggacag

SEQ ID NO: 8980 - DNA, 20 bp, human
ggctccggacgggcacagag

SEQ ID NO: 8981 - DNA, 20 bp, human
gtgcccgtccggagctggtg

SEQ ID NO: 8982 - DNA, 20 bp, human
gggacaggggggcgtcagca

SEQ ID NO: 8983 - DNA, 20 bp, human
gtctggtaagaaagggactc

SEQ ID NO: 8984 - DNA, 20 bp, human
gcttctgcttagagttaggg

SEQ ID NO: 8985 - DNA, 20 bp, human
gtccctttcttaccagactc

SEQ ID NO: 8986 - DNA, 20 bp, human
gctccaggtaatgccctctg

SEQ ID NO: 8987 - DNA, 20 bp, human
gcctggagcagctgcctcta

SEQ ID NO: 8988 - DNA, 20 bp, human
gctccccagagggcattacc

SEQ ID NO: 8989 - DNA, 20 bp, human
gctgctcagttcatccctag

SEQ ID NO: 8990 - DNA, 20 bp, human
gagggatgaactgagcagac

SEQ ID NO: 8991 - DNA, 20 bp, human
ggcgagggatcgaggcccaa

SEQ ID NO: 8992 - DNA, 20 bp, human
gctgaacatcaaggcacctg

SEQ ID NO: 8993 - DNA, 20 bp, human
gggtgccttgatgttcagtc

SEQ ID NO: 8994 - DNA, 20 bp, human
gggagatcagtccagaccgc

SEQ ID NO: 8995 - DNA, 20 bp, human
gcatcaaggcacctgcggtc

SEQ ID NO: 8996 - DNA, 20 bp, human
gggccaggaccagcacgcag

SEQ ID NO: 8997 - DNA, 20 bp, human
gggcctggagcctgtttctg

SEQ ID NO: 8998 - DNA, 20 bp, human
gtgaggagggacatttctgg

SEQ ID NO: 8999 - DNA, 20 bp, human
gcccgcagagttgagcacag

SEQ ID NO: 9000 - DNA, 20 bp, human
gaatgtccctcctcagaaac

SEQ ID NO: 9001 - DNA, 20 bp, human
ggccacgtgagacatgagta

SEQ ID NO: 9002 - DNA, 20 bp, human
gagtgtgtggacatgtgtga

SEQ ID NO: 9003 - DNA, 20 bp, human
gagtgtggctgtgtgtcctg

SEQ ID NO: 9004 - DNA, 20 bp, human
gtgtggggcccacacctggt

SEQ ID NO: 9005 - DNA, 20 bp, human
gcacgtgcgtgcgtggaagt

SEQ ID NO: 9006 - DNA, 20 bp, human
gcaagacaggcatctcaaat

SEQ ID NO: 9007 - DNA, 20 bp, human
gttctcagcaagctgtccaa

SEQ ID NO: 9008 - DNA, 20 bp, human
gccctccaaactggacaacg

SEQ ID NO: 9009 - DNA, 20 bp, human
ggcttgctgagaattcacct

SEQ ID NO: 9010 - DNA, 20 bp, human
gatctggaaactggaattaa

SEQ ID NO: 9011 - DNA, 20 bp, human
gcgctgggatgagttcacac

SEQ ID NO: 9012 - DNA, 20 bp, human
ggcatcgcagtaaaataatc

SEQ ID NO: 9013 - DNA, 20 bp, human
gagatgcctgtcttggtgac

SEQ ID NO: 9014 - DNA, 20 bp, human
ggttatatgtagctgaaatg

SEQ ID NO: 9015 - DNA, 20 bp, human
gagaacaagtctaaagctac

SEQ ID NO: 9016 - DNA, 20 bp, human
gcggtgagaagcgcagtcgg

SEQ ID NO: 9017 - DNA, 20 bp, human
gggcacggggatgagctcag

SEQ ID NO: 9018 - DNA, 20 bp, human
gacccgacccgctagaaggt

SEQ ID NO: 9019 - DNA, 20 bp, human
gctctcctgagactacctgg

SEQ ID NO: 9020 - DNA, 20 bp, human
gaacacggcgcttaactgtg

SEQ ID NO: 9021 - DNA, 20 bp, human
gccccagttatggagatctg

SEQ ID NO: 9022 - DNA, 20 bp, human
gacgtccttcacctccgctg

SEQ ID NO: 9023 - DNA, 20 bp, human
gcggcgcttaactgtgaggt

SEQ ID NO: 9024 - DNA, 20 bp, human
ggtctcaggagagctactcg

SEQ ID NO: 9025 - DNA, 20 bp, human
ggacgacccgacccgctaga

SEQ ID NO: 9026 - DNA, 20 bp, human
gcctcatgggacacagaact

SEQ ID NO: 9027 - DNA, 20 bp, human
ggaagcgatcaaacctacca

SEQ ID NO: 9028 - DNA, 20 bp, human
gacacagaactaggcagaac

SEQ ID NO: 9029 - DNA, 20 bp, human
ggaccaagtgggagcaactg

SEQ ID NO: 9030 - DNA, 20 bp, human
gtaaatgggggagaccaagt

SEQ ID NO: 9031 - DNA, 20 bp, human
gcctggtgacctgtaaatgg

SEQ ID NO: 9032 - DNA, 20 bp, human
gttctgtgtcccatgaggaa

SEQ ID NO: 9033 - DNA, 20 bp, human
gtctcaatgactggactgtg

SEQ ID NO: 9034 - DNA, 20 bp, human
ggagcccaaagttcagaact

SEQ ID NO: 9035 - DNA, 20 bp, human
gtggggtccctatatatggg

SEQ ID NO: 9036 - DNA, 20 bp, human
gcattgtggatgagtcacac

SEQ ID NO: 9037 - DNA, 20 bp, human
gccgtcctgcaatagcaaca

SEQ ID NO: 9038 - DNA, 20 bp, human
gtcgagaacaagatgagcac

SEQ ID NO: 9039 - DNA, 20 bp, human
gtagcagacgaaaaccactt

SEQ ID NO: 9040 - DNA, 20 bp, human
gcacactggcactaccaaag

SEQ ID NO: 9041 - DNA, 20 bp, human
gatccctgacatatacgaag

SEQ ID NO: 9042 - DNA, 20 bp, human
gctgacatatacgaaggggt

SEQ ID NO: 9043 - DNA, 20 bp, human
ggggatcaataatgataagt

SEQ ID NO: 9044 - DNA, 20 bp, human
gcaataatgataagtaggcc

SEQ ID NO: 9045 - DNA, 20 bp, human
gtctgccatgttgctattgc

SEQ ID NO: 9046 - DNA, 20 bp, human
ggggctatgtgtcccgagga

SEQ ID NO: 9047 - DNA, 20 bp, human
gctctgtgcaaagagagtaa

SEQ ID NO: 9048 - DNA, 20 bp, human
gatacccagaatccaaatga

SEQ ID NO: 9049 - DNA, 20 bp, human
gagccgggctatgtgtcccg

SEQ ID NO: 9050 - DNA, 20 bp, human
gctgcactctgagcatgacg

SEQ ID NO: 9051 - DNA, 20 bp, human
gtacatttcagagtgttgat

SEQ ID NO: 9052 - DNA, 20 bp, human
gagatcatagcctgaaacta

SEQ ID NO: 9053 - DNA, 20 bp, human
gagagaaatgagaaggtctt

SEQ ID NO: 9054 - DNA, 20 bp, human
gcaaagagagtaagggtaat

SEQ ID NO: 9055 - DNA, 20 bp, human
gtaggtttaaaaatgagatc

SEQ ID NO: 9056 - DNA, 20 bp, human
gtgctgctgaggcccaatgg

SEQ ID NO: 9057 - DNA, 20 bp, human
gcagacgcataactggaggt

SEQ ID NO: 9058 - DNA, 20 bp, human
ggtggcctggccataagaac

SEQ ID NO: 9059 - DNA, 20 bp, human
gtatacagacgcataactgg

SEQ ID NO: 9060 - DNA, 20 bp, human
gggggactggaggacctgtc

SEQ ID NO: 9061 - DNA, 20 bp, human
gctggccataagaacaggct

SEQ ID NO: 9062 - DNA, 20 bp, human
ggtctcagcagtcaaaacca

SEQ ID NO: 9063 - DNA, 20 bp, human
gcagtccccaagatataccg

SEQ ID NO: 9064 - DNA, 20 bp, human
gataagaacaggctgggatc

SEQ ID NO: 9065 - DNA, 20 bp, human
ggtctgtataataaccagac

SEQ ID NO: 9066 - DNA, 20 bp, human
ggcgggtaaactgtagagag

SEQ ID NO: 9067 - DNA, 20 bp, human
gctgaccccagaagaaaggt

SEQ ID NO: 9068 - DNA, 20 bp, human
gccagctgaccccagaagaa

SEQ ID NO: 9069 - DNA, 20 bp, human
gccagaagaaaggtaggtgt

SEQ ID NO: 9070 - DNA, 20 bp, human
gacagatgcacagctggacg

SEQ ID NO: 9071 - DNA, 20 bp, human
ggtcagctggccgtgtctga

SEQ ID NO: 9072 - DNA, 20 bp, human
gccggccacaaggacatgcc

SEQ ID NO: 9073 - DNA, 20 bp, human
ggttctgacaccctcagaca

SEQ ID NO: 9074 - DNA, 20 bp, human
gcggcctcccagatataccc

SEQ ID NO: 9075 - DNA, 20 bp, human
gattccagggtatatctggg

SEQ ID NO: 9076 - DNA, 20 bp, human
gcagatgcacggctggaggt

SEQ ID NO: 9077 - DNA, 20 bp, human
ggccaggccacaagaaggac

SEQ ID NO: 9078 - DNA, 20 bp, human
gagagcctggagaacgtgtc

SEQ ID NO: 9079 - DNA, 20 bp, human
gcaggctctgagatataccc

SEQ ID NO: 9080 - DNA, 20 bp, human
ggaccacccctaacttacca

SEQ ID NO: 9081 - DNA, 20 bp, human
gagaagtccagctaaaacct

SEQ ID NO: 9082 - DNA, 20 bp, human
gtggttattatgcagatgca

SEQ ID NO: 9083 - DNA, 20 bp, human
gtatttggaggaaccagaga

SEQ ID NO: 9084 - DNA, 20 bp, human
gtattatgcagatgcacggc

SEQ ID NO: 9085 - DNA, 20 bp, human
ggggttcacaaagcttccta

SEQ ID NO: 9086 - DNA, 20 bp, human
gtggctcagacgctgatctg

SEQ ID NO: 9087 - DNA, 20 bp, human
ggggcctctgctgaatgttg

SEQ ID NO: 9088 - DNA, 20 bp, human
ggacacagtgcgtcccctct

SEQ ID NO: 9089 - DNA, 20 bp, human
gctggtagactcgcctagag

SEQ ID NO: 9090 - DNA, 20 bp, human
gacgcactgtgtcctagttg

SEQ ID NO: 9091 - DNA, 20 bp, human
gcctgggcagcattcaccag

SEQ ID NO: 9092 - DNA, 20 bp, human
gatgagccagtagaactggg

SEQ ID NO: 9093 - DNA, 20 bp, human
gtggggcccccatgcaacaa

SEQ ID NO: 9094 - DNA, 20 bp, human
gcaagcgtcgggtgagtccg

SEQ ID NO: 9095 - DNA, 20 bp, human
gctggtcctcccagttctac

SEQ ID NO: 9096 - DNA, 20 bp, human
gttgcaagttcccggttcca

SEQ ID NO: 9097 - DNA, 20 bp, human
gccggttccaaggtgttacc

SEQ ID NO: 9098 - DNA, 20 bp, human
gccatttctggttaaagtag

SEQ ID NO: 9099 - DNA, 20 bp, human
gaacttaccaggtaacacct

SEQ ID NO: 9100 - DNA, 20 bp, human
gcccagcaatagcatatggt

SEQ ID NO: 9101 - DNA, 20 bp, human
gatgaccccaaagcacggtt

SEQ ID NO: 9102 - DNA, 20 bp, human
gaagcttaaaagaacttacc

SEQ ID NO: 9103 - DNA, 20 bp, human
ggcccctgcttgaagcagtg

SEQ ID NO: 9104 - DNA, 20 bp, human
gtggagatatagcagatcct

SEQ ID NO: 9105 - DNA, 20 bp, human
gaaatctaaagcatgccatg

SEQ ID NO: 9106 - DNA, 20 bp, human
gtctccgaggtcccctggtc

SEQ ID NO: 9107 - DNA, 20 bp, human
gcagggggctgtgagtgtct

SEQ ID NO: 9108 - DNA, 20 bp, human
gcagccccctgccagaccag

SEQ ID NO: 9109 - DNA, 20 bp, human
gctgccagaccaggggacct

SEQ ID NO: 9110 - DNA, 20 bp, human
gtccactgctggggatccga

SEQ ID NO: 9111 - DNA, 20 bp, human
gttgtggccttgggtcccga

SEQ ID NO: 9112 - DNA, 20 bp, human
gtgaaggacagagcccccaa

SEQ ID NO: 9113 - DNA, 20 bp, human
gctctgtccttgcctctccg

SEQ ID NO: 9114 - DNA, 20 bp, human
ggggctggagaaagacggat

SEQ ID NO: 9115 - DNA, 20 bp, human
gtccgagggcttaggcagag

SEQ ID NO: 9116 - DNA, 20 bp, human
gggaggcagacagaagtgaa

SEQ ID NO: 9117 - DNA, 20 bp, human
ggtacagtggacatgaaggt

SEQ ID NO: 9118 - DNA, 20 bp, human
gtcttcagttggcttcaacg

SEQ ID NO: 9119 - DNA, 20 bp, human
ggaaccctgaggcatatatt

SEQ ID NO: 9120 - DNA, 20 bp, human
gtcagattttactttcctgg

SEQ ID NO: 9121 - DNA, 20 bp, human
gatcccgaatatatgcctca

SEQ ID NO: 9122 - DNA, 20 bp, human
ggagatgaggattctagact

SEQ ID NO: 9123 - DNA, 20 bp, human
gaaggtgggaatctgcaact

SEQ ID NO: 9124 - DNA, 20 bp, human
gtcctgtgaataaggagatg

SEQ ID NO: 9125 - DNA, 20 bp, human
gaagagtacagtggacatga

SEQ ID NO: 9126 - DNA, 20 bp, human
gagtaaagcttggggacctg

SEQ ID NO: 9127 - DNA, 20 bp, human
ggatctcgaagcgatacttc

SEQ ID NO: 9128 - DNA, 20 bp, human
gaaacggaagtggccgtcgg

SEQ ID NO: 9129 - DNA, 20 bp, human
gacggtcccccgggcgacag

SEQ ID NO: 9130 - DNA, 20 bp, human
ggatacttccggctcccccc

SEQ ID NO: 9131 - DNA, 20 bp, human
ggtcccccgggcgacagcgg

SEQ ID NO: 9132 - DNA, 20 bp, human
gaggcgtagtacggtccccc

SEQ ID NO: 9133 - DNA, 20 bp, human
gccgtccatagcccctctcg

SEQ ID NO: 9134 - DNA, 20 bp, human
gagatccccaaatactatcg

SEQ ID NO: 9135 - DNA, 20 bp, human
gactatcggggaaacggaag

SEQ ID NO: 9136 - DNA, 20 bp, human
gggccacgcccactatagag

SEQ ID NO: 9137 - DNA, 20 bp, human
gaggcgggagacccccgggt

SEQ ID NO: 9138 - DNA, 20 bp, human
gcgacgcggcttctagaacc

SEQ ID NO: 9139 - DNA, 20 bp, human
gtcgctggcagcggaggctc

SEQ ID NO: 9140 - DNA, 20 bp, human
gaacatgtcgctggcagcgg

SEQ ID NO: 9141 - DNA, 20 bp, human
gtgactacggaggcccggta

SEQ ID NO: 9142 - DNA, 20 bp, human
gggccccgcggttcattcac

SEQ ID NO: 9143 - DNA, 20 bp, human
gtgggatggctgggtgacga

SEQ ID NO: 9144 - DNA, 20 bp, human
gtccaaccgcaagcaggcag

SEQ ID NO: 9145 - DNA, 20 bp, human
gagtaccctcttgggatcgt

SEQ ID NO: 9146 - DNA, 20 bp, human
gcacctgcctttccccatta

SEQ ID NO: 9147 - DNA, 20 bp, human
ggagccctgaaacaaggggc

SEQ ID NO: 9148 - DNA, 20 bp, human
ggccgaaagggttgtagaca

SEQ ID NO: 9149 - DNA, 20 bp, human
gggccacatgaccctatgga

SEQ ID NO: 9150 - DNA, 20 bp, human
ggcgcactgctgaaagacta

SEQ ID NO: 9151 - DNA, 20 bp, human
gggctccttcagaagttagt

SEQ ID NO: 9152 - DNA, 20 bp, human
gacagttaccgggatgctat

SEQ ID NO: 9153 - DNA, 20 bp, human
ggctctccgtctgaaaacct

SEQ ID NO: 9154 - DNA, 20 bp, human
gccacagaaattaagcaagt

SEQ ID NO: 9155 - DNA, 20 bp, human
gggctgataaaaccctaatg

SEQ ID NO: 9156 - DNA, 20 bp, human
ggcgaaggcgcggcagagag

SEQ ID NO: 9157 - DNA, 20 bp, human
ggtgcgccgcgggagccagg

SEQ ID NO: 9158 - DNA, 20 bp, human
gtctcgggaacaaataaggt

SEQ ID NO: 9159 - DNA, 20 bp, human
gcccgcccgcaagaccacca

SEQ ID NO: 9160 - DNA, 20 bp, human
gtaagcgtaacagagtcacc

SEQ ID NO: 9161 - DNA, 20 bp, human
gtcattctcgggaacaaata

SEQ ID NO: 9162 - DNA, 20 bp, human
gcgcgagagcacctggacaa

SEQ ID NO: 9163 - DNA, 20 bp, human
gtgacagccgcggcaggcga

SEQ ID NO: 9164 - DNA, 20 bp, human
ggccgcggcaggcgaaggcg

SEQ ID NO: 9165 - DNA, 20 bp, human
gaccatggccccacgccccc

SEQ ID NO: 9166 - DNA, 20 bp, human
gggtaggcgagagcacgcgg

SEQ ID NO: 9167 - DNA, 20 bp, human
gccgggctggcgcggaacca

SEQ ID NO: 9168 - DNA, 20 bp, human
gagcggtaggcgagagcacg

SEQ ID NO: 9169 - DNA, 20 bp, human
ggccggagcgcgactccctg

SEQ ID NO: 9170 - DNA, 20 bp, human
gcagtttcctcggcagcggt

SEQ ID NO: 9171 - DNA, 20 bp, human
ggcccggggcgagaagggta

SEQ ID NO: 9172 - DNA, 20 bp, human
gccggcccgctgagagggag

SEQ ID NO: 9173 - DNA, 20 bp, human
gccgtcagtttcctcggcag

SEQ ID NO: 9174 - DNA, 20 bp, human
gcggctcgggcgctggaggt

SEQ ID NO: 9175 - DNA, 20 bp, human
gcttgggttaaggtcttggg

SEQ ID NO: 9176 - DNA, 20 bp, human
gggccccggaggattcggag

SEQ ID NO: 9177 - DNA, 20 bp, human
gatcctccggggccgcagag

SEQ ID NO: 9178 - DNA, 20 bp, human
gcagcgctgggacggaaccc

SEQ ID NO: 9179 - DNA, 20 bp, human
ggcaggcccgagtaaaaagt

SEQ ID NO: 9180 - DNA, 20 bp, human
gcccggttcgagaggaaccc

SEQ ID NO: 9181 - DNA, 20 bp, human
ggccaaaagcgtcacaatcc

SEQ ID NO: 9182 - DNA, 20 bp, human
ggccgcagaggggttcgcta

SEQ ID NO: 9183 - DNA, 20 bp, human
ggtcacaatcccggttcgag

SEQ ID NO: 9184 - DNA, 20 bp, human
gcaaggagcggatgtctcgg

SEQ ID NO: 9185 - DNA, 20 bp, human
ggatgttctcgggcaaggag

SEQ ID NO: 9186 - DNA, 20 bp, human
gcccggcccacgagcaccag

SEQ ID NO: 9187 - DNA, 20 bp, human
gggcccgccctctccggcaa

SEQ ID NO: 9188 - DNA, 20 bp, human
gtgcgacgggcggtgaccta

SEQ ID NO: 9189 - DNA, 20 bp, human
gcggcatcgtggcggaggga

SEQ ID NO: 9190 - DNA, 20 bp, human
gctgcagcccttgccggaga

SEQ ID NO: 9191 - DNA, 20 bp, human
gcgcccgccgcagctgaccc

SEQ ID NO: 9192 - DNA, 20 bp, human
ggccgctcggcgcctggaga

SEQ ID NO: 9193 - DNA, 20 bp, human
gggacggctgcagcccttgc

SEQ ID NO: 9194 - DNA, 20 bp, human
gccgcggaggcgccagacct

SEQ ID NO: 9195 - DNA, 20 bp, human
gccgagccgctggtgctcgt

SEQ ID NO: 9196 - DNA, 20 bp, human
ggggcagagctgtggaacag

SEQ ID NO: 9197 - DNA, 20 bp, human
gggccgccgcgggcacggag

SEQ ID NO: 9198 - DNA, 20 bp, human
gggcggccgagagcactccc

SEQ ID NO: 9199 - DNA, 20 bp, human
gcagcccgagagaacccggt

SEQ ID NO: 9200 - DNA, 20 bp, human
gagcggcgggaggtacctgg

SEQ ID NO: 9201 - DNA, 20 bp, human
gctgggctcaggcgacgcgg

SEQ ID NO: 9202 - DNA, 20 bp, human
gccctcgcggcgcctcccac

SEQ ID NO: 9203 - DNA, 20 bp, human
gaacaggggagagagccccg

SEQ ID NO: 9204 - DNA, 20 bp, human
ggggcgcggcctccactccg

SEQ ID NO: 9205 - DNA, 20 bp, human
ggaggcactcagctactaca

SEQ ID NO: 9206 - DNA, 20 bp, human
gtgcccagtggccgcatcta

SEQ ID NO: 9207 - DNA, 20 bp, human
gaccagctgcagctcggagt

SEQ ID NO: 9208 - DNA, 20 bp, human
gtgacgccggggccgaagga

SEQ ID NO: 9209 - DNA, 20 bp, human
gtgcagctcggagtcggcca

SEQ ID NO: 9210 - DNA, 20 bp, human
gcgcgccgagggcagcacgt

SEQ ID NO: 9211 - DNA, 20 bp, human
gcgtagcccgagacaaggaa

SEQ ID NO: 9212 - DNA, 20 bp, human
ggcctggggtggggaagtcg

SEQ ID NO: 9213 - DNA, 20 bp, human
gatcgcaggcgagtgcccag

SEQ ID NO: 9214 - DNA, 20 bp, human
gctcctggcgcgacacctga

SEQ ID NO: 9215 - DNA, 20 bp, human
gcgccctagatgcggccact

SEQ ID NO: 9216 - DNA, 20 bp, human
gcccagccagcagaagagat

SEQ ID NO: 9217 - DNA, 20 bp, human
gcggcccagcttgtcgggaa

SEQ ID NO: 9218 - DNA, 20 bp, human
gcagcccaaggtagtaacag

SEQ ID NO: 9219 - DNA, 20 bp, human
gtcggccgaacgctcacccg

SEQ ID NO: 9220 - DNA, 20 bp, human
ggtccgtctccgacttctgg

SEQ ID NO: 9221 - DNA, 20 bp, human
gcgctgcgggatgacgtcag

SEQ ID NO: 9222 - DNA, 20 bp, human
gcccaaggtagtaacagggg

SEQ ID NO: 9223 - DNA, 20 bp, human
gttccctacaaggcctgttg

SEQ ID NO: 9224 - DNA, 20 bp, human
gcttcgtgaaaggcacttga

SEQ ID NO: 9225 - DNA, 20 bp, human
gttgcgaccaaggtacatac

SEQ ID NO: 9226 - DNA, 20 bp, human
gcacgaatcagcgaggtcca

SEQ ID NO: 9227 - DNA, 20 bp, human
gcggcgctcgtggaatcttc

SEQ ID NO: 9228 - DNA, 20 bp, human
gctgcgccgaaaggccttgt

SEQ ID NO: 9229 - DNA, 20 bp, human
gcactctcaggctcgctgag

SEQ ID NO: 9230 - DNA, 20 bp, human
gcggagacttccgcactctc

SEQ ID NO: 9231 - DNA, 20 bp, human
gagaggcgcccgtaagaggg

SEQ ID NO: 9232 - DNA, 20 bp, human
gcgaaaggccttgtgggtgt

SEQ ID NO: 9233 - DNA, 20 bp, human
gctcgagtacagtgacccag

SEQ ID NO: 9234 - DNA, 20 bp, human
gggcagataacatgtgtcta

SEQ ID NO: 9235 - DNA, 20 bp, human
gcggaagtctccggctggtg

SEQ ID NO: 9236 - DNA, 20 bp, human
ggcagccgccactggaatac

SEQ ID NO: 9237 - DNA, 20 bp, human
gcgcacatcccacaggagta

SEQ ID NO: 9238 - DNA, 20 bp, human
gtggtgaggtaaccagaaag

SEQ ID NO: 9239 - DNA, 20 bp, human
gttagtgacgcacatcccac

SEQ ID NO: 9240 - DNA, 20 bp, human
gccagctcttgaggatgcaa

SEQ ID NO: 9241 - DNA, 20 bp, human
gagctcctgtattccagtgg

SEQ ID NO: 9242 - DNA, 20 bp, human
gggaagcagctgttagatgg

SEQ ID NO: 9243 - DNA, 20 bp, human
gttgacctgctatgaggacc

SEQ ID NO: 9244 - DNA, 20 bp, human
ggagtggaagcagccgccac

SEQ ID NO: 9245 - DNA, 20 bp, human
ggtcaccaggtcctcatagc

SEQ ID NO: 9246 - DNA, 20 bp, human
ggggagcagtgaatagcaat

SEQ ID NO: 9247 - DNA, 20 bp, human
gggccaggaggctgcgtatc

SEQ ID NO: 9248 - DNA, 20 bp, human
gaagagataaggacaacaga

SEQ ID NO: 9249 - DNA, 20 bp, human
gatggtaggtaggatcactg

SEQ ID NO: 9250 - DNA, 20 bp, human
gaggtaggatcactgcggga

SEQ ID NO: 9251 - DNA, 20 bp, human
ggataaaaacgaaaagtgat

SEQ ID NO: 9252 - DNA, 20 bp, human
gccttatctttgctggaggc

SEQ ID NO: 9253 - DNA, 20 bp, human
ggcctgagtgaagaccatgg

SEQ ID NO: 9254 - DNA, 20 bp, human
gggggcctgagtgaagacca

SEQ ID NO: 9255 - DNA, 20 bp, human
gagtgtgcctatgcagacag

SEQ ID NO: 9256 - DNA, 20 bp, human
gggtgtcctgcagctcggac

SEQ ID NO: 9257 - DNA, 20 bp, human
gagcccgcaacccgctcagg

SEQ ID NO: 9258 - DNA, 20 bp, human
gcggagcccgcaacccgctc

SEQ ID NO: 9259 - DNA, 20 bp, human
gatgtcccccgagacgggtg

SEQ ID NO: 9260 - DNA, 20 bp, human
gcaacccgctcaggcggcga

SEQ ID NO: 9261 - DNA, 20 bp, human
ggaaggtggctagaaactcc

SEQ ID NO: 9262 - DNA, 20 bp, human
gacgggtgcggtgaggctat

SEQ ID NO: 9263 - DNA, 20 bp, human
gaccgcctcctacccagagc

SEQ ID NO: 9264 - DNA, 20 bp, human
ggcacgtccagcaacccgtg

SEQ ID NO: 9265 - DNA, 20 bp, human
gcgagcgtcagcgtccaggt

SEQ ID NO: 9266 - DNA, 20 bp, human
gtcctcatctccaggcagca

SEQ ID NO: 9267 - DNA, 20 bp, human
gcgccctctgtgaggcggcc

SEQ ID NO: 9268 - DNA, 20 bp, human
gcccgggaggcggtgggtgc

SEQ ID NO: 9269 - DNA, 20 bp, human
gggtgggtgcgggtgcagct

SEQ ID NO: 9270 - DNA, 20 bp, human
ggcccagcagaggcgcatca

SEQ ID NO: 9271 - DNA, 20 bp, human
ggcctcacagagggcgaagg

SEQ ID NO: 9272 - DNA, 20 bp, human
gtgcaggcacagctcctcgg

SEQ ID NO: 9273 - DNA, 20 bp, human
gcatcggcctgggccccccg

SEQ ID NO: 9274 - DNA, 20 bp, human
ggccctgctgcctggagatg

SEQ ID NO: 9275 - DNA, 20 bp, human
gcctctgtgaggcggccagg

SEQ ID NO: 9276 - DNA, 20 bp, human
gtgcaggcacagcatctcgg

SEQ ID NO: 9277 - DNA, 20 bp, human
gcaggagttcctcatggccg

SEQ ID NO: 9278 - DNA, 20 bp, human
ggctgcctcacagagggtga

SEQ ID NO: 9279 - DNA, 20 bp, human
gcggtgggcgcggtgcagct

SEQ ID NO: 9280 - DNA, 20 bp, human
ggcccagcagaggcgcgtca

SEQ ID NO: 9281 - DNA, 20 bp, human
gcctggcacgctgctgaagc

SEQ ID NO: 9282 - DNA, 20 bp, human
ggtcctcatctccaggaagc

SEQ ID NO: 9283 - DNA, 20 bp, human
ggcccgggaggcggtgggcg

SEQ ID NO: 9284 - DNA, 20 bp, human
gggcacgctgctgaagctgg

SEQ ID NO: 9285 - DNA, 20 bp, human
gtcccgggcgaagacttcat

SEQ ID NO: 9286 - DNA, 20 bp, human
gctcagggccaggatgctcc

SEQ ID NO: 9287 - DNA, 20 bp, human
gtgggcagccacgtagaagg

SEQ ID NO: 9288 - DNA, 20 bp, human
gaccaggcaggccacagtca

SEQ ID NO: 9289 - DNA, 20 bp, human
ggcgagtgcccggagcatcc

SEQ ID NO: 9290 - DNA, 20 bp, human
gccacaaggggcaggtcctg

SEQ ID NO: 9291 - DNA, 20 bp, human
gagggcctgtggccagttga

SEQ ID NO: 9292 - DNA, 20 bp, human
gcacgccagcagacatccgc

SEQ ID NO: 9293 - DNA, 20 bp, human
gcatgctgcagagccctgcg

SEQ ID NO: 9294 - DNA, 20 bp, human
gagctgggcagccacgtaga

SEQ ID NO: 9295 - DNA, 20 bp, human
ggcccagctgtctcagggcc

SEQ ID NO: 9296 - DNA, 20 bp, human
gcttctgtcgacccatggcg

SEQ ID NO: 9297 - DNA, 20 bp, human
ggcggtggcgcagcgagcag

SEQ ID NO: 9298 - DNA, 20 bp, human
ggtcggagctgtcagagagg

SEQ ID NO: 9299 - DNA, 20 bp, human
gaggcggcggcgctgtcggg

SEQ ID NO: 9300 - DNA, 20 bp, human
gttgtgggagggtaaacgat

SEQ ID NO: 9301 - DNA, 20 bp, human
gtggctgagtcacttgtggg

SEQ ID NO: 9302 - DNA, 20 bp, human
gacgatcggcactatcactg

SEQ ID NO: 9303 - DNA, 20 bp, human
gagctccttctgtcgaccca

SEQ ID NO: 9304 - DNA, 20 bp, human
gagagggggttagaaccgtg

SEQ ID NO: 9305 - DNA, 20 bp, human
ggagagtttggggagtgcaa

SEQ ID NO: 9306 - DNA, 20 bp, human
gccataactcatgggagggt

SEQ ID NO: 9307 - DNA, 20 bp, human
gagagctagagggaagacgg

SEQ ID NO: 9308 - DNA, 20 bp, human
gggggagggcacacctgaga

SEQ ID NO: 9309 - DNA, 20 bp, human
gtagacacacagtgagtcgg

SEQ ID NO: 9310 - DNA, 20 bp, human
gcttacccataactcatggg

SEQ ID NO: 9311 - DNA, 20 bp, human
ggctcttctcctgaaagcaa

SEQ ID NO: 9312 - DNA, 20 bp, human
gctacttacccataactcat

SEQ ID NO: 9313 - DNA, 20 bp, human
gaacccgcatcagaacatgg

SEQ ID NO: 9314 - DNA, 20 bp, human
ggacacttggatatgatcaa

SEQ ID NO: 9315 - DNA, 20 bp, human
gctgcgtgacaagaacccgc

SEQ ID NO: 9316 - DNA, 20 bp, human
gggcaatgagagctgcactc

SEQ ID NO: 9317 - DNA, 20 bp, human
gacccacagcaaggcggtgg

SEQ ID NO: 9318 - DNA, 20 bp, human
gacccccaccgccttgctgt

SEQ ID NO: 9319 - DNA, 20 bp, human
gcctaagcgttgttccctta

SEQ ID NO: 9320 - DNA, 20 bp, human
gtgttcccttaaggcaaaga

SEQ ID NO: 9321 - DNA, 20 bp, human
ggcccaggaaaattacccta

SEQ ID NO: 9322 - DNA, 20 bp, human
gcttttgccccagaacaaag

SEQ ID NO: 9323 - DNA, 20 bp, human
gtgtgctgggagtcagatta

SEQ ID NO: 9324 - DNA, 20 bp, human
gagtgactgtgaacatataa

SEQ ID NO: 9325 - DNA, 20 bp, human
ggcagatctgaaacatatgg

SEQ ID NO: 9326 - DNA, 20 bp, human
gaggccgccagcctcggagt

SEQ ID NO: 9327 - DNA, 20 bp, human
ggcgcgatctgcaggatggt

SEQ ID NO: 9328 - DNA, 20 bp, human
ggctggcatcctctacggtg

SEQ ID NO: 9329 - DNA, 20 bp, human
ggagcggtgccacaccgtag

SEQ ID NO: 9330 - DNA, 20 bp, human
gaggatgccagccccggcaa

SEQ ID NO: 9331 - DNA, 20 bp, human
gaggccctgggacccgtgag

SEQ ID NO: 9332 - DNA, 20 bp, human
gctgtcccgcgcccactccg

SEQ ID NO: 9333 - DNA, 20 bp, human
gccggggctggcatcctcta

SEQ ID NO: 9334 - DNA, 20 bp, human
gtcaccctggccctcttggt

SEQ ID NO: 9335 - DNA, 20 bp, human
ggtgggcgcgggacagtgcg

SEQ ID NO: 9336 - DNA, 20 bp, human
ggcacggggcagagagatgt

SEQ ID NO: 9337 - DNA, 20 bp, human
gacgaggaaggccagcgtca

SEQ ID NO: 9338 - DNA, 20 bp, human
gagagatgtgggagcctacg

SEQ ID NO: 9339 - DNA, 20 bp, human
gaggaaggccagcgtcacgg

SEQ ID NO: 9340 - DNA, 20 bp, human
gatgtgggagcctacgagga

SEQ ID NO: 9341 - DNA, 20 bp, human
ggctgtgcaggtcacctgga

SEQ ID NO: 9342 - DNA, 20 bp, human
gccccgtgctgtggcctatg

SEQ ID NO: 9343 - DNA, 20 bp, human
gaggactgtgctggtcagac

SEQ ID NO: 9344 - DNA, 20 bp, human
gcatggctgtgcaggtcacc

SEQ ID NO: 9345 - DNA, 20 bp, human
gtggcagggcgcaggcggat

SEQ ID NO: 9346 - DNA, 20 bp, human
gggcagtggaccacagcggg

SEQ ID NO: 9347 - DNA, 20 bp, human
gaccacagcgggaggcgtgc

SEQ ID NO: 9348 - DNA, 20 bp, human
ggcctgcacgcctcccgctg

SEQ ID NO: 9349 - DNA, 20 bp, human
gcattccctgggtaccatac

SEQ ID NO: 9350 - DNA, 20 bp, human
gaggcgtgcaggcaggagac

SEQ ID NO: 9351 - DNA, 20 bp, human
gggagaggtcagtaaggcag

SEQ ID NO: 9352 - DNA, 20 bp, human
gaccggcagtggaccacagc

SEQ ID NO: 9353 - DNA, 20 bp, human
gctgcctctcagctctccca

SEQ ID NO: 9354 - DNA, 20 bp, human
ggagccagggacagtcacgg

SEQ ID NO: 9355 - DNA, 20 bp, human
gccagatctgggcgctgagg

SEQ ID NO: 9356 - DNA, 20 bp, human
gagggacagaggacacgggt

SEQ ID NO: 9357 - DNA, 20 bp, human
gagccccaaagccagcccgt

SEQ ID NO: 9358 - DNA, 20 bp, human
gagaggaagatgccgacaga

SEQ ID NO: 9359 - DNA, 20 bp, human
gctgatcctgatgtctggag

SEQ ID NO: 9360 - DNA, 20 bp, human
gtatctgccgtagggaaaaa

SEQ ID NO: 9361 - DNA, 20 bp, human
ggacagaggacacgggtggg

SEQ ID NO: 9362 - DNA, 20 bp, human
gcactgggtgtggaaagcaa

SEQ ID NO: 9363 - DNA, 20 bp, human
gtgcagccggccctggccca

SEQ ID NO: 9364 - DNA, 20 bp, human
gccggccctggcccacgggc

SEQ ID NO: 9365 - DNA, 20 bp, human
ggacctgctgatcacactat

SEQ ID NO: 9366 - DNA, 20 bp, human
gggaagaaacaagttactag

SEQ ID NO: 9367 - DNA, 20 bp, human
gccacagcctctaattggaa

SEQ ID NO: 9368 - DNA, 20 bp, human
gaccagcctggcagctaggg

SEQ ID NO: 9369 - DNA, 20 bp, human
gaggctgtttgactatttag

SEQ ID NO: 9370 - DNA, 20 bp, human
gctagctgccaggctggtag

SEQ ID NO: 9371 - DNA, 20 bp, human
gcaaatgccgttccaattag

SEQ ID NO: 9372 - DNA, 20 bp, human
ggccccaagatgcagcctga

SEQ ID NO: 9373 - DNA, 20 bp, human
gtggcttaatcgtcttctgg

SEQ ID NO: 9374 - DNA, 20 bp, human
gtccctcaggctgcatcttg

SEQ ID NO: 9375 - DNA, 20 bp, human
gaaaccctctctgagttctt

SEQ ID NO: 9376 - DNA, 20 bp, human
ggctccagatcgtagtgcag

SEQ ID NO: 9377 - DNA, 20 bp, human
gaggctcttccaggaggaag

SEQ ID NO: 9378 - DNA, 20 bp, human
ggcagcggcacgagccaggg

SEQ ID NO: 9379 - DNA, 20 bp, human
gagtgcagcggcacgagcca

SEQ ID NO: 9380 - DNA, 20 bp, human
gtcgcagtggccgtacaagg

SEQ ID NO: 9381 - DNA, 20 bp, human
ggtgccgctgcactacgatc

SEQ ID NO: 9382 - DNA, 20 bp, human
ggagcaactggcgacccccg

SEQ ID NO: 9383 - DNA, 20 bp, human
ggtcgcagcactgaacaccc

SEQ ID NO: 9384 - DNA, 20 bp, human
gaagaggcacgatacaagag

SEQ ID NO: 9385 - DNA, 20 bp, human
gaggcacgatacaagagagg

SEQ ID NO: 9386 - DNA, 20 bp, human
ggcgccccggcagtaactta

SEQ ID NO: 9387 - DNA, 20 bp, human
gctgttgtacgggttcccta

SEQ ID NO: 9388 - DNA, 20 bp, human
gacttaagggaagtggacca

SEQ ID NO: 9389 - DNA, 20 bp, human
gctaggtgctgggcataccg

SEQ ID NO: 9390 - DNA, 20 bp, human
gccggcccggagcgtttgtg

SEQ ID NO: 9391 - DNA, 20 bp, human
gcagccttcagagtcccgta

SEQ ID NO: 9392 - DNA, 20 bp, human
ggttccctacgggactctga

SEQ ID NO: 9393 - DNA, 20 bp, human
gaggctgaggatatccggcc

SEQ ID NO: 9394 - DNA, 20 bp, human
gctctgggcagcggcaaccc

SEQ ID NO: 9395 - DNA, 20 bp, human
gtgcccagcacctagcatag

SEQ ID NO: 9396 - DNA, 20 bp, human
gctgggagagcgggacggtc

SEQ ID NO: 9397 - DNA, 20 bp, human
gctccccgggatctcggagg

SEQ ID NO: 9398 - DNA, 20 bp, human
ggcttgctgggagagcggga

SEQ ID NO: 9399 - DNA, 20 bp, human
ggctgcgggagagaagacgg

SEQ ID NO: 9400 - DNA, 20 bp, human
gggctgagagtagccgactg

SEQ ID NO: 9401 - DNA, 20 bp, human
gtggctccccgggatctcgg

SEQ ID NO: 9402 - DNA, 20 bp, human
gctcctgtacagcactggag

SEQ ID NO: 9403 - DNA, 20 bp, human
gcgccccctccgagatcccg

SEQ ID NO: 9404 - DNA, 20 bp, human
gggcagccgtcagtcctacc

SEQ ID NO: 9405 - DNA, 20 bp, human
gtggcagcgctgggccgacg

SEQ ID NO: 9406 - DNA, 20 bp, human
gaggcccaagatggagacgg

SEQ ID NO: 9407 - DNA, 20 bp, human
gccgccgccgtctccatctt

SEQ ID NO: 9408 - DNA, 20 bp, human
gtgtagcggcgtgacaggtg

SEQ ID NO: 9409 - DNA, 20 bp, human
gagagtccgagaggcgacgg

SEQ ID NO: 9410 - DNA, 20 bp, human
ggcggctgtagcggcgtgac

SEQ ID NO: 9411 - DNA, 20 bp, human
ggcggcgtgacaggtgaggg

SEQ ID NO: 9412 - DNA, 20 bp, human
ggacggaggcggactctgtg

SEQ ID NO: 9413 - DNA, 20 bp, human
gtcatggaaggcggttacag

SEQ ID NO: 9414 - DNA, 20 bp, human
gggcgcaccaccactagcag

SEQ ID NO: 9415 - DNA, 20 bp, human
gtaggcgggacccgaccgag

SEQ ID NO: 9416 - DNA, 20 bp, human
ggcaggtacacgacattctt

SEQ ID NO: 9417 - DNA, 20 bp, human
gcacaaagcaggaagcctcc

SEQ ID NO: 9418 - DNA, 20 bp, human
gtgttggccacggctgcagg

SEQ ID NO: 9419 - DNA, 20 bp, human
gacagcaacaacagcaacgg

SEQ ID NO: 9420 - DNA, 20 bp, human
gcagcctcagacccacccag

SEQ ID NO: 9421 - DNA, 20 bp, human
gaccagcccaggcgggaccc

SEQ ID NO: 9422 - DNA, 20 bp, human
gcaggtgcaaagccatacct

SEQ ID NO: 9423 - DNA, 20 bp, human
ggtatgtctgcacccagctc

SEQ ID NO: 9424 - DNA, 20 bp, human
gagacccagcaggcgtctga

SEQ ID NO: 9425 - DNA, 20 bp, human
gaggcgtctgagggtaagcg

SEQ ID NO: 9426 - DNA, 20 bp, human
gtggcggtgtaagtcggtgg

SEQ ID NO: 9427 - DNA, 20 bp, human
gcggtggcggtgtaagtcgg

SEQ ID NO: 9428 - DNA, 20 bp, human
gacgcggggaccaggcgtac

SEQ ID NO: 9429 - DNA, 20 bp, human
gcagcgggccagagacggta

SEQ ID NO: 9430 - DNA, 20 bp, human
gtctcagcggccaacgaggt

SEQ ID NO: 9431 - DNA, 20 bp, human
ggccccttgctgcaatttgg

SEQ ID NO: 9432 - DNA, 20 bp, human
gccggccccttgctgcaatt

SEQ ID NO: 9433 - DNA, 20 bp, human
gtaagccagcgggccagaga

SEQ ID NO: 9434 - DNA, 20 bp, human
gtactcaaaacaggtcagtg

SEQ ID NO: 9435 - DNA, 20 bp, human
gaccccaaggcgcccgaggg

SEQ ID NO: 9436 - DNA, 20 bp, human
gtcggtcctcgcccctctgc

SEQ ID NO: 9437 - DNA, 20 bp, human
gtagtggggccggcgtgtcg

SEQ ID NO: 9438 - DNA, 20 bp, human
ggagcacctgagcaaggcgc

SEQ ID NO: 9439 - DNA, 20 bp, human
gtcgcggccgccgcacctgg

SEQ ID NO: 9440 - DNA, 20 bp, human
ggccgggatggcccacgcgg

SEQ ID NO: 9441 - DNA, 20 bp, human
gacgcgggagcgaaatccaa

SEQ ID NO: 9442 - DNA, 20 bp, human
gagcgcaaggcgagtacccg

SEQ ID NO: 9443 - DNA, 20 bp, human
ggatgcccaggaccttgtgt

SEQ ID NO: 9444 - DNA, 20 bp, human
ggcgcgggagcacctgagca

SEQ ID NO: 9445 - DNA, 20 bp, human
ggccaggaggagccaacaca

SEQ ID NO: 9446 - DNA, 20 bp, human
ggcggccgcgtagtgaggtg

SEQ ID NO: 9447 - DNA, 20 bp, human
ggcggcgggacccagaacct

SEQ ID NO: 9448 - DNA, 20 bp, human
gacccagaacctcggacgag

SEQ ID NO: 9449 - DNA, 20 bp, human
gctgggaagcagggacccgg

SEQ ID NO: 9450 - DNA, 20 bp, human
gggcacccgcgagcggacgg

SEQ ID NO: 9451 - DNA, 20 bp, human
ggggtcctcacctcactacg

SEQ ID NO: 9452 - DNA, 20 bp, human
gggtgctcgcgggacaggag

SEQ ID NO: 9453 - DNA, 20 bp, human
gcagtgatgctgggacggag

SEQ ID NO: 9454 - DNA, 20 bp, human
gaggccctcgagaaggtgat

SEQ ID NO: 9455 - DNA, 20 bp, human
gcctcgagaaggtgatgggg

SEQ ID NO: 9456 - DNA, 20 bp, human
gggtggagcgcgagctgaag

SEQ ID NO: 9457 - DNA, 20 bp, human
gaggactcagcgcagagctc

SEQ ID NO: 9458 - DNA, 20 bp, human
gcggggaggcaggtccggct

SEQ ID NO: 9459 - DNA, 20 bp, human
gaggtccggctcggctgctg

SEQ ID NO: 9460 - DNA, 20 bp, human
gagcgctgcgagtcgctcgt

SEQ ID NO: 9461 - DNA, 20 bp, human
gctgaaggggctgcaccggt

SEQ ID NO: 9462 - DNA, 20 bp, human
gtcagcgcagagctcgggcg

SEQ ID NO: 9463 - DNA, 20 bp, human
gcgtgggcacgtagccgtcc

SEQ ID NO: 9464 - DNA, 20 bp, human
gggggctgcaccggtcggtc

SEQ ID NO: 9465 - DNA, 20 bp, human
gcgatctgcaggatcacgtt

SEQ ID NO: 9466 - DNA, 20 bp, human
gggcagcggttcctgtcaag

SEQ ID NO: 9467 - DNA, 20 bp, human
gcctcaccgtctctccttgt

SEQ ID NO: 9468 - DNA, 20 bp, human
gaaacgccgggccgtctcag

SEQ ID NO: 9469 - DNA, 20 bp, human
gatcttggcaagaggcgaag

SEQ ID NO: 9470 - DNA, 20 bp, human
gggcaggtcccagcaaacga

SEQ ID NO: 9471 - DNA, 20 bp, human
gccgcactccggctccactg

SEQ ID NO: 9472 - DNA, 20 bp, human
ggcaagaggcgaagcggcag

SEQ ID NO: 9473 - DNA, 20 bp, human
ggacctgctgcccccttgac

SEQ ID NO: 9474 - DNA, 20 bp, human
gccggctccactggggatag

SEQ ID NO: 9475 - DNA, 20 bp, human
ggccccgccctgagggtcta

SEQ ID NO: 9476 - DNA, 20 bp, human
gtagacagagatggagaatt

SEQ ID NO: 9477 - DNA, 20 bp, human
gagagggacttagagtatcc

SEQ ID NO: 9478 - DNA, 20 bp, human
gactctaagtccctctagga

SEQ ID NO: 9479 - DNA, 20 bp, human
gagatggagaattaggcagg

SEQ ID NO: 9480 - DNA, 20 bp, human
gcagagatggagaattaggc

SEQ ID NO: 9481 - DNA, 20 bp, human
gctgctgggtccaatatctg

SEQ ID NO: 9482 - DNA, 20 bp, human
gggaggcagcaaacactgct

SEQ ID NO: 9483 - DNA, 20 bp, human
gaaaagaccaagatctagag

SEQ ID NO: 9484 - DNA, 20 bp, human
gcttagagtatcccggcgag

SEQ ID NO: 9485 - DNA, 20 bp, human
gttcttctttaccttcctag

SEQ ID NO: 9486 - DNA, 20 bp, human
gggtctgttggtgggagagt

SEQ ID NO: 9487 - DNA, 20 bp, human
gcgggtggagaccaactctg

SEQ ID NO: 9488 - DNA, 20 bp, human
gctccacccggcctgggaac

SEQ ID NO: 9489 - DNA, 20 bp, human
gcttcaccgagaggagtaca

SEQ ID NO: 9490 - DNA, 20 bp, human
ggcagcactcagcagaagac

SEQ ID NO: 9491 - DNA, 20 bp, human
ggctgcacaaagcaccatat

SEQ ID NO: 9492 - DNA, 20 bp, human
gcggaagcggaaactccttg

SEQ ID NO: 9493 - DNA, 20 bp, human
gggcctgggaaccggctcgg

SEQ ID NO: 9494 - DNA, 20 bp, human
ggttggtctccacccggcct

SEQ ID NO: 9495 - DNA, 20 bp, human
gaaagggcaatcccccgagc

SEQ ID NO: 9496 - DNA, 20 bp, human
gcggcctcgggaaacgagaa

SEQ ID NO: 9497 - DNA, 20 bp, human
gtgggagcaaaaccaacgcc

SEQ ID NO: 9498 - DNA, 20 bp, human
gcctctgaggtgagggcgag

SEQ ID NO: 9499 - DNA, 20 bp, human
gcgtggacggttgggattag

SEQ ID NO: 9500 - DNA, 20 bp, human
ggtgtgggccgcagagacgt

SEQ ID NO: 9501 - DNA, 20 bp, human
ggtctcactggtgtgaaggg

SEQ ID NO: 9502 - DNA, 20 bp, human
gcgcccgcgcgtggacggtt

SEQ ID NO: 9503 - DNA, 20 bp, human
ggaggccccacgacccccac

SEQ ID NO: 9504 - DNA, 20 bp, human
ggaggccgcccgcgcgtgga

SEQ ID NO: 9505 - DNA, 20 bp, human
ggacgccgtcaaggtcatgt

SEQ ID NO: 9506 - DNA, 20 bp, human
gggcttccggtgctaggtgg

SEQ ID NO: 9507 - DNA, 20 bp, human
ggcagcagccgggctgaagt

SEQ ID NO: 9508 - DNA, 20 bp, human
gtagagaagaggctcggtca

SEQ ID NO: 9509 - DNA, 20 bp, human
ggcgggtcccggtagagaag

SEQ ID NO: 9510 - DNA, 20 bp, human
ggtcgcccccttgagcgagg

SEQ ID NO: 9511 - DNA, 20 bp, human
gctagcaccggaagccgcga

SEQ ID NO: 9512 - DNA, 20 bp, human
gagaggctcggtcagggtga

SEQ ID NO: 9513 - DNA, 20 bp, human
gccgaggagaggtgatgagg

SEQ ID NO: 9514 - DNA, 20 bp, human
gtcctccgcctcgctcaagg

SEQ ID NO: 9515 - DNA, 20 bp, human
gacagctccagtcgccgtcg

SEQ ID NO: 9516 - DNA, 20 bp, human
gccctgtgccgatgaagatc

SEQ ID NO: 9517 - DNA, 20 bp, human
gcgcctagcaggtcctctac

SEQ ID NO: 9518 - DNA, 20 bp, human
gtcgtctggcgacagatcgg

SEQ ID NO: 9519 - DNA, 20 bp, human
gggaggcagaaacgtctcag

SEQ ID NO: 9520 - DNA, 20 bp, human
gcacaggaataagccggtag

SEQ ID NO: 9521 - DNA, 20 bp, human
gatccggcacaggaataagc

SEQ ID NO: 9522 - DNA, 20 bp, human
gagccggtagaggacctgct

SEQ ID NO: 9523 - DNA, 20 bp, human
gcctcccccaccacagcggg

SEQ ID NO: 9524 - DNA, 20 bp, human
ggccgatgaagatccggcac

SEQ ID NO: 9525 - DNA, 20 bp, human
gacctgctaggcgactggcg

SEQ ID NO: 9526 - DNA, 20 bp, human
ggcccggctggtaagaaggg

SEQ ID NO: 9527 - DNA, 20 bp, human
gccagcccggctggtaagaa

SEQ ID NO: 9528 - DNA, 20 bp, human
gcgcggagcgggagaggact

SEQ ID NO: 9529 - DNA, 20 bp, human
gtccagcccgcaccccgcgt

SEQ ID NO: 9530 - DNA, 20 bp, human
ggctgcgccccatccccccg

SEQ ID NO: 9531 - DNA, 20 bp, human
gcttaccagccgggctgggg

SEQ ID NO: 9532 - DNA, 20 bp, human
ggggaggcaaggggcacggg

SEQ ID NO: 9533 - DNA, 20 bp, human
ggagaggactgggaggcaag

SEQ ID NO: 9534 - DNA, 20 bp, human
gtgaggcctggagggcagtc

SEQ ID NO: 9535 - DNA, 20 bp, human
gtaaaagtcgtctccaaggg

SEQ ID NO: 9536 - DNA, 20 bp, human
gcaagattcggcctctgtgg

SEQ ID NO: 9537 - DNA, 20 bp, human
gaacagaaagggccacacta

SEQ ID NO: 9538 - DNA, 20 bp, human
gtcaggtggagtgttgggag

SEQ ID NO: 9539 - DNA, 20 bp, human
ggaacactcaggtggagtgt

SEQ ID NO: 9540 - DNA, 20 bp, human
gtacttccagaacactcagg

SEQ ID NO: 9541 - DNA, 20 bp, human
ggggaggccaggacaagatt

SEQ ID NO: 9542 - DNA, 20 bp, human
gccacactacggtatgtccc

SEQ ID NO: 9543 - DNA, 20 bp, human
gagaagctctacaggagtca

SEQ ID NO: 9544 - DNA, 20 bp, human
gaacagaaggggtagaagtg

SEQ ID NO: 9545 - DNA, 20 bp, human
ggaagcaggattctgggacc

SEQ ID NO: 9546 - DNA, 20 bp, human
gcggcggcggcagaactggg

SEQ ID NO: 9547 - DNA, 20 bp, human
gcagcggcggcggcagaact

SEQ ID NO: 9548 - DNA, 20 bp, human
gagggagcccgcgctcgggg

SEQ ID NO: 9549 - DNA, 20 bp, human
ggccgggccgcgcctcagca

SEQ ID NO: 9550 - DNA, 20 bp, human
gggctcccagcgcagtctca

SEQ ID NO: 9551 - DNA, 20 bp, human
gaggaggagttggaggccgg

SEQ ID NO: 9552 - DNA, 20 bp, human
gcacaaaggagcgaagaccg

SEQ ID NO: 9553 - DNA, 20 bp, human
gaaaggagcgaagaccgagg

SEQ ID NO: 9554 - DNA, 20 bp, human
gctttccagctcggcccaag

SEQ ID NO: 9555 - DNA, 20 bp, human
gcgggtgtcctgggtcggtg

SEQ ID NO: 9556 - DNA, 20 bp, human
gtaaggaaactgggcaaaaa

SEQ ID NO: 9557 - DNA, 20 bp, human
gaaaggaaaaaagcatacat

SEQ ID NO: 9558 - DNA, 20 bp, human
ggaactcataaggaaggggg

SEQ ID NO: 9559 - DNA, 20 bp, human
gggggaaacacagcagttct

SEQ ID NO: 9560 - DNA, 20 bp, human
gtttttgttggctttgcgtt

SEQ ID NO: 9561 - DNA, 20 bp, human
gagttagaactcataaggaa

SEQ ID NO: 9562 - DNA, 20 bp, human
gaatcaaactattattacaa

SEQ ID NO: 9563 - DNA, 20 bp, human
gtactaagttagaactcata

SEQ ID NO: 9564 - DNA, 20 bp, human
gtagtaaacttagcccacag

SEQ ID NO: 9565 - DNA, 20 bp, human
gtgacttccagcagatggga

SEQ ID NO: 9566 - DNA, 20 bp, human
gtcaggccagggccgaggta

SEQ ID NO: 9567 - DNA, 20 bp, human
gcaacgtagccggaagctgg

SEQ ID NO: 9568 - DNA, 20 bp, human
gcgtagccggaagctggtgg

SEQ ID NO: 9569 - DNA, 20 bp, human
gcccgggaggcgacgtgcgt

SEQ ID NO: 9570 - DNA, 20 bp, human
ggcgcatcctcattgcagtg

SEQ ID NO: 9571 - DNA, 20 bp, human
gaccggttacgggagtccag

SEQ ID NO: 9572 - DNA, 20 bp, human
gtgcgtgggcagggaccctc

SEQ ID NO: 9573 - DNA, 20 bp, human
gcccagcgccgagggaactg

SEQ ID NO: 9574 - DNA, 20 bp, human
gggtggagggcagcttcgta

SEQ ID NO: 9575 - DNA, 20 bp, human
ggtgggagattccagatccg

SEQ ID NO: 9576 - DNA, 20 bp, human
gttcagagcggcccaagtcg

SEQ ID NO: 9577 - DNA, 20 bp, human
ggccgcggttgtgtctggga

SEQ ID NO: 9578 - DNA, 20 bp, human
gtctgggcaacaagggagag

SEQ ID NO: 9579 - DNA, 20 bp, human
gcggccggccaggggtgtct

SEQ ID NO: 9580 - DNA, 20 bp, human
ggtcagccgcggttgtgtct

SEQ ID NO: 9581 - DNA, 20 bp, human
gagagtggctgcctcgactt

SEQ ID NO: 9582 - DNA, 20 bp, human
gggccggccgggtggaaaca

SEQ ID NO: 9583 - DNA, 20 bp, human
gcagtcgaaacaggcctggg

SEQ ID NO: 9584 - DNA, 20 bp, human
gcccgccgcgggccaatcca

SEQ ID NO: 9585 - DNA, 20 bp, human
gtgggccgctctgaattcgg

SEQ ID NO: 9586 - DNA, 20 bp, human
ggcggcgcgggcacaccccc

SEQ ID NO: 9587 - DNA, 20 bp, human
gcttgttagtgggcaccgag

SEQ ID NO: 9588 - DNA, 20 bp, human
gcgcagctggcccagccaac

SEQ ID NO: 9589 - DNA, 20 bp, human
ggcggctcacagctgacgat

SEQ ID NO: 9590 - DNA, 20 bp, human
gcgcctcagcaggagcgacg

SEQ ID NO: 9591 - DNA, 20 bp, human
gggcctcgtcgctcctgctg

SEQ ID NO: 9592 - DNA, 20 bp, human
gcggccgctaccttgttagt

SEQ ID NO: 9593 - DNA, 20 bp, human
ggtgcccactaacaaggtag

SEQ ID NO: 9594 - DNA, 20 bp, human
gcgccccaagagctcgccgg

SEQ ID NO: 9595 - DNA, 20 bp, human
gttcgtcgactcttaccggt

SEQ ID NO: 9596 - DNA, 20 bp, human
gggcaggtcggcggtgatgg

SEQ ID NO: 9597 - DNA, 20 bp, human
gctgccccggccgccatgtt

SEQ ID NO: 9598 - DNA, 20 bp, human
gcggcggctcgtccgacccg

SEQ ID NO: 9599 - DNA, 20 bp, human
ggccgctgggagccgcgggt

SEQ ID NO: 9600 - DNA, 20 bp, human
gcagaggcaccgcgagagaa

SEQ ID NO: 9601 - DNA, 20 bp, human
ggggctaccctggctactgt

SEQ ID NO: 9602 - DNA, 20 bp, human
ggagggcttcccgaggtcag

SEQ ID NO: 9603 - DNA, 20 bp, human
ggcggctcccagcggctgga

SEQ ID NO: 9604 - DNA, 20 bp, human
gccggagggacgagtgagag

SEQ ID NO: 9605 - DNA, 20 bp, human
ggagctgggctcgggaaacg

SEQ ID NO: 9606 - DNA, 20 bp, human
gaagcgacacctcggcccca

SEQ ID NO: 9607 - DNA, 20 bp, human
gcacgtgacgcgctccaaca

SEQ ID NO: 9608 - DNA, 20 bp, human
ggccaaggccgagtaggata

SEQ ID NO: 9609 - DNA, 20 bp, human
ggaggtgtcgcttcctgacg

SEQ ID NO: 9610 - DNA, 20 bp, human
ggtgacgcgctccaacatgg

SEQ ID NO: 9611 - DNA, 20 bp, human
ggtgtcgcttcctgacgggg

SEQ ID NO: 9612 - DNA, 20 bp, human
gctccgggggtataatgagg

SEQ ID NO: 9613 - DNA, 20 bp, human
gggccgggccaaggccgagt

SEQ ID NO: 9614 - DNA, 20 bp, human
ggcccgggcaacacttcctc

SEQ ID NO: 9615 - DNA, 20 bp, human
gggtggaattcgggatcggg

SEQ ID NO: 9616 - DNA, 20 bp, human
gccggtccgactgtcctcgg

SEQ ID NO: 9617 - DNA, 20 bp, human
gaccaaccgccgaggacagt

SEQ ID NO: 9618 - DNA, 20 bp, human
gcataacacttgggcagata

SEQ ID NO: 9619 - DNA, 20 bp, human
ggcagatacggcacagacta

SEQ ID NO: 9620 - DNA, 20 bp, human
gtcgccggtccgactgtcct

SEQ ID NO: 9621 - DNA, 20 bp, human
gtcacactgaccaaccgccg

SEQ ID NO: 9622 - DNA, 20 bp, human
gaaccaaaggcataacactt

SEQ ID NO: 9623 - DNA, 20 bp, human
gggctgggttgagaggtcgc

SEQ ID NO: 9624 - DNA, 20 bp, human
gttcggaacggtgaacccgt

SEQ ID NO: 9625 - DNA, 20 bp, human
gaggcgattccagagagcgg

SEQ ID NO: 9626 - DNA, 20 bp, human
gctgctgctaggatcgcgac

SEQ ID NO: 9627 - DNA, 20 bp, human
gggtgtatgagacggaggag

SEQ ID NO: 9628 - DNA, 20 bp, human
ggacgaggtgtatgagacgg

SEQ ID NO: 9629 - DNA, 20 bp, human
gcggcttcttctgcccggag

SEQ ID NO: 9630 - DNA, 20 bp, human
ggcgatcctagcagcaggtc

SEQ ID NO: 9631 - DNA, 20 bp, human
gctaggatcgcgacgggaac

SEQ ID NO: 9632 - DNA, 20 bp, human
gaggaggggagaccccctga

SEQ ID NO: 9633 - DNA, 20 bp, human
gcggaaatgacgtcctctcc

SEQ ID NO: 9634 - DNA, 20 bp, human
ggaagacgaggtgtatgaga

SEQ ID NO: 9635 - DNA, 20 bp, human
gggagaacaaacctgaatag

SEQ ID NO: 9636 - DNA, 20 bp, human
gcctggggggagcggactac

SEQ ID NO: 9637 - DNA, 20 bp, human
gaggtaggccgcaggctgtg

SEQ ID NO: 9638 - DNA, 20 bp, human
ggggcgcggcggacgcaggt

SEQ ID NO: 9639 - DNA, 20 bp, human
gggctcgctgctcccgggtg

SEQ ID NO: 9640 - DNA, 20 bp, human
ggttagcgcggggtcagcgg

SEQ ID NO: 9641 - DNA, 20 bp, human
ggcggcccaggactcgaggt

SEQ ID NO: 9642 - DNA, 20 bp, human
ggggtcagcggaggtcagcg

SEQ ID NO: 9643 - DNA, 20 bp, human
gtggcagggaacgactgcga

SEQ ID NO: 9644 - DNA, 20 bp, human
ggggtgccgtggcccaggcg

SEQ ID NO: 9645 - DNA, 20 bp, human
gcgtgggagcgaagcctcgg

SEQ ID NO: 9646 - DNA, 20 bp, human
gggagctccaataatcccta

SEQ ID NO: 9647 - DNA, 20 bp, human
gtcactgagggttgactgac

SEQ ID NO: 9648 - DNA, 20 bp, human
ggcgccaagtccagaaccat

SEQ ID NO: 9649 - DNA, 20 bp, human
gccagaaccatagggattat

SEQ ID NO: 9650 - DNA, 20 bp, human
gtggctcgtgatctcagcca

SEQ ID NO: 9651 - DNA, 20 bp, human
ggcattgtagctactcattg

SEQ ID NO: 9652 - DNA, 20 bp, human
gcacgagccacaaaagtaag

SEQ ID NO: 9653 - DNA, 20 bp, human
ggctcctttctcaaagggac

SEQ ID NO: 9654 - DNA, 20 bp, human
gtttctcaaagggacaggta

SEQ ID NO: 9655 - DNA, 20 bp, human
gagctgtcctcattagataa

SEQ ID NO: 9656 - DNA, 20 bp, human
ggcagcactgagaatctcca

SEQ ID NO: 9657 - DNA, 20 bp, human
gcgcgggtaggtaagagcag

SEQ ID NO: 9658 - DNA, 20 bp, human
gctgagaatctccaaggcag

SEQ ID NO: 9659 - DNA, 20 bp, human
ggggcggtggcgctcactcc

SEQ ID NO: 9660 - DNA, 20 bp, human
gtgcggatcatgtccctaag

SEQ ID NO: 9661 - DNA, 20 bp, human
gagaaagaccgagaaaacgg

SEQ ID NO: 9662 - DNA, 20 bp, human
gtagaacctggagacagcgg

SEQ ID NO: 9663 - DNA, 20 bp, human
gccaaggcagaggctccgcg

SEQ ID NO: 9664 - DNA, 20 bp, human
gggaagaggattccttggag

SEQ ID NO: 9665 - DNA, 20 bp, human
gcgcgagaggctgcccctta

SEQ ID NO: 9666 - DNA, 20 bp, human
gagagagagacacaccacgt

SEQ ID NO: 9667 - DNA, 20 bp, human
gtacaaatgggcacttacat

SEQ ID NO: 9668 - DNA, 20 bp, human
ggggagggtagccagaatgt

SEQ ID NO: 9669 - DNA, 20 bp, human
gctctaaggggattcgtgac

SEQ ID NO: 9670 - DNA, 20 bp, human
ggggcacttacataggtctg

SEQ ID NO: 9671 - DNA, 20 bp, human
ggtgcccatttgtaggaaga

SEQ ID NO: 9672 - DNA, 20 bp, human
gattcgtgacaggtaagcat

SEQ ID NO: 9673 - DNA, 20 bp, human
ggttcacctcatgaaaatca

SEQ ID NO: 9674 - DNA, 20 bp, human
gggacatgatatagatggtt

SEQ ID NO: 9675 - DNA, 20 bp, human
gaaggcctggctaacacaga

SEQ ID NO: 9676 - DNA, 20 bp, human
ggagcgtctcccggaaggat

SEQ ID NO: 9677 - DNA, 20 bp, human
gcttggagcgggacgagctc

SEQ ID NO: 9678 - DNA, 20 bp, human
ggccgcagctgccatcttag

SEQ ID NO: 9679 - DNA, 20 bp, human
ggcgccaggcgcccctaaga

SEQ ID NO: 9680 - DNA, 20 bp, human
ggcgtctacagctgccacga

SEQ ID NO: 9681 - DNA, 20 bp, human
gggcgctacgggtttctcgt

SEQ ID NO: 9682 - DNA, 20 bp, human
gtaggggcgcctggcgctac

SEQ ID NO: 9683 - DNA, 20 bp, human
gtcgttggaggcggccttcg

SEQ ID NO: 9684 - DNA, 20 bp, human
gggttagagcgtctcccgga

SEQ ID NO: 9685 - DNA, 20 bp, human
gcgaagatgtcgatgcggtc

SEQ ID NO: 9686 - DNA, 20 bp, human
gccagcagctcaccgcgctc

SEQ ID NO: 9687 - DNA, 20 bp, human
gagggagcagtgcccgagcg

SEQ ID NO: 9688 - DNA, 20 bp, human
gtgccgagccttgacaggcg

SEQ ID NO: 9689 - DNA, 20 bp, human
gccctctgccacgcctgtca

SEQ ID NO: 9690 - DNA, 20 bp, human
ggccttgacaggcgtggcag

SEQ ID NO: 9691 - DNA, 20 bp, human
ggaaagcgtggcctaataag

SEQ ID NO: 9692 - DNA, 20 bp, human
gtcaaggctcggcaaacatc

SEQ ID NO: 9693 - DNA, 20 bp, human
ggatccgaggaggggaacgg

SEQ ID NO: 9694 - DNA, 20 bp, human
gcggcaaacatccggctccg

SEQ ID NO: 9695 - DNA, 20 bp, human
ggaggaccggagcagatccg

SEQ ID NO: 9696 - DNA, 20 bp, human
gcagctagcgctggtctcgg

SEQ ID NO: 9697 - DNA, 20 bp, human
ggcgcgttcagggagcacag

SEQ ID NO: 9698 - DNA, 20 bp, human
gcccgtagagccgagtcctg

SEQ ID NO: 9699 - DNA, 20 bp, human
ggccagcagccagaggaacg

SEQ ID NO: 9700 - DNA, 20 bp, human
gctctctcggcaggagacgg

SEQ ID NO: 9701 - DNA, 20 bp, human
gagctgcggcgccccaatcc

SEQ ID NO: 9702 - DNA, 20 bp, human
ggtccggggccagcagccag

SEQ ID NO: 9703 - DNA, 20 bp, human
gccgcagctagcgctggtct

SEQ ID NO: 9704 - DNA, 20 bp, human
gtcctccgcgccgcaggact

SEQ ID NO: 9705 - DNA, 20 bp, human
ggccgcaggactcggctcta

SEQ ID NO: 9706 - DNA, 20 bp, human
ggggtgaccagaaagaaggt

SEQ ID NO: 9707 - DNA, 20 bp, human
gatacgtcgataactctctg

SEQ ID NO: 9708 - DNA, 20 bp, human
ggaaccagacggggacagta

SEQ ID NO: 9709 - DNA, 20 bp, human
gagacggggacagtaaggtt

SEQ ID NO: 9710 - DNA, 20 bp, human
ggggtgtctgcggaggagct

SEQ ID NO: 9711 - DNA, 20 bp, human
gtttcagagcgaaccagacg

SEQ ID NO: 9712 - DNA, 20 bp, human
ggtcgataactctctgaggc

SEQ ID NO: 9713 - DNA, 20 bp, human
gtggctctgggtgtctgcgg

SEQ ID NO: 9714 - DNA, 20 bp, human
gtggtggctctgggtgtctg

SEQ ID NO: 9715 - DNA, 20 bp, human
gcgttggaagtagcaagaag

SEQ ID NO: 9716 - DNA, 20 bp, human
ggcgaaccagacggacagta

SEQ ID NO: 9717 - DNA, 20 bp, human
gccagacggacagtaaggtt

SEQ ID NO: 9718 - DNA, 20 bp, human
ggtggagagaatctggcaat

SEQ ID NO: 9719 - DNA, 20 bp, human
gtggctccgggtgtctgcag

SEQ ID NO: 9720 - DNA, 20 bp, human
gggtgtctgcagtggagctg

SEQ ID NO: 9721 - DNA, 20 bp, human
gacccccccgtggtggctcc

SEQ ID NO: 9722 - DNA, 20 bp, human
gcgttggaagtagcaggaag

SEQ ID NO: 9723 - DNA, 20 bp, human
ggacggacagtaaggtttgg

SEQ ID NO: 9724 - DNA, 20 bp, human
gtgtgcaggccgggaggtag

SEQ ID NO: 9725 - DNA, 20 bp, human
gggcggaagcatgaggctaa

SEQ ID NO: 9726 - DNA, 20 bp, human
gcgcgggtcctggcggacgg

SEQ ID NO: 9727 - DNA, 20 bp, human
gcaggaagtcaggaaaccca

SEQ ID NO: 9728 - DNA, 20 bp, human
gaagagcgttcacacggcta

SEQ ID NO: 9729 - DNA, 20 bp, human
gagcccgaagagcgttcaca

SEQ ID NO: 9730 - DNA, 20 bp, human
ggtgcgcgcaaagggaggtc

SEQ ID NO: 9731 - DNA, 20 bp, human
ggtaacttaccctccctcag

SEQ ID NO: 9732 - DNA, 20 bp, human
ggcaggctggcctctgaggg

SEQ ID NO: 9733 - DNA, 20 bp, human
gtgccctcacacaggaagtc

SEQ ID NO: 9734 - DNA, 20 bp, human
gccgcggggcggactaagaa

SEQ ID NO: 9735 - DNA, 20 bp, human
gggcagagaagccacaactt

SEQ ID NO: 9736 - DNA, 20 bp, human
gacaggtcattgccgagaaa

SEQ ID NO: 9737 - DNA, 20 bp, human
gattaacagttaggagttga

SEQ ID NO: 9738 - DNA, 20 bp, human
gcgtaagagtaggcctgtgt

SEQ ID NO: 9739 - DNA, 20 bp, human
gattgttcaacatccagata

SEQ ID NO: 9740 - DNA, 20 bp, human
ggttaaaacttaccttttct

SEQ ID NO: 9741 - DNA, 20 bp, human
gtgatggcagtttcaataac

SEQ ID NO: 9742 - DNA, 20 bp, human
gttataaaacagttggttaa

SEQ ID NO: 9743 - DNA, 20 bp, human
gagtcacatgtcgtaagagt

SEQ ID NO: 9744 - DNA, 20 bp, human
gttacctgtgattaaaacat

SEQ ID NO: 9745 - DNA, 20 bp, human
gtgcttaatttcagtactgg

SEQ ID NO: 9746 - DNA, 20 bp, human
gcgcttcccggcccaaacgg

SEQ ID NO: 9747 - DNA, 20 bp, human
gcccgagggcgatgctcccg

SEQ ID NO: 9748 - DNA, 20 bp, human
gcaatgggcaggggaccccg

SEQ ID NO: 9749 - DNA, 20 bp, human
ggaccgggtctactccccga

SEQ ID NO: 9750 - DNA, 20 bp, human
gagctggctaaccagaccgt

SEQ ID NO: 9751 - DNA, 20 bp, human
ggctgccctgggctcaacaa

SEQ ID NO: 9752 - DNA, 20 bp, human
ggctggctcggcccccggga

SEQ ID NO: 9753 - DNA, 20 bp, human
gcatcgcttcccggcccaaa

SEQ ID NO: 9754 - DNA, 20 bp, human
ggcaggtctcgggagcccgg

SEQ ID NO: 9755 - DNA, 20 bp, human
gaggggaccccgcggtgtgg

SEQ ID NO: 9756 - DNA, 20 bp, human
gactggggagagggctatat

SEQ ID NO: 9757 - DNA, 20 bp, human
ggcgatcctgacacagagaa

SEQ ID NO: 9758 - DNA, 20 bp, human
ggcgagttgccaggcgagac

SEQ ID NO: 9759 - DNA, 20 bp, human
gggctgttagtaccactccc

SEQ ID NO: 9760 - DNA, 20 bp, human
ggtcgggaacagccatgcaa

SEQ ID NO: 9761 - DNA, 20 bp, human
gcggcaaggaccagaccgtc

SEQ ID NO: 9762 - DNA, 20 bp, human
ggaagttggcgtggggagaa

SEQ ID NO: 9763 - DNA, 20 bp, human
ggtgacagggaagttggcgt

SEQ ID NO: 9764 - DNA, 20 bp, human
gccgaaggcttacctcgagg

SEQ ID NO: 9765 - DNA, 20 bp, human
gacatgctgaaagatcaaat

SEQ ID NO: 9766 - DNA, 20 bp, human
gctgacgaagatggcgactg

SEQ ID NO: 9767 - DNA, 20 bp, human
ggcgaggaaacggaagtcca

SEQ ID NO: 9768 - DNA, 20 bp, human
gcacctccggccggattcgc

SEQ ID NO: 9769 - DNA, 20 bp, human
gggcgggacgtaaggtgggg

SEQ ID NO: 9770 - DNA, 20 bp, human
ggcgcttcacatcttctccg

SEQ ID NO: 9771 - DNA, 20 bp, human
gtccggccggattcgcgggc

SEQ ID NO: 9772 - DNA, 20 bp, human
ggcgccgagacacctcttga

SEQ ID NO: 9773 - DNA, 20 bp, human
gaggtgccagcccgcgaatc

SEQ ID NO: 9774 - DNA, 20 bp, human
ggtcctgccggtgcccgagg

SEQ ID NO: 9775 - DNA, 20 bp, human
ggccagcccgcgaatccggc

SEQ ID NO: 9776 - DNA, 20 bp, human
gggaggtacatggccccgac

SEQ ID NO: 9777 - DNA, 20 bp, human
gggtacatggccccgacggg

SEQ ID NO: 9778 - DNA, 20 bp, human
ggagcgcaggcggaggtaca

SEQ ID NO: 9779 - DNA, 20 bp, human
gcgctgccgctggccgtcaa

SEQ ID NO: 9780 - DNA, 20 bp, human
gctcgccgcgcgcctcccgt

SEQ ID NO: 9781 - DNA, 20 bp, human
gcccagcaggagactctagg

SEQ ID NO: 9782 - DNA, 20 bp, human
gcggctgccgtgctcaggca

SEQ ID NO: 9783 - DNA, 20 bp, human
gccgcggtgtcgagcgcagg

SEQ ID NO: 9784 - DNA, 20 bp, human
gaggcagggagccgagctcc

SEQ ID NO: 9785 - DNA, 20 bp, human
ggttctgggactctcattag

SEQ ID NO: 9786 - DNA, 20 bp, human
ggcgctggctcggggccgga

SEQ ID NO: 9787 - DNA, 20 bp, human
gaggcgaggggagagtccgg

SEQ ID NO: 9788 - DNA, 20 bp, human
ggcgaggcgaggggagagtc

SEQ ID NO: 9789 - DNA, 20 bp, human
ggggtggcctgtggcgggaa

SEQ ID NO: 9790 - DNA, 20 bp, human
gcgggcagcgcgggatcgtc

SEQ ID NO: 9791 - DNA, 20 bp, human
gcccgccccacgccctcctg

SEQ ID NO: 9792 - DNA, 20 bp, human
gagagagcccgcggcaagcc

SEQ ID NO: 9793 - DNA, 20 bp, human
gtcgcgggccgtggagtgcc

SEQ ID NO: 9794 - DNA, 20 bp, human
ggcccggcccggcgaggcga

SEQ ID NO: 9795 - DNA, 20 bp, human
gtctgtcacttggcgttcgc

SEQ ID NO: 9796 - DNA, 20 bp, human
gctgatcaatcactggacca

SEQ ID NO: 9797 - DNA, 20 bp, human
ggaggatgctcactattcag

SEQ ID NO: 9798 - DNA, 20 bp, human
gcaatcactggaccagggcg

SEQ ID NO: 9799 - DNA, 20 bp, human
gcgaacgagcaggacatgag

SEQ ID NO: 9800 - DNA, 20 bp, human
ggtccgtccggagccaggag

SEQ ID NO: 9801 - DNA, 20 bp, human
gcgcgtgcgcccaggccagg

SEQ ID NO: 9802 - DNA, 20 bp, human
gccaggagtttcacgaggaa

SEQ ID NO: 9803 - DNA, 20 bp, human
gagccaggagaggtagccga

SEQ ID NO: 9804 - DNA, 20 bp, human
gcatgtgacacatggcgtga

SEQ ID NO: 9805 - DNA, 20 bp, human
ggcctgacgggtgacgccag

SEQ ID NO: 9806 - DNA, 20 bp, human
gactcgggcagaggaaacgg

SEQ ID NO: 9807 - DNA, 20 bp, human
ggcggggcgggatcccgacc

SEQ ID NO: 9808 - DNA, 20 bp, human
gcaacggaaaacgaaaactc

SEQ ID NO: 9809 - DNA, 20 bp, human
gggcgactccattcatcggg

SEQ ID NO: 9810 - DNA, 20 bp, human
gccagcaccctcacctgtgg

SEQ ID NO: 9811 - DNA, 20 bp, human
ggggatcccgaccaggcaga

SEQ ID NO: 9812 - DNA, 20 bp, human
gagaaggcgactccattcat

SEQ ID NO: 9813 - DNA, 20 bp, human
gccggagccccggcccccac

SEQ ID NO: 9814 - DNA, 20 bp, human
gagtcgccttctgcctggtc

SEQ ID NO: 9815 - DNA, 20 bp, human
gtgtgccggggcctcgccaa

SEQ ID NO: 9816 - DNA, 20 bp, human
gtcggagcagcagccctgtc

SEQ ID NO: 9817 - DNA, 20 bp, human
gaacacagcccagctccggg

SEQ ID NO: 9818 - DNA, 20 bp, human
gaccgcgggaaggacggacg

SEQ ID NO: 9819 - DNA, 20 bp, human
gggagctaccgcgggaagga

SEQ ID NO: 9820 - DNA, 20 bp, human
gcccagcaaggtaggtgatg

SEQ ID NO: 9821 - DNA, 20 bp, human
gctccgggtggaaaccagca

SEQ ID NO: 9822 - DNA, 20 bp, human
gtcaagacagatgccggaca

SEQ ID NO: 9823 - DNA, 20 bp, human
gaagtgcgcggagctaccgc

SEQ ID NO: 9824 - DNA, 20 bp, human
ggctgctgctccgaaggaaa

SEQ ID NO: 9825 - DNA, 20 bp, human
ggcggtcgcgaggaagtgcg

SEQ ID NO: 9826 - DNA, 20 bp, human
ggaggctgcgaaaataggta

SEQ ID NO: 9827 - DNA, 20 bp, human
gctgcgaaaataggtatggt

SEQ ID NO: 9828 - DNA, 20 bp, human
ggacacttccctctgcgtca

SEQ ID NO: 9829 - DNA, 20 bp, human
ggagaaaggaggagacacgt

SEQ ID NO: 9830 - DNA, 20 bp, human
gtcacgacctcaactcagta

SEQ ID NO: 9831 - DNA, 20 bp, human
ggcagagggaagtgtcaact

SEQ ID NO: 9832 - DNA, 20 bp, human
gaagtggaggctgcgaaaat

SEQ ID NO: 9833 - DNA, 20 bp, human
gttgcttcacaagcaatctt

SEQ ID NO: 9834 - DNA, 20 bp, human
ggcctgagattctttcgaaa

SEQ ID NO: 9835 - DNA, 20 bp, human
gttgcttcccatgacgcaga

SEQ ID NO: 9836 - DNA, 20 bp, human
ggctagcgaaggaggcgggg

SEQ ID NO: 9837 - DNA, 20 bp, human
ggccgagagctagctagcga

SEQ ID NO: 9838 - DNA, 20 bp, human
gagctagctagcgaaggagg

SEQ ID NO: 9839 - DNA, 20 bp, human
gtcggaagtgcggactatcg

SEQ ID NO: 9840 - DNA, 20 bp, human
gtgctgtgagagggcgctcg

SEQ ID NO: 9841 - DNA, 20 bp, human
gtccttcgctagctagctct

SEQ ID NO: 9842 - DNA, 20 bp, human
ggttcgagcggcccagacac

SEQ ID NO: 9843 - DNA, 20 bp, human
gacgcagcgcggacccgcag

SEQ ID NO: 9844 - DNA, 20 bp, human
gcaaggagctcatcaaggac

SEQ ID NO: 9845 - DNA, 20 bp, human
ggccgccggctccacaggtg

SEQ ID NO: 9846 - DNA, 20 bp, human
gtaaggggtgaaccactgta

SEQ ID NO: 9847 - DNA, 20 bp, human
ggtgctggcacagggcaaca

SEQ ID NO: 9848 - DNA, 20 bp, human
gaggggcactaccccagtgc

SEQ ID NO: 9849 - DNA, 20 bp, human
gactgtaaggcagtaccagg

SEQ ID NO: 9850 - DNA, 20 bp, human
gggagggaactggagataag

SEQ ID NO: 9851 - DNA, 20 bp, human
gctgtcccggcagttcagag

SEQ ID NO: 9852 - DNA, 20 bp, human
gttaggagctgggtgagctg

SEQ ID NO: 9853 - DNA, 20 bp, human
gggaggagccaagagggacc

SEQ ID NO: 9854 - DNA, 20 bp, human
gcaagagggacctggctctc

SEQ ID NO: 9855 - DNA, 20 bp, human
gctggcccctctgaactgcc

SEQ ID NO: 9856 - DNA, 20 bp, human
gggaggcgccgcacatgagc

SEQ ID NO: 9857 - DNA, 20 bp, human
gcttatacaagcagccccgg

SEQ ID NO: 9858 - DNA, 20 bp, human
ggagtcaccgggagggaact

SEQ ID NO: 9859 - DNA, 20 bp, human
ggccaccccctagtccccca

SEQ ID NO: 9860 - DNA, 20 bp, human
ggggtggctgccccacctgg

SEQ ID NO: 9861 - DNA, 20 bp, human
gaccgggagggaactgggtc

SEQ ID NO: 9862 - DNA, 20 bp, human
ggaggagggagtacgagcaa

SEQ ID NO: 9863 - DNA, 20 bp, human
gccctagctggccccgaagg

SEQ ID NO: 9864 - DNA, 20 bp, human
gtcgcccctgggggactagg

SEQ ID NO: 9865 - DNA, 20 bp, human
gaagctgaggccaagttgaa

SEQ ID NO: 9866 - DNA, 20 bp, human
ggaccgggaccagcatggac

SEQ ID NO: 9867 - DNA, 20 bp, human
gcagcctgggctgaagtcgt

SEQ ID NO: 9868 - DNA, 20 bp, human
ggagcggctggtcgcacctc

SEQ ID NO: 9869 - DNA, 20 bp, human
gcggccccagaacaaagacc

SEQ ID NO: 9870 - DNA, 20 bp, human
ggaccagccgctctctcccg

SEQ ID NO: 9871 - DNA, 20 bp, human
gcgatggaggtggaggactc

SEQ ID NO: 9872 - DNA, 20 bp, human
ggcgcgcgcgtacgagtggt

SEQ ID NO: 9873 - DNA, 20 bp, human
gtgtcagcagctgggcggcg

SEQ ID NO: 9874 - DNA, 20 bp, human
gtggaggtggaggactcggg

SEQ ID NO: 9875 - DNA, 20 bp, human
gggaggtgggaaacgctcga

SEQ ID NO: 9876 - DNA, 20 bp, human
ggagctggggaggacgccag

SEQ ID NO: 9877 - DNA, 20 bp, human
gggagtccacgggaagggtc

SEQ ID NO: 9878 - DNA, 20 bp, human
gggactggagtccacgggaa

SEQ ID NO: 9879 - DNA, 20 bp, human
gaagcacacagactagtggt

SEQ ID NO: 9880 - DNA, 20 bp, human
gcggccccgagtggaagcgg

SEQ ID NO: 9881 - DNA, 20 bp, human
ggcccaagcacacagactag

SEQ ID NO: 9882 - DNA, 20 bp, human
gtgcggctgcggctgagatt

SEQ ID NO: 9883 - DNA, 20 bp, human
gggtgtcctcgagccaggac

SEQ ID NO: 9884 - DNA, 20 bp, human
gctaggggcgcgcccggcga

SEQ ID NO: 9885 - DNA, 20 bp, human
gcacgggaagggtccggccg

SEQ ID NO: 9886 - DNA, 20 bp, human
gcactcaggccaggagggta

SEQ ID NO: 9887 - DNA, 20 bp, human
gaggctgggccacgagacac

SEQ ID NO: 9888 - DNA, 20 bp, human
ggaggaagctaccaggaccc

SEQ ID NO: 9889 - DNA, 20 bp, human
gtcaggccaggagggtaagg

SEQ ID NO: 9890 - DNA, 20 bp, human
gcagcccgatccagcctgaa

SEQ ID NO: 9891 - DNA, 20 bp, human
gggccccggccacacggaag

SEQ ID NO: 9892 - DNA, 20 bp, human
gatcccatgggggactggta

SEQ ID NO: 9893 - DNA, 20 bp, human
ggccaggagggtaaggaggc

SEQ ID NO: 9894 - DNA, 20 bp, human
ggctggctgggatcccatgg

SEQ ID NO: 9895 - DNA, 20 bp, human
ggggcagggctcccaattgg

SEQ ID NO: 9896 - DNA, 20 bp, human
gcggggcgaggagactgccc

SEQ ID NO: 9897 - DNA, 20 bp, human
gctctaccaaagtcgtctga

SEQ ID NO: 9898 - DNA, 20 bp, human
gccgggagcccatcttacag

SEQ ID NO: 9899 - DNA, 20 bp, human
gggctcccgggctagatcac

SEQ ID NO: 9900 - DNA, 20 bp, human
gaggggcggcagagacggag

SEQ ID NO: 9901 - DNA, 20 bp, human
gacagcggtgccaagcagag

SEQ ID NO: 9902 - DNA, 20 bp, human
gtagatcaccggctgccccg

SEQ ID NO: 9903 - DNA, 20 bp, human
gggacccaccgcagccccct

SEQ ID NO: 9904 - DNA, 20 bp, human
ggcggcgcggggtggatctc

SEQ ID NO: 9905 - DNA, 20 bp, human
ggcagccggtgatctagccc

SEQ ID NO: 9906 - DNA, 20 bp, human
ggcaccagtacctgtcacta

SEQ ID NO: 9907 - DNA, 20 bp, human
ggtgccctagtgacaggtac

SEQ ID NO: 9908 - DNA, 20 bp, human
gtagggagtggacaggacaa

SEQ ID NO: 9909 - DNA, 20 bp, human
gtgtctggtgccctagtgac

SEQ ID NO: 9910 - DNA, 20 bp, human
gagctgaacaacctgaatgt

SEQ ID NO: 9911 - DNA, 20 bp, human
ggggaaggtttggagctcaa

SEQ ID NO: 9912 - DNA, 20 bp, human
gacaagttcagggcaagttg

SEQ ID NO: 9913 - DNA, 20 bp, human
gcagggcaagttgtggaatg

SEQ ID NO: 9914 - DNA, 20 bp, human
ggacttgttagaacgccagg

SEQ ID NO: 9915 - DNA, 20 bp, human
ggtatactcagatgtgtgtc

SEQ ID NO: 9916 - DNA, 20 bp, human
gcgcaggacgggagggacca

SEQ ID NO: 9917 - DNA, 20 bp, human
gccgccatggcgacacaaag

SEQ ID NO: 9918 - DNA, 20 bp, human
gccatggcgacacaaagggg

SEQ ID NO: 9919 - DNA, 20 bp, human
gatggggccgcaggacggga

SEQ ID NO: 9920 - DNA, 20 bp, human
ggacgagaacggcgagcgag

SEQ ID NO: 9921 - DNA, 20 bp, human
gggctggcagaaggatgccg

SEQ ID NO: 9922 - DNA, 20 bp, human
gggatgccgaggaaggtgct

SEQ ID NO: 9923 - DNA, 20 bp, human
gctccgccggggagggctga

SEQ ID NO: 9924 - DNA, 20 bp, human
gagccacgggcagccgttag

SEQ ID NO: 9925 - DNA, 20 bp, human
gcacaggccgcgggatcggg

SEQ ID NO: 9926 - DNA, 20 bp, human
ggatgtgtcgacgatgatga

SEQ ID NO: 9927 - DNA, 20 bp, human
gcaaccagcagctttccgtc

SEQ ID NO: 9928 - DNA, 20 bp, human
gcagtgtggtgggattatct

SEQ ID NO: 9929 - DNA, 20 bp, human
gccacactgatgttgtaggt

SEQ ID NO: 9930 - DNA, 20 bp, human
gagcactcgggcgcacgaag

SEQ ID NO: 9931 - DNA, 20 bp, human
gtctgggaccgagaaggaaa

SEQ ID NO: 9932 - DNA, 20 bp, human
gggattatctgggaccgaga

SEQ ID NO: 9933 - DNA, 20 bp, human
gcgctccctggaggattgtg

SEQ ID NO: 9934 - DNA, 20 bp, human
ggcagggccgtgcttcgatg

SEQ ID NO: 9935 - DNA, 20 bp, human
ggaagttagccgctccctgg

SEQ ID NO: 9936 - DNA, 20 bp, human
gctcaaaggccgaggcgaaa

SEQ ID NO: 9937 - DNA, 20 bp, human
gcgcaactcaaggaccctca

SEQ ID NO: 9938 - DNA, 20 bp, human
gctcagggcgtggtcaccgg

SEQ ID NO: 9939 - DNA, 20 bp, human
gcggcgggggcggggctcaa

SEQ ID NO: 9940 - DNA, 20 bp, human
gagcggcgtcccgcaactca

SEQ ID NO: 9941 - DNA, 20 bp, human
gcgggtcatggcgtggatac

SEQ ID NO: 9942 - DNA, 20 bp, human
gaggatgaatgtccctgaca

SEQ ID NO: 9943 - DNA, 20 bp, human
gtttatgcggggcctcgacg

SEQ ID NO: 9944 - DNA, 20 bp, human
ggcgtctggccccaaggctc

SEQ ID NO: 9945 - DNA, 20 bp, human
gggtgcgggggacgacgcaa

SEQ ID NO: 9946 - DNA, 20 bp, human
gcggaggacgccgacagcac

SEQ ID NO: 9947 - DNA, 20 bp, human
gcgtgtgcccggcccgaagt

SEQ ID NO: 9948 - DNA, 20 bp, human
gccgacagcacgggctgccg

SEQ ID NO: 9949 - DNA, 20 bp, human
gcggccgccgcgcactgggc

SEQ ID NO: 9950 - DNA, 20 bp, human
gacacaactcactctggaca

SEQ ID NO: 9951 - DNA, 20 bp, human
gccgccgcgcactgggccgg

SEQ ID NO: 9952 - DNA, 20 bp, human
gtgagagcgcgggcaacggg

SEQ ID NO: 9953 - DNA, 20 bp, human
gtgctccgccgctgctgccg

SEQ ID NO: 9954 - DNA, 20 bp, human
gaggcccgcggcgactgcag

SEQ ID NO: 9955 - DNA, 20 bp, human
ggggggcgcggaggctcgag

SEQ ID NO: 9956 - DNA, 20 bp, human
ggcgtcgcttcggagcgcgg

SEQ ID NO: 9957 - DNA, 20 bp, human
ggggtcccagcggatcgtga

SEQ ID NO: 9958 - DNA, 20 bp, human
gctccgaagcgacgccggga

SEQ ID NO: 9959 - DNA, 20 bp, human
ggccagccccataggtccag

SEQ ID NO: 9960 - DNA, 20 bp, human
ggaacgcgctcagtctaagg

SEQ ID NO: 9961 - DNA, 20 bp, human
ggctcggccccgctccctcg

SEQ ID NO: 9962 - DNA, 20 bp, human
ggtggaacgcgctcagtcta

SEQ ID NO: 9963 - DNA, 20 bp, human
gtgagaagcctgctccccgt

SEQ ID NO: 9964 - DNA, 20 bp, human
gtctaaggcggcggtgacca

SEQ ID NO: 9965 - DNA, 20 bp, human
gggggccgagcagaccgacg

SEQ ID NO: 9966 - DNA, 20 bp, human
gcggccgcgtgggagcagtg

SEQ ID NO: 9967 - DNA, 20 bp, human
ggtgagaagcggtagaccca

SEQ ID NO: 9968 - DNA, 20 bp, human
gggagaacccaaggtcgtga

SEQ ID NO: 9969 - DNA, 20 bp, human
gagaagcggtagacccaagg

SEQ ID NO: 9970 - DNA, 20 bp, human
gggttcagtggagacactgg

SEQ ID NO: 9971 - DNA, 20 bp, human
gcttctcacccaaggttcag

SEQ ID NO: 9972 - DNA, 20 bp, human
gcccgctccagaggtcgctg

SEQ ID NO: 9973 - DNA, 20 bp, human
gtgggagcagtggggttcga

SEQ ID NO: 9974 - DNA, 20 bp, human
ggtctaccgcttctcaccca

SEQ ID NO: 9975 - DNA, 20 bp, human
gggcccgctcacggccgcgt

SEQ ID NO: 9976 - DNA, 20 bp, human
ggatcgagtcagccccacgg

SEQ ID NO: 9977 - DNA, 20 bp, human
ggcacctcgaggatcccggt

SEQ ID NO: 9978 - DNA, 20 bp, human
ggccatgggctggcacctcg

SEQ ID NO: 9979 - DNA, 20 bp, human
gggccagtagcctgaaccca

SEQ ID NO: 9980 - DNA, 20 bp, human
gggcaggctcggccatgggc

SEQ ID NO: 9981 - DNA, 20 bp, human
ggccgatcgagtcagcccca

SEQ ID NO: 9982 - DNA, 20 bp, human
ggctggcacctcgaggatcc

SEQ ID NO: 9983 - DNA, 20 bp, human
gtcctcgaggtgccagccca

SEQ ID NO: 9984 - DNA, 20 bp, human
gggagggcaggctcggccat

SEQ ID NO: 9985 - DNA, 20 bp, human
gcgaggatcccggtcggtcg

SEQ ID NO: 9986 - DNA, 20 bp, human
gcacggcgcgcagacacttc

SEQ ID NO: 9987 - DNA, 20 bp, human
gcgacgactgtcaagagagt

SEQ ID NO: 9988 - DNA, 20 bp, human
gagcaggaaagtttctctca

SEQ ID NO: 9989 - DNA, 20 bp, human
gtgcgctcgcctagcctcgg

SEQ ID NO: 9990 - DNA, 20 bp, human
ggaaggcgccgggacgcgag

SEQ ID NO: 9991 - DNA, 20 bp, human
gctgattgcgcggaggaaac

SEQ ID NO: 9992 - DNA, 20 bp, human
gagttggggagtggaactgc

SEQ ID NO: 9993 - DNA, 20 bp, human
gatcgtcgttcggaacgcgg

SEQ ID NO: 9994 - DNA, 20 bp, human
ggctcgcctagcctcggggg

SEQ ID NO: 9995 - DNA, 20 bp, human
gccgaggcgcgagtcccctc

SEQ ID NO: 9996 - DNA, 20 bp, human
gagctggccaaccagacggt

SEQ ID NO: 9997 - DNA, 20 bp, human
gcgcgggcgcgcaccgacag

SEQ ID NO: 9998 - DNA, 20 bp, human
ggggcaggtaggtcacccgc

SEQ ID NO: 9999 - DNA, 20 bp, human
gaaccagacggtgggcaggt

SEQ ID NO: 10000 - DNA, 20 bp, human
gcgggagccatgtaaccctg

SEQ ID NO: 10001 - DNA, 20 bp, human
gcgccagctggccaaccaga

SEQ ID NO: 10002 - DNA, 20 bp, human
gcagggaggacgaagcgaag

SEQ ID NO: 10003 - DNA, 20 bp, human
gccccgcgccggactgggac

SEQ ID NO: 10004 - DNA, 20 bp, human
ggtcccggggaaaggcaggg

SEQ ID NO: 10005 - DNA, 20 bp, human
gcatcacctgcgcgcccctg

SEQ ID NO: 10006 - DNA, 20 bp, human
gcagccacacacccgaccgg

SEQ ID NO: 10007 - DNA, 20 bp, human
gtgagcgcgccgaggaagag

SEQ ID NO: 10008 - DNA, 20 bp, human
gcgccgctccgcccccggtc

SEQ ID NO: 10009 - DNA, 20 bp, human
ggcgcagccacacacccgac

SEQ ID NO: 10010 - DNA, 20 bp, human
gcgcgccgggagagatgctg

SEQ ID NO: 10011 - DNA, 20 bp, human
ggtctcctcctcaacggcag

SEQ ID NO: 10012 - DNA, 20 bp, human
gaggtcctacctaacaacgt

SEQ ID NO: 10013 - DNA, 20 bp, human
gccacacacccgaccggggg

SEQ ID NO: 10014 - DNA, 20 bp, human
gcggttgtaaccagttgaag

SEQ ID NO: 10015 - DNA, 20 bp, human
gttcggcgtgaagggcagag

SEQ ID NO: 10016 - DNA, 20 bp, human
gcactgggccgctccgggtg

SEQ ID NO: 10017 - DNA, 20 bp, human
ggtccccaccggctccgcag

SEQ ID NO: 10018 - DNA, 20 bp, human
gcacctgctcactaactcag

SEQ ID NO: 10019 - DNA, 20 bp, human
gctgccgctgcggagccggt

SEQ ID NO: 10020 - DNA, 20 bp, human
ggtgctgtgcaaagcgcccc

SEQ ID NO: 10021 - DNA, 20 bp, human
ggcagcgggacgctgtgcca

SEQ ID NO: 10022 - DNA, 20 bp, human
gtcctcccggaggcgacatg

SEQ ID NO: 10023 - DNA, 20 bp, human
gggcgcgccactcctcccgg

SEQ ID NO: 10024 - DNA, 20 bp, human
gcctcagccgtggacctgtg

SEQ ID NO: 10025 - DNA, 20 bp, human
ggtgagcaggtggcacttcg

SEQ ID NO: 10026 - DNA, 20 bp, human
gtcgcccagcctcagtgacc

SEQ ID NO: 10027 - DNA, 20 bp, human
gtgaagcgccgcgccgcctt

SEQ ID NO: 10028 - DNA, 20 bp, human
gcgcgcggccagcacagacc

SEQ ID NO: 10029 - DNA, 20 bp, human
gcggctccagggcctccggg

SEQ ID NO: 10030 - DNA, 20 bp, human
gtagcccgcggacggctcag

SEQ ID NO: 10031 - DNA, 20 bp, human
gcgccgggttaatcattgca

SEQ ID NO: 10032 - DNA, 20 bp, human
gacagacccggcgcaaacgg

SEQ ID NO: 10033 - DNA, 20 bp, human
gggcgcgggacccgagacgg

SEQ ID NO: 10034 - DNA, 20 bp, human
ggcggcccctagcccgcgga

SEQ ID NO: 10035 - DNA, 20 bp, human
gccaggaacgctgccgaagg

SEQ ID NO: 10036 - DNA, 20 bp, human
gcggggtccgtggccaggta

SEQ ID NO: 10037 - DNA, 20 bp, human
ggtccgtggccaggtaaggc

SEQ ID NO: 10038 - DNA, 20 bp, human
gctgcccgggagccacgtcc

SEQ ID NO: 10039 - DNA, 20 bp, human
ggcagacccggcacgcaggt

SEQ ID NO: 10040 - DNA, 20 bp, human
gcgtggccaggtaaggcggg

SEQ ID NO: 10041 - DNA, 20 bp, human
gcccaggacggaagcaaaaa

SEQ ID NO: 10042 - DNA, 20 bp, human
gccaaaacgcaggctgagag

SEQ ID NO: 10043 - DNA, 20 bp, human
gcgacctaacctgagacccc

SEQ ID NO: 10044 - DNA, 20 bp, human
gacaccccaaacctacaagg

SEQ ID NO: 10045 - DNA, 20 bp, human
gcgccgccgcccgccttacc

SEQ ID NO: 10046 - DNA, 20 bp, human
ggtactgggggagaaacctc

SEQ ID NO: 10047 - DNA, 20 bp, human
gctgaggtgacccagggtac

SEQ ID NO: 10048 - DNA, 20 bp, human
gctctgggctgaggtgaccc

SEQ ID NO: 10049 - DNA, 20 bp, human
gctaccttgaggttcatcag

SEQ ID NO: 10050 - DNA, 20 bp, human
ggctggcggtgagaagacaa

SEQ ID NO: 10051 - DNA, 20 bp, human
gacagcggcgaaggtccacc

SEQ ID NO: 10052 - DNA, 20 bp, human
ggggtggggaccgaggacag

SEQ ID NO: 10053 - DNA, 20 bp, human
gcttgaggttcatcagggga

SEQ ID NO: 10054 - DNA, 20 bp, human
gcgccgcagtcgcagcgaga

SEQ ID NO: 10055 - DNA, 20 bp, human
gccaccaggttacagtacac

SEQ ID NO: 10056 - DNA, 20 bp, human
gaccgcgcggccgaaccctc

SEQ ID NO: 10057 - DNA, 20 bp, human
ggccacggccactcaccgga

SEQ ID NO: 10058 - DNA, 20 bp, human
gggagggatcctgaaccgcg

SEQ ID NO: 10059 - DNA, 20 bp, human
gggccactcaccggagggtt

SEQ ID NO: 10060 - DNA, 20 bp, human
gggccgaaccctccggtgag

SEQ ID NO: 10061 - DNA, 20 bp, human
gccccgaacgcgatggaccg

SEQ ID NO: 10062 - DNA, 20 bp, human
gtcgtgaccccggaagtgac

SEQ ID NO: 10063 - DNA, 20 bp, human
gaccccggaagtgacaggca

SEQ ID NO: 10064 - DNA, 20 bp, human
ggccccccgcgtccccaagg

SEQ ID NO: 10065 - DNA, 20 bp, human
ggacctgagggcccctcctt

SEQ ID NO: 10066 - DNA, 20 bp, human
gagtcagagttgagagacag

SEQ ID NO: 10067 - DNA, 20 bp, human
gttgagagacagaggcaccc

SEQ ID NO: 10068 - DNA, 20 bp, human
ggtgcttcacgtctctgtcc

SEQ ID NO: 10069 - DNA, 20 bp, human
ggtctgtgctggtggatggt

SEQ ID NO: 10070 - DNA, 20 bp, human
gcaaatacctcgggctgggg

SEQ ID NO: 10071 - DNA, 20 bp, human
ggaggaggcttaaaaaagga

SEQ ID NO: 10072 - DNA, 20 bp, human
gtggatggtgggttgtgctg

SEQ ID NO: 10073 - DNA, 20 bp, human
ggagtactggcagttagaac

SEQ ID NO: 10074 - DNA, 20 bp, human
gtttcctgcaaagtaggagc

SEQ ID NO: 10075 - DNA, 20 bp, human
gtgataagaaattgctaagg

SEQ ID NO: 10076 - DNA, 20 bp, human
ggagaagacgggagcgaagt

SEQ ID NO: 10077 - DNA, 20 bp, human
gccagccccacccaagacag

SEQ ID NO: 10078 - DNA, 20 bp, human
gctccaggcggcggtgtcca

SEQ ID NO: 10079 - DNA, 20 bp, human
ggagcccctctgtcttgggt

SEQ ID NO: 10080 - DNA, 20 bp, human
gggaccaggtgcggacgggt

SEQ ID NO: 10081 - DNA, 20 bp, human
gtggtgatccccgagaagac

SEQ ID NO: 10082 - DNA, 20 bp, human
ggaagggaccaggtgcggac

SEQ ID NO: 10083 - DNA, 20 bp, human
gcctggagcccctctgtctt

SEQ ID NO: 10084 - DNA, 20 bp, human
gcggctcctcggcggctccg

SEQ ID NO: 10085 - DNA, 20 bp, human
gtcaggctctgtagggcgtg

SEQ ID NO: 10086 - DNA, 20 bp, human
ggatcgccgagcccgacctc

SEQ ID NO: 10087 - DNA, 20 bp, human
gaagcgggagccgggaccca

SEQ ID NO: 10088 - DNA, 20 bp, human
ggtgtccgcgcggaggtgac

SEQ ID NO: 10089 - DNA, 20 bp, human
ggtacctggtgtccgcgcgg

SEQ ID NO: 10090 - DNA, 20 bp, human
gggtcgggctcggcgatccc

SEQ ID NO: 10091 - DNA, 20 bp, human
gccggcggggcgcccgaggt

SEQ ID NO: 10092 - DNA, 20 bp, human
ggccaaaccgactcgtccca

SEQ ID NO: 10093 - DNA, 20 bp, human
gtgcgttccctgggacgagt

SEQ ID NO: 10094 - DNA, 20 bp, human
ggtggccctaaagcatgcgg

SEQ ID NO: 10095 - DNA, 20 bp, human
gcgcgcggaggtgaccggcg

SEQ ID NO: 10096 - DNA, 20 bp, human
gggcggctagagcgacgcgg

SEQ ID NO: 10097 - DNA, 20 bp, human
gagggacagctgccagtctg

SEQ ID NO: 10098 - DNA, 20 bp, human
gcagggcggctagagcgacg

SEQ ID NO: 10099 - DNA, 20 bp, human
gctccagaggttccacagac

SEQ ID NO: 10100 - DNA, 20 bp, human
ggcgacgcggcggcaggggt

SEQ ID NO: 10101 - DNA, 20 bp, human
ggacccaccacgcaccccta

SEQ ID NO: 10102 - DNA, 20 bp, human
ggtccctcacctgctccagg

SEQ ID NO: 10103 - DNA, 20 bp, human
gaaccgaagcctccgcgctc

SEQ ID NO: 10104 - DNA, 20 bp, human
gtggggtcctcatagaccag

SEQ ID NO: 10105 - DNA, 20 bp, human
gagcccgagcgcggaggctt

SEQ ID NO: 10106 - DNA, 20 bp, human
ggcgcgatccgggacggacg

SEQ ID NO: 10107 - DNA, 20 bp, human
gggcaggagcgaactccgat

SEQ ID NO: 10108 - DNA, 20 bp, human
gaggagcgaactccgatcgg

SEQ ID NO: 10109 - DNA, 20 bp, human
gtcggcggaaggagcccgag

SEQ ID NO: 10110 - DNA, 20 bp, human
gccccggcccctcaggataa

SEQ ID NO: 10111 - DNA, 20 bp, human
ggcagaagtgcaactctcaa

SEQ ID NO: 10112 - DNA, 20 bp, human
gggcgcatccctgtagccgg

SEQ ID NO: 10113 - DNA, 20 bp, human
gtgggacccagcgatttcgg

SEQ ID NO: 10114 - DNA, 20 bp, human
gcgcgcgcccgccggctaca

SEQ ID NO: 10115 - DNA, 20 bp, human
ggccggcgggcgcgcgatcc

SEQ ID NO: 10116 - DNA, 20 bp, human
gtgagcggcgcggacgacaa

SEQ ID NO: 10117 - DNA, 20 bp, human
gccacacagaggggagacgc

SEQ ID NO: 10118 - DNA, 20 bp, human
gacacgcgaggatcccgcgg

SEQ ID NO: 10119 - DNA, 20 bp, human
gtggagttctggtgttacta

SEQ ID NO: 10120 - DNA, 20 bp, human
gcaggacacccggaggaccc

SEQ ID NO: 10121 - DNA, 20 bp, human
gggcacacgcgaggatcccg

SEQ ID NO: 10122 - DNA, 20 bp, human
gccagaactccagtgacaca

SEQ ID NO: 10123 - DNA, 20 bp, human
gccgccgccacccgagccaa

SEQ ID NO: 10124 - DNA, 20 bp, human
gtcgtccgcgccgctcacaa

SEQ ID NO: 10125 - DNA, 20 bp, human
gggcgccgcgtcgcgcacgg

SEQ ID NO: 10126 - DNA, 20 bp, human
ggttgggctcctccacatcc

SEQ ID NO: 10127 - DNA, 20 bp, human
gcaggctcggcgcacaggga

SEQ ID NO: 10128 - DNA, 20 bp, human
gtctggccgggcgagagaga

SEQ ID NO: 10129 - DNA, 20 bp, human
ggcggcaggccggcacgagc

SEQ ID NO: 10130 - DNA, 20 bp, human
gagcgagcggcgaaccgagg

SEQ ID NO: 10131 - DNA, 20 bp, human
gcgcgaaggccggaacacgg

SEQ ID NO: 10132 - DNA, 20 bp, human
ggcgagcgcggccgcgacgc

SEQ ID NO: 10133 - DNA, 20 bp, human
gcggccgcgacgccggcagt

SEQ ID NO: 10134 - DNA, 20 bp, human
gtcagaaaaaggccgaacgt

SEQ ID NO: 10135 - DNA, 20 bp, human
ggtcggacgcccgctcgtgc

SEQ ID NO: 10136 - DNA, 20 bp, human
gcgggcgcgcgcgcagacag

SEQ ID NO: 10137 - DNA, 20 bp, human
gcccagatagagagccggga

SEQ ID NO: 10138 - DNA, 20 bp, human
gcgaggccccgagactccgg

SEQ ID NO: 10139 - DNA, 20 bp, human
gccggctcgccgggttctgg

SEQ ID NO: 10140 - DNA, 20 bp, human
gggagacgcggccaacgctg

SEQ ID NO: 10141 - DNA, 20 bp, human
gggcctcgaactccccgccg

SEQ ID NO: 10142 - DNA, 20 bp, human
gcggcctggaagccctggtc

SEQ ID NO: 10143 - DNA, 20 bp, human
ggcgggatcagctcacggac

SEQ ID NO: 10144 - DNA, 20 bp, human
ggcctccgcctcccggacca

SEQ ID NO: 10145 - DNA, 20 bp, human
gtctgcgcgcgcgcccgcga

SEQ ID NO: 10146 - DNA, 20 bp, human
gcccagggctgagtgagtag

SEQ ID NO: 10147 - DNA, 20 bp, human
gccttggagcgaggaatgca

SEQ ID NO: 10148 - DNA, 20 bp, human
gcaggagacagaggtatcca

SEQ ID NO: 10149 - DNA, 20 bp, human
gcctgggaggtgactgagag

SEQ ID NO: 10150 - DNA, 20 bp, human
gtgtggatcggggctcatag

SEQ ID NO: 10151 - DNA, 20 bp, human
gagcctgcgggagggtccct

SEQ ID NO: 10152 - DNA, 20 bp, human
ggagagtggaggggattcaa

SEQ ID NO: 10153 - DNA, 20 bp, human
gtacctgggttcctaagggt

SEQ ID NO: 10154 - DNA, 20 bp, human
gctcgctccaaggggcagac

SEQ ID NO: 10155 - DNA, 20 bp, human
ggatgaggacaagacggcaa

SEQ ID NO: 10156 - DNA, 20 bp, human
gggagggaaggcgcaggcac

SEQ ID NO: 10157 - DNA, 20 bp, human
gcagaccgcgcaggaagcgg

SEQ ID NO: 10158 - DNA, 20 bp, human
gagccagaccgcgcaggaag

SEQ ID NO: 10159 - DNA, 20 bp, human
gtgcagccgcttcgctcctg

SEQ ID NO: 10160 - DNA, 20 bp, human
gggccactcggggtcaagag

SEQ ID NO: 10161 - DNA, 20 bp, human
ggcttgcgggaaaagcgagg

SEQ ID NO: 10162 - DNA, 20 bp, human
gagcgaagcggctgcaggac

SEQ ID NO: 10163 - DNA, 20 bp, human
gaagaggaagcggccactcg

SEQ ID NO: 10164 - DNA, 20 bp, human
ggccctctcttgaccccgag

SEQ ID NO: 10165 - DNA, 20 bp, human
ggggaggcgccgggaacccg

SEQ ID NO: 10166 - DNA, 20 bp, human
gccgcggctggagcgaccag

SEQ ID NO: 10167 - DNA, 20 bp, human
ggcaggcggacgcagagtcg

SEQ ID NO: 10168 - DNA, 20 bp, human
ggcgagcagccaagggcgtt

SEQ ID NO: 10169 - DNA, 20 bp, human
gcctccgtctcgggtcccag

SEQ ID NO: 10170 - DNA, 20 bp, human
gaagcagcgcacgggagtgt

SEQ ID NO: 10171 - DNA, 20 bp, human
gggtgccccgtccgccatag

SEQ ID NO: 10172 - DNA, 20 bp, human
ggacgcagagaccggagcag

SEQ ID NO: 10173 - DNA, 20 bp, human
gtccgcctgcccaacgccct

SEQ ID NO: 10174 - DNA, 20 bp, human
gggagcgaccaggggcaccg

SEQ ID NO: 10175 - DNA, 20 bp, human
gcggctgacaggataggagg

SEQ ID NO: 10176 - DNA, 20 bp, human
gggccggacggaggcatcgg

SEQ ID NO: 10177 - DNA, 20 bp, human
gcggacggaggcatcggagg

SEQ ID NO: 10178 - DNA, 20 bp, human
gtcggaggcggctgcgagag

SEQ ID NO: 10179 - DNA, 20 bp, human
ggcggctgcgagagtggcag

SEQ ID NO: 10180 - DNA, 20 bp, human
gatctgggggggccggacgg

SEQ ID NO: 10181 - DNA, 20 bp, human
ggctcctgaacgaggagcag

SEQ ID NO: 10182 - DNA, 20 bp, human
gcgggaggcctgaaatacga

SEQ ID NO: 10183 - DNA, 20 bp, human
ggggggccggacggaggcat

SEQ ID NO: 10184 - DNA, 20 bp, human
gctagctactgtggatctgg

SEQ ID NO: 10185 - DNA, 20 bp, human
gccccgggcgctcctgaacg

SEQ ID NO: 10186 - DNA, 20 bp, human
gaggatatccccgacgtacg

SEQ ID NO: 10187 - DNA, 20 bp, human
gtggtgggcgcggaacaagg

SEQ ID NO: 10188 - DNA, 20 bp, human
gtccccgacgtacgcggcag

SEQ ID NO: 10189 - DNA, 20 bp, human
gaggctccaccttctcgctg

SEQ ID NO: 10190 - DNA, 20 bp, human
gggctctgggaagaacgcgt

SEQ ID NO: 10191 - DNA, 20 bp, human
ggccgctgccgcgtacgtcg

SEQ ID NO: 10192 - DNA, 20 bp, human
gggatgaggagcggaaccat

SEQ ID NO: 10193 - DNA, 20 bp, human
gctgcagcttgcagtcccgc

SEQ ID NO: 10194 - DNA, 20 bp, human
gacaaggcggggccaggatc

SEQ ID NO: 10195 - DNA, 20 bp, human
ggcctggtgggcgcggaaca

SEQ ID NO: 10196 - DNA, 20 bp, human
gattcgatccgagacataat

SEQ ID NO: 10197 - DNA, 20 bp, human
gggaccgcggcgaaaggaga

SEQ ID NO: 10198 - DNA, 20 bp, human
gcagaggtcgaagaacagag

SEQ ID NO: 10199 - DNA, 20 bp, human
gggagacaggagatgcaccg

SEQ ID NO: 10200 - DNA, 20 bp, human
ggactgaggtaacgcagtag

SEQ ID NO: 10201 - DNA, 20 bp, human
gacggtgctgggatcccggg

SEQ ID NO: 10202 - DNA, 20 bp, human
gactgcgagcgagtgggtag

SEQ ID NO: 10203 - DNA, 20 bp, human
ggggtaggattcactcccag

SEQ ID NO: 10204 - DNA, 20 bp, human
ggaaagggccaacctgggtc

SEQ ID NO: 10205 - DNA, 20 bp, human
gaagttgctccggtaaggga

SEQ ID NO: 10206 - DNA, 20 bp, human
gtgtgcgggtcccagcggag

SEQ ID NO: 10207 - DNA, 20 bp, human
gaccgggaggaggtgtccag

SEQ ID NO: 10208 - DNA, 20 bp, human
gcacagcgccagtggctcgg

SEQ ID NO: 10209 - DNA, 20 bp, human
ggggacccgcacagcgccag

SEQ ID NO: 10210 - DNA, 20 bp, human
gctgcatggccggcccgggt

SEQ ID NO: 10211 - DNA, 20 bp, human
gatgcagggggaatcacggg

SEQ ID NO: 10212 - DNA, 20 bp, human
gctaggcccccgcaccgaca

SEQ ID NO: 10213 - DNA, 20 bp, human
ggggccgacccccgagccac

SEQ ID NO: 10214 - DNA, 20 bp, human
gtagagccacccctaaccag

SEQ ID NO: 10215 - DNA, 20 bp, human
gcctcccacagcctggaccg

SEQ ID NO: 10216 - DNA, 20 bp, human
gggagcacccactaccccgt

SEQ ID NO: 10217 - DNA, 20 bp, human
gccggacccgggccacccac

SEQ ID NO: 10218 - DNA, 20 bp, human
ggcgctctcctaagctctcg

SEQ ID NO: 10219 - DNA, 20 bp, human
gcgggaaccgcgcaccgcag

SEQ ID NO: 10220 - DNA, 20 bp, human
gagcgcagccgcgagagctt

SEQ ID NO: 10221 - DNA, 20 bp, human
gggcgtccccggttgtccag

SEQ ID NO: 10222 - DNA, 20 bp, human
gtcgcgtgctcccagaccgg

SEQ ID NO: 10223 - DNA, 20 bp, human
gagagcgctgccgccgaccg

SEQ ID NO: 10224 - DNA, 20 bp, human
ggcacccactaccccgtggg

SEQ ID NO: 10225 - DNA, 20 bp, human
ggacagaagggagcgtcccg

SEQ ID NO: 10226 - DNA, 20 bp, human
ggagccttccggactccggg

SEQ ID NO: 10227 - DNA, 20 bp, human
ggagtccggaaggctctccc

SEQ ID NO: 10228 - DNA, 20 bp, human
gccgccgcccggagtccgga

SEQ ID NO: 10229 - DNA, 20 bp, human
gcctgtctcccgaaggacac

SEQ ID NO: 10230 - DNA, 20 bp, human
gtccgaggcgccctcaggca

SEQ ID NO: 10231 - DNA, 20 bp, human
gcgggcgcactgagagccgg

SEQ ID NO: 10232 - DNA, 20 bp, human
ggccctgcggatgcgaactc

SEQ ID NO: 10233 - DNA, 20 bp, human
ggtctcccgaaggacactgg

SEQ ID NO: 10234 - DNA, 20 bp, human
ggccaggcgttggcatcgcc

SEQ ID NO: 10235 - DNA, 20 bp, human
gcccggccgccgccaggcgt

SEQ ID NO: 10236 - DNA, 20 bp, human
gccagctccacgatgccggg

SEQ ID NO: 10237 - DNA, 20 bp, human
gagccgggcaggactcgact

SEQ ID NO: 10238 - DNA, 20 bp, human
ggtcctgcccggctagaagc

SEQ ID NO: 10239 - DNA, 20 bp, human
ggctccacgatgccgggcgg

SEQ ID NO: 10240 - DNA, 20 bp, human
gggagacacaaagaagactg

SEQ ID NO: 10241 - DNA, 20 bp, human
gggatgtcaccgctgaccct

SEQ ID NO: 10242 - DNA, 20 bp, human
gaggcgactacaaaactccc

SEQ ID NO: 10243 - DNA, 20 bp, human
gcgacagccggcttctagcc

SEQ ID NO: 10244 - DNA, 20 bp, human
gagggtgagagatggcgacg

SEQ ID NO: 10245 - DNA, 20 bp, human
gggtccggccaaggacgctg

SEQ ID NO: 10246 - DNA, 20 bp, human
ggctggagaagagaagtaac

SEQ ID NO: 10247 - DNA, 20 bp, human
gagagaagtaaccggcacta

SEQ ID NO: 10248 - DNA, 20 bp, human
ggcttctaggctagtctaga

SEQ ID NO: 10249 - DNA, 20 bp, human
ggactgggtgctgaaaaaat

SEQ ID NO: 10250 - DNA, 20 bp, human
ggcaatgttgaagaataagc

SEQ ID NO: 10251 - DNA, 20 bp, human
gcattgcatcctcatcgtcc

SEQ ID NO: 10252 - DNA, 20 bp, human
ggactatgaagaatatagac

SEQ ID NO: 10253 - DNA, 20 bp, human
gctgtcatgtctcgagacag

SEQ ID NO: 10254 - DNA, 20 bp, human
gatcctcatcgtcctggctc

SEQ ID NO: 10255 - DNA, 20 bp, human
gcagaacaacatgctgggta

SEQ ID NO: 10256 - DNA, 20 bp, human
gtggcccggggaacgtctgg

SEQ ID NO: 10257 - DNA, 20 bp, human
gttccccgggccaataatca

SEQ ID NO: 10258 - DNA, 20 bp, human
gcgaccggaagcaaacttgt

SEQ ID NO: 10259 - DNA, 20 bp, human
gtgcgctggggacggctctg

SEQ ID NO: 10260 - DNA, 20 bp, human
gcagggccgagacgggagga

SEQ ID NO: 10261 - DNA, 20 bp, human
gaggagggcacccacctggt

SEQ ID NO: 10262 - DNA, 20 bp, human
gcgggtcccgcctaggaaat

SEQ ID NO: 10263 - DNA, 20 bp, human
ggcctgcgccccggacccag

SEQ ID NO: 10264 - DNA, 20 bp, human
gcttcaaagtaggcgccctg

SEQ ID NO: 10265 - DNA, 20 bp, human
ggggagcccagggccgagac

SEQ ID NO: 10266 - DNA, 20 bp, human
gcagggccgagacgggagga

SEQ ID NO: 10267 - DNA, 20 bp, human
ggggagcccagggccgagac

SEQ ID NO: 10268 - DNA, 20 bp, human
gagcccagggccgagacggg

SEQ ID NO: 10269 - DNA, 20 bp, human
gcatgtgacaccgaccaggt

SEQ ID NO: 10270 - DNA, 20 bp, human
gaggagggcacccacctggt

SEQ ID NO: 10271 - DNA, 20 bp, human
ggtggagcccggcggaggtg

SEQ ID NO: 10272 - DNA, 20 bp, human
gcgaccggaagcaaacttgt

SEQ ID NO: 10273 - DNA, 20 bp, human
gcggcggctgtggagcccgg

SEQ ID NO: 10274 - DNA, 20 bp, human
gcccggcctggttaaggaaa

SEQ ID NO: 10275 - DNA, 20 bp, human
gggaagaggagaggaactag

SEQ ID NO: 10276 - DNA, 20 bp, human
ggcccgccagcgccctcggt

SEQ ID NO: 10277 - DNA, 20 bp, human
gtgggcacagccacccggag

SEQ ID NO: 10278 - DNA, 20 bp, human
gcccacctgtaaaacgacta

SEQ ID NO: 10279 - DNA, 20 bp, human
ggtaggccatatggaccagg

SEQ ID NO: 10280 - DNA, 20 bp, human
ggagaccagccaccccctcg

SEQ ID NO: 10281 - DNA, 20 bp, human
gcctgtaaaacgactagggt

SEQ ID NO: 10282 - DNA, 20 bp, human
gcaggatgcgacgacctccc

SEQ ID NO: 10283 - DNA, 20 bp, human
gcaggccggctaacctccct

SEQ ID NO: 10284 - DNA, 20 bp, human
gagggtaggccatatggacc

SEQ ID NO: 10285 - DNA, 20 bp, human
gacgactagggtaggccata

SEQ ID NO: 10286 - DNA, 20 bp, human
gcagagacccggcgggtccg

SEQ ID NO: 10287 - DNA, 20 bp, human
ggacccgccgggtctctgga

SEQ ID NO: 10288 - DNA, 20 bp, human
gcgggtccgaggcgagtaac

SEQ ID NO: 10289 - DNA, 20 bp, human
gagccgccgccgaccggaag

SEQ ID NO: 10290 - DNA, 20 bp, human
ggctctcttccacttccggt

SEQ ID NO: 10291 - DNA, 20 bp, human
gagccttccagagacccggc

SEQ ID NO: 10292 - DNA, 20 bp, human
gtactcgcctcggacccgcc

SEQ ID NO: 10293 - DNA, 20 bp, human
gcggccagaagaaagatcaa

SEQ ID NO: 10294 - DNA, 20 bp, human
gtcccaatatcaaggccggg

SEQ ID NO: 10295 - DNA, 20 bp, human
gttccacttccggtcggcgg

SEQ ID NO: 10296 - DNA, 20 bp, human
gtgattgctaaggtgcctca

SEQ ID NO: 10297 - DNA, 20 bp, human
gaggtaaccctggagtgaag

SEQ ID NO: 10298 - DNA, 20 bp, human
ggagctctgggacttcgtag

SEQ ID NO: 10299 - DNA, 20 bp, human
gaggcaatggctgattgcta

SEQ ID NO: 10300 - DNA, 20 bp, human
gtgggacttcgtagaggtgg

SEQ ID NO: 10301 - DNA, 20 bp, human
gtgaagcggtttagttagaa

SEQ ID NO: 10302 - DNA, 20 bp, human
gagctttaaccctcaccctg

SEQ ID NO: 10303 - DNA, 20 bp, human
ggagctgggagtgcagtaac

SEQ ID NO: 10304 - DNA, 20 bp, human
gccactctggcaccttgagg

SEQ ID NO: 10305 - DNA, 20 bp, human
ggaaaacacacaaggcagag

SEQ ID NO: 10306 - DNA, 20 bp, human
gcaccgggcaccgcgaaccg

SEQ ID NO: 10307 - DNA, 20 bp, human
ggctcctgggagctcatcta

SEQ ID NO: 10308 - DNA, 20 bp, human
gtacggcgccagccagtgag

SEQ ID NO: 10309 - DNA, 20 bp, human
gagctcccaggagccaaaca

SEQ ID NO: 10310 - DNA, 20 bp, human
gggagctgctagagaccgag

SEQ ID NO: 10311 - DNA, 20 bp, human
gcacttccggctgcagtccg

SEQ ID NO: 10312 - DNA, 20 bp, human
ggcgccgtagatgagctccc

SEQ ID NO: 10313 - DNA, 20 bp, human
gggatccccaaaaagtactg

SEQ ID NO: 10314 - DNA, 20 bp, human
ggagctccatgccctggctg

SEQ ID NO: 10315 - DNA, 20 bp, human
gcggagcatgtagggagcct

SEQ ID NO: 10316 - DNA, 20 bp, human
gcctgtgcggcgggatctcg

SEQ ID NO: 10317 - DNA, 20 bp, human
gccaccggctcggccctgtg

SEQ ID NO: 10318 - DNA, 20 bp, human
gccgccgcacagggccgagc

SEQ ID NO: 10319 - DNA, 20 bp, human
ggccctggtagtgagcacat

SEQ ID NO: 10320 - DNA, 20 bp, human
gatctcggggccgcacggag

SEQ ID NO: 10321 - DNA, 20 bp, human
gtggtagtgagcacatgggg

SEQ ID NO: 10322 - DNA, 20 bp, human
gctaccagggcctggtccgg

SEQ ID NO: 10323 - DNA, 20 bp, human
gggctgcggggccctcgcca

SEQ ID NO: 10324 - DNA, 20 bp, human
gcccgggcgctgcgggccac

SEQ ID NO: 10325 - DNA, 20 bp, human
gtcgccgagcgggtgcctga

SEQ ID NO: 10326 - DNA, 20 bp, human
gagacccggcgagacacgag

SEQ ID NO: 10327 - DNA, 20 bp, human
gcgagacacgagcggcggga

SEQ ID NO: 10328 - DNA, 20 bp, human
ggctcggaccaggaggggga

SEQ ID NO: 10329 - DNA, 20 bp, human
gaaggagctcggaccaggag

SEQ ID NO: 10330 - DNA, 20 bp, human
gcgggtaaggagctcggacc

SEQ ID NO: 10331 - DNA, 20 bp, human
ggcacaggtcaggacagagg

SEQ ID NO: 10332 - DNA, 20 bp, human
gtacccgcgggagacccctg

SEQ ID NO: 10333 - DNA, 20 bp, human
ggctgtcccttagccagacc

SEQ ID NO: 10334 - DNA, 20 bp, human
gcccggcgagacacgagcgg

SEQ ID NO: 10335 - DNA, 20 bp, human
gccgcgtccgacgcttggtc

SEQ ID NO: 10336 - DNA, 20 bp, human
gcgaccggaagcaaacttgt

SEQ ID NO: 10337 - DNA, 20 bp, human
gtggcccggggaacgtctgg

SEQ ID NO: 10338 - DNA, 20 bp, human
gccctggccgcccgacggga

SEQ ID NO: 10339 - DNA, 20 bp, human
gcgggtcccgcctaggaaat

SEQ ID NO: 10340 - DNA, 20 bp, human
gttccccgggccaataatca

SEQ ID NO: 10341 - DNA, 20 bp, human
gcccgacgggagggagggat

SEQ ID NO: 10342 - DNA, 20 bp, human
gccgcccctggccgcccgac

SEQ ID NO: 10343 - DNA, 20 bp, human
gggaagaggagaggaactag

SEQ ID NO: 10344 - DNA, 20 bp, human
ggcctgcgccccggacccag

SEQ ID NO: 10345 - DNA, 20 bp, human
ggtggagcccggcggaggtg

SEQ ID NO: 10346 - DNA, 20 bp, human
ggtgacaccactggcaacaa

SEQ ID NO: 10347 - DNA, 20 bp, human
gtcttctggattcattactg

SEQ ID NO: 10348 - DNA, 20 bp, human
gagaagaacaaatcgtgaca

SEQ ID NO: 10349 - DNA, 20 bp, human
ggctgccccagagtgctgtt

SEQ ID NO: 10350 - DNA, 20 bp, human
gccttgtcccttgttgccag

SEQ ID NO: 10351 - DNA, 20 bp, human
ggcccccaaattgtagtata

SEQ ID NO: 10352 - DNA, 20 bp, human
gttaaagtaggagattccca

SEQ ID NO: 10353 - DNA, 20 bp, human
gaacatgtcctcggtacaca

SEQ ID NO: 10354 - DNA, 20 bp, human
gtggctctgtggaaaaggta

SEQ ID NO: 10355 - DNA, 20 bp, human
gacactccaaacagcactct

SEQ ID NO: 10356 - DNA, 20 bp, human
gctgagaaggcgcctgacag

SEQ ID NO: 10357 - DNA, 20 bp, human
gagagtgatgagccacgtaa

SEQ ID NO: 10358 - DNA, 20 bp, human
gccgctccgcgcacaaagga

SEQ ID NO: 10359 - DNA, 20 bp, human
gacgtggctcatcactctgg

SEQ ID NO: 10360 - DNA, 20 bp, human
gtcccgagccgctcctgaga

SEQ ID NO: 10361 - DNA, 20 bp, human
ggcaccgcagcgaggagacg

SEQ ID NO: 10362 - DNA, 20 bp, human
gccgcccgcgccccccggtc

SEQ ID NO: 10363 - DNA, 20 bp, human
ggccgccgctccgcgcacaa

SEQ ID NO: 10364 - DNA, 20 bp, human
ggccggccccccacgcggag

SEQ ID NO: 10365 - DNA, 20 bp, human
ggccggggcgcacggagaag

SEQ ID NO: 10366 - DNA, 20 bp, human
gcagggatcgaacgagtgtc

SEQ ID NO: 10367 - DNA, 20 bp, human
gggatagggccagcaaggca

SEQ ID NO: 10368 - DNA, 20 bp, human
gccaccatgctagaaaggag

SEQ ID NO: 10369 - DNA, 20 bp, human
gaagtagggtggttagagaa

SEQ ID NO: 10370 - DNA, 20 bp, human
ggcgccggagaaccactcac

SEQ ID NO: 10371 - DNA, 20 bp, human
gccctcccccgactaaactc

SEQ ID NO: 10372 - DNA, 20 bp, human
gctctcgggcgccacgggaa

SEQ ID NO: 10373 - DNA, 20 bp, human
ggaagagagcgagcaagctt

SEQ ID NO: 10374 - DNA, 20 bp, human
ggaacgagtgtctggcagcc

SEQ ID NO: 10375 - DNA, 20 bp, human
gggaaaacgagcgaagtaaa

SEQ ID NO: 10376 - DNA, 20 bp, human
gcccttgcctgggaatgagg

SEQ ID NO: 10377 - DNA, 20 bp, human
gtttctccggcagcagaaag

SEQ ID NO: 10378 - DNA, 20 bp, human
gttctgctgccggagaaagg

SEQ ID NO: 10379 - DNA, 20 bp, human
gaaagcggagagtcacagcg

SEQ ID NO: 10380 - DNA, 20 bp, human
gctctccgcggacgagacag

SEQ ID NO: 10381 - DNA, 20 bp, human
ggacgagacagcggggatca

SEQ ID NO: 10382 - DNA, 20 bp, human
gtccccccaagcccttgcct

SEQ ID NO: 10383 - DNA, 20 bp, human
gctttcttcagctccgaggg

SEQ ID NO: 10384 - DNA, 20 bp, human
gtcttcagctccgagggcgg

SEQ ID NO: 10385 - DNA, 20 bp, human
gagcgagcgcagcgcagcag

SEQ ID NO: 10386 - DNA, 20 bp, human
gccgaggcggctctcaagga

SEQ ID NO: 10387 - DNA, 20 bp, human
gcgcgcggccatgatcgccg

SEQ ID NO: 10388 - DNA, 20 bp, human
ggcacccacagcgccaagag

SEQ ID NO: 10389 - DNA, 20 bp, human
gcgccacgccgcggcgatca

SEQ ID NO: 10390 - DNA, 20 bp, human
gcaccgggacccatgctggg

SEQ ID NO: 10391 - DNA, 20 bp, human
gaagagcggcggctccgagg

SEQ ID NO: 10392 - DNA, 20 bp, human
gcgtctccatggccgagccc

SEQ ID NO: 10393 - DNA, 20 bp, human
ggggagcagccccgtctcca

SEQ ID NO: 10394 - DNA, 20 bp, human
gcccacagcgccaagagcgg

SEQ ID NO: 10395 - DNA, 20 bp, human
ggcatcctcttcctcctcgt

SEQ ID NO: 10396 - DNA, 20 bp, human
ggcacccccggaccgaccat

SEQ ID NO: 10397 - DNA, 20 bp, human
gctgggcggccgcgcaacaa

SEQ ID NO: 10398 - DNA, 20 bp, human
gagcaggcggccgcgggcat

SEQ ID NO: 10399 - DNA, 20 bp, human
ggaggtgagcagctgattga

SEQ ID NO: 10400 - DNA, 20 bp, human
gccatgatgcggagctacgg

SEQ ID NO: 10401 - DNA, 20 bp, human
gcagaaccagcacccgtcgg

SEQ ID NO: 10402 - DNA, 20 bp, human
gcggccgcgggcatgggctt

SEQ ID NO: 10403 - DNA, 20 bp, human
gggccagaaccagcacccgt

SEQ ID NO: 10404 - DNA, 20 bp, human
gccgccgccctgctgccggg

SEQ ID NO: 10405 - DNA, 20 bp, human
gagcagctgattgagggtcg

SEQ ID NO: 10406 - DNA, 20 bp, human
gaaccgggggggcagcgccg

SEQ ID NO: 10407 - DNA, 20 bp, human
gctcagtcatgggccggcgg

SEQ ID NO: 10408 - DNA, 20 bp, human
gccgccgccggccgaggaat

SEQ ID NO: 10409 - DNA, 20 bp, human
ggagcccggagcccattcct

SEQ ID NO: 10410 - DNA, 20 bp, human
gatgggctccgggctctggt

SEQ ID NO: 10411 - DNA, 20 bp, human
gcggcggcggggctcagtca

SEQ ID NO: 10412 - DNA, 20 bp, human
gaggaagcgctgggagcggg

SEQ ID NO: 10413 - DNA, 20 bp, human
gagggtgagagcagaaccgg

SEQ ID NO: 10414 - DNA, 20 bp, human
gccggagcccattcctcggc

SEQ ID NO: 10415 - DNA, 20 bp, human
ggcggattcgcgaaggtgag

SEQ ID NO: 10416 - DNA, 20 bp, human
ggctcccggcccccgaccca

SEQ ID NO: 10417 - DNA, 20 bp, human
gggggcgcctcttaccaatc

SEQ ID NO: 10418 - DNA, 20 bp, human
gggctggcggctcggtgagt

SEQ ID NO: 10419 - DNA, 20 bp, human
gggcgagcaggggcgatcgg

SEQ ID NO: 10420 - DNA, 20 bp, human
ggcgcctcttaccaatcggg

SEQ ID NO: 10421 - DNA, 20 bp, human
gaggggtgtagacgcggacg

SEQ ID NO: 10422 - DNA, 20 bp, human
gtcttaccaatcgggcggag

SEQ ID NO: 10423 - DNA, 20 bp, human
gcactggatcaatcgctcag

SEQ ID NO: 10424 - DNA, 20 bp, human
ggtcctggaagccaaagaag

SEQ ID NO: 10425 - DNA, 20 bp, human
gtggagacttcactccccac

SEQ ID NO: 10426 - DNA, 20 bp, human
gcaggggtgaccgggaaggt

SEQ ID NO: 10427 - DNA, 20 bp, human
ggtgggcgcgcagataggtg

SEQ ID NO: 10428 - DNA, 20 bp, human
ggcccggggccaaaagaatc

SEQ ID NO: 10429 - DNA, 20 bp, human
gaatgatagggctgaatggg

SEQ ID NO: 10430 - DNA, 20 bp, human
gcccgggccacttacctgtg

SEQ ID NO: 10431 - DNA, 20 bp, human
ggggccatcggaagagccag

SEQ ID NO: 10432 - DNA, 20 bp, human
gaatccggcagcaaaagcag

SEQ ID NO: 10433 - DNA, 20 bp, human
gtgggctgtggggcttacag

SEQ ID NO: 10434 - DNA, 20 bp, human
gtggtagaggtaaaaatgat

SEQ ID NO: 10435 - DNA, 20 bp, human
gaatggggggaggcgtgcag

SEQ ID NO: 10436 - DNA, 20 bp, human
ggagggaccaagatggagag

SEQ ID NO: 10437 - DNA, 20 bp, human
gaatattgggtagagagaca

SEQ ID NO: 10438 - DNA, 20 bp, human
gcagagccccccaacacagg

SEQ ID NO: 10439 - DNA, 20 bp, human
gtggagagagatagaatatt

SEQ ID NO: 10440 - DNA, 20 bp, human
gattgggtagagagacaggg

SEQ ID NO: 10441 - DNA, 20 bp, human
gagaggtatcaggcagagac

SEQ ID NO: 10442 - DNA, 20 bp, human
gggaggtggtcatggattca

SEQ ID NO: 10443 - DNA, 20 bp, human
ggcaggggtcacaaggaaag

SEQ ID NO: 10444 - DNA, 20 bp, human
ggggggctctgggggcagta

SEQ ID NO: 10445 - DNA, 20 bp, human
gtcgggaaatggtgaaggaa

SEQ ID NO: 10446 - DNA, 20 bp, human
gggattgtggcagtaaatcg

SEQ ID NO: 10447 - DNA, 20 bp, human
gcctccgtgggcccccgtcc

SEQ ID NO: 10448 - DNA, 20 bp, human
gcccgaggaagcggacgagg

SEQ ID NO: 10449 - DNA, 20 bp, human
ggcagcaccactcccagccg

SEQ ID NO: 10450 - DNA, 20 bp, human
gccaactgcaccgggacctc

SEQ ID NO: 10451 - DNA, 20 bp, human
gggatactgaatggacgaag

SEQ ID NO: 10452 - DNA, 20 bp, human
gcagtaaatcggggcgagtg

SEQ ID NO: 10453 - DNA, 20 bp, human
gtcccgggaaaatggctgtg

SEQ ID NO: 10454 - DNA, 20 bp, human
gggggccagccattgaccag

SEQ ID NO: 10455 - DNA, 20 bp, human
ggtccgtggcaggactcgag

SEQ ID NO: 10456 - DNA, 20 bp, human
ggtcagtcgagtccggagtg

SEQ ID NO: 10457 - DNA, 20 bp, human
gaggagctcggtcgccgaag

SEQ ID NO: 10458 - DNA, 20 bp, human
gccgagcggccgccaaacaa

SEQ ID NO: 10459 - DNA, 20 bp, human
ggctcggtcgccgaagcgga

SEQ ID NO: 10460 - DNA, 20 bp, human
gcggaggcgagatctgaccc

SEQ ID NO: 10461 - DNA, 20 bp, human
ggcgaccgagctcctcactc

SEQ ID NO: 10462 - DNA, 20 bp, human
gcagatctcgcctccgagga

SEQ ID NO: 10463 - DNA, 20 bp, human
gtctcgcctccgaggaaggt

SEQ ID NO: 10464 - DNA, 20 bp, human
gcaagagtctccctccgctt

SEQ ID NO: 10465 - DNA, 20 bp, human
gtccctccgggcaaaggtcc

SEQ ID NO: 10466 - DNA, 20 bp, human
gccgcgcgctgagggtctcg

SEQ ID NO: 10467 - DNA, 20 bp, human
gatggcccggagaggtcccg

SEQ ID NO: 10468 - DNA, 20 bp, human
gaaatatgccgagcccggta

SEQ ID NO: 10469 - DNA, 20 bp, human
gtggaaaccgcagcaggaag

SEQ ID NO: 10470 - DNA, 20 bp, human
ggcttacccatggcccggag

SEQ ID NO: 10471 - DNA, 20 bp, human
ggggacgacagagccgtacc

SEQ ID NO: 10472 - DNA, 20 bp, human
gcgcgctgagggtctcgggg

SEQ ID NO: 10473 - DNA, 20 bp, human
gccgcagagccgcttaccca

SEQ ID NO: 10474 - DNA, 20 bp, human
ggacagagccgtaccgggct

SEQ ID NO: 10475 - DNA, 20 bp, human
ggagccgcttacccatggcc

SEQ ID NO: 10476 - DNA, 20 bp, human
ggcgggaagaggatggatca

SEQ ID NO: 10477 - DNA, 20 bp, human
ggatctcggcgggaagagga

SEQ ID NO: 10478 - DNA, 20 bp, human
gagaaagaggagcagcgccc

SEQ ID NO: 10479 - DNA, 20 bp, human
gtgagctcttgcctcccttc

SEQ ID NO: 10480 - DNA, 20 bp, human
ggaaaggcgccatacgatct

SEQ ID NO: 10481 - DNA, 20 bp, human
gcatttcggtgcccgaaggg

SEQ ID NO: 10482 - DNA, 20 bp, human
gaatggattgcatcaggtcc

SEQ ID NO: 10483 - DNA, 20 bp, human
gaggcgccatacgatctcgg

SEQ ID NO: 10484 - DNA, 20 bp, human
ggagacattacgccggctga

SEQ ID NO: 10485 - DNA, 20 bp, human
gatggagcccaactcactcc

SEQ ID NO: 10486 - DNA, 20 bp, human
gtttctctcggaggccggag

SEQ ID NO: 10487 - DNA, 20 bp, human
gagccgcgtctgactgaggc

SEQ ID NO: 10488 - DNA, 20 bp, human
ggcggagccgcgtctgactg

SEQ ID NO: 10489 - DNA, 20 bp, human
ggtcagacgcggctccgctc

SEQ ID NO: 10490 - DNA, 20 bp, human
gtgcccgcctcagtcagacg

SEQ ID NO: 10491 - DNA, 20 bp, human
gatagcagcggccgtggagg

SEQ ID NO: 10492 - DNA, 20 bp, human
gggctcagtagcgatagcag

SEQ ID NO: 10493 - DNA, 20 bp, human
gacgatgataccctggatct

SEQ ID NO: 10494 - DNA, 20 bp, human
gggagccggagcgagagccg

SEQ ID NO: 10495 - DNA, 20 bp, human
gcgctactgagccaacaaag

SEQ ID NO: 10496 - DNA, 20 bp, human
ggctgtggggacgactcttc

SEQ ID NO: 10497 - DNA, 20 bp, human
ggggccagagggaccggatt

SEQ ID NO: 10498 - DNA, 20 bp, human
ggaagcagcgcgggcttgac

SEQ ID NO: 10499 - DNA, 20 bp, human
gggaccggattggggcgaag

SEQ ID NO: 10500 - DNA, 20 bp, human
gcagctctcggaaaggtcag

SEQ ID NO: 10501 - DNA, 20 bp, human
gactcgagtggtgagccccg

SEQ ID NO: 10502 - DNA, 20 bp, human
gccgcgccagacagggagag

SEQ ID NO: 10503 - DNA, 20 bp, human
gcgcggagaggcccccccag

SEQ ID NO: 10504 - DNA, 20 bp, human
ggattggggcgaagcggcag

SEQ ID NO: 10505 - DNA, 20 bp, human
ggtggggacgactcttctgg

SEQ ID NO: 10506 - DNA, 20 bp, human
gcggggccgcacatccctag

SEQ ID NO: 10507 - DNA, 20 bp, human
gccagagtctgaccagggta

SEQ ID NO: 10508 - DNA, 20 bp, human
gagctggggataccctccac

SEQ ID NO: 10509 - DNA, 20 bp, human
ggcctcgccagaagctggtt

SEQ ID NO: 10510 - DNA, 20 bp, human
gcctccgaagaaaaacgact

SEQ ID NO: 10511 - DNA, 20 bp, human
gaggcggcggcacagctccg

SEQ ID NO: 10512 - DNA, 20 bp, human
gaaggcggcgggaggaaaaa

SEQ ID NO: 10513 - DNA, 20 bp, human
gggagcccgcggcgccccta

SEQ ID NO: 10514 - DNA, 20 bp, human
gcagctctcggaaaggtcag

SEQ ID NO: 10515 - DNA, 20 bp, human
gcgcggagaggcccccccag

SEQ ID NO: 10516 - DNA, 20 bp, human
ggcctcggagctgcagccga

SEQ ID NO: 10517 - DNA, 20 bp, human
ggcttgcgaggaaaccgcct

SEQ ID NO: 10518 - DNA, 20 bp, human
ggagctgcagccgaaggcca

SEQ ID NO: 10519 - DNA, 20 bp, human
gcacgtcggactccaggcgg

SEQ ID NO: 10520 - DNA, 20 bp, human
gggaccccgcaggaatcaag

SEQ ID NO: 10521 - DNA, 20 bp, human
gcaagtggagctggggatga

SEQ ID NO: 10522 - DNA, 20 bp, human
gggacgtccccaagctgtcc

SEQ ID NO: 10523 - DNA, 20 bp, human
ggggtaaagaactcgaaccc

SEQ ID NO: 10524 - DNA, 20 bp, human
gggggacgtccgcagagcct

SEQ ID NO: 10525 - DNA, 20 bp, human
ggatcggcgagggaggacag

SEQ ID NO: 10526 - DNA, 20 bp, human
gcgggaaccgaggaacgggt

SEQ ID NO: 10527 - DNA, 20 bp, human
gacgcaggtgcgggttgcac

SEQ ID NO: 10528 - DNA, 20 bp, human
gccatcttcggcgggcgagt

SEQ ID NO: 10529 - DNA, 20 bp, human
ggtcgcagcggggccatctt

SEQ ID NO: 10530 - DNA, 20 bp, human
gcgggcgagggacgcaggtg

SEQ ID NO: 10531 - DNA, 20 bp, human
gccagcaccaaggggcccag

SEQ ID NO: 10532 - DNA, 20 bp, human
ggcggccgcagcagtcgcag

SEQ ID NO: 10533 - DNA, 20 bp, human
ggagcccgggaaccgaggaa

SEQ ID NO: 10534 - DNA, 20 bp, human
gggtcagagcccgggaaccg

SEQ ID NO: 10535 - DNA, 20 bp, human
ggcagcggggccatcttcgg

SEQ ID NO: 10536 - DNA, 20 bp, human
ggcgtggctctcctccccta

SEQ ID NO: 10537 - DNA, 20 bp, human
ggaaagcagctccatagggg

SEQ ID NO: 10538 - DNA, 20 bp, human
ggaggcttacctccttccag

SEQ ID NO: 10539 - DNA, 20 bp, human
gacccaagagcgagatggga

SEQ ID NO: 10540 - DNA, 20 bp, human
gcatgacccaagagcgagat

SEQ ID NO: 10541 - DNA, 20 bp, human
ggcagctgtgagatcctgcg

SEQ ID NO: 10542 - DNA, 20 bp, human
gtgggagtagggatgagtag

SEQ ID NO: 10543 - DNA, 20 bp, human
gcgcaggcatcgtctaagtt

SEQ ID NO: 10544 - DNA, 20 bp, human
gctcgctcttgggtcatgcc

SEQ ID NO: 10545 - DNA, 20 bp, human
gcagtctaatagtaacacag

SEQ ID NO: 10546 - DNA, 20 bp, human
gcatgtgcaaaactggagta

SEQ ID NO: 10547 - DNA, 20 bp, human
gttaggaaacagacatgaag

SEQ ID NO: 10548 - DNA, 20 bp, human
gcatcagagcctaattgtct

SEQ ID NO: 10549 - DNA, 20 bp, human
gtcaaggaacccagacaatt

SEQ ID NO: 10550 - DNA, 20 bp, human
gataagatatgcagagtaat

SEQ ID NO: 10551 - DNA, 20 bp, human
ggaaggctctgccaattatt

SEQ ID NO: 10552 - DNA, 20 bp, human
gctgtgttaatctgacaaga

SEQ ID NO: 10553 - DNA, 20 bp, human
gtaggtatgaaaacccaact

SEQ ID NO: 10554 - DNA, 20 bp, human
gagcctgacatcaagttaga

SEQ ID NO: 10555 - DNA, 20 bp, human
gacagacatgaagcggttac

SEQ ID NO: 10556 - DNA, 20 bp, human
gggtcccgctaactcggcta

SEQ ID NO: 10557 - DNA, 20 bp, human
gggttgttccttggctaaga

SEQ ID NO: 10558 - DNA, 20 bp, human
gtccaggcgcggggaaaagg

SEQ ID NO: 10559 - DNA, 20 bp, human
gacgactgccctcttagcca

SEQ ID NO: 10560 - DNA, 20 bp, human
gctccctcccgggacaccct

SEQ ID NO: 10561 - DNA, 20 bp, human
ggctaagagggcagtcgtcg

SEQ ID NO: 10562 - DNA, 20 bp, human
gtagccgggtcccgctaact

SEQ ID NO: 10563 - DNA, 20 bp, human
ggcctgggatagactcgtcc

SEQ ID NO: 10564 - DNA, 20 bp, human
gagtctatcccaggccgcaa

SEQ ID NO: 10565 - DNA, 20 bp, human
ggcctggacgagtctatccc

SEQ ID NO: 10566 - DNA, 20 bp, human
ggatctcacatgaaaatgtt

SEQ ID NO: 10567 - DNA, 20 bp, human
gttactgtgagaacaccgat

SEQ ID NO: 10568 - DNA, 20 bp, human
gctacaacataaacacatct

SEQ ID NO: 10569 - DNA, 20 bp, human
gacaacatacaccagcccat

SEQ ID NO: 10570 - DNA, 20 bp, human
gtgtgagaacaccgatgggc

SEQ ID NO: 10571 - DNA, 20 bp, human
gcactcacagtctgggatgt

SEQ ID NO: 10572 - DNA, 20 bp, human
gaatgtggaaatgatcgagt

SEQ ID NO: 10573 - DNA, 20 bp, human
gaggctgaaatgggttcgct

SEQ ID NO: 10574 - DNA, 20 bp, human
gtttcatgtgagatccagaa

SEQ ID NO: 10575 - DNA, 20 bp, human
gagcttatcaacttgattat

SEQ ID NO: 10576 - DNA, 20 bp, human
gacacgaggctggccgcctc

SEQ ID NO: 10577 - DNA, 20 bp, human
gcggtcgagtgtggcctgtg

SEQ ID NO: 10578 - DNA, 20 bp, human
ggcgcttgccgtcctctcag

SEQ ID NO: 10579 - DNA, 20 bp, human
ggcaagatgcgagtccacac

SEQ ID NO: 10580 - DNA, 20 bp, human
gggaagcggtcggtcgagtg

SEQ ID NO: 10581 - DNA, 20 bp, human
gtcgcagatgaactacgcgg

SEQ ID NO: 10582 - DNA, 20 bp, human
gcatcttgcccgaagccggg

SEQ ID NO: 10583 - DNA, 20 bp, human
gcaggcgacgaccctcagag

SEQ ID NO: 10584 - DNA, 20 bp, human
gtccccgcgctaccactgag

SEQ ID NO: 10585 - DNA, 20 bp, human
gcgcgctaccactgagagga

SEQ ID NO: 10586 - DNA, 20 bp, human
ggcccaggcaggacctcaca

SEQ ID NO: 10587 - DNA, 20 bp, human
gtggacagaaacaactggta

SEQ ID NO: 10588 - DNA, 20 bp, human
gatctcagagatcctcgagg

SEQ ID NO: 10589 - DNA, 20 bp, human
ggggaaagctctatcagcct

SEQ ID NO: 10590 - DNA, 20 bp, human
ggcagcccgcagtgagcagt

SEQ ID NO: 10591 - DNA, 20 bp, human
gctgagatgcccatggatgt

SEQ ID NO: 10592 - DNA, 20 bp, human
gggcatctcagagatcctcg

SEQ ID NO: 10593 - DNA, 20 bp, human
gcaaattggacagaaacaac

SEQ ID NO: 10594 - DNA, 20 bp, human
gtcctccccactgctcactg

SEQ ID NO: 10595 - DNA, 20 bp, human
gctgagaagaactgtcaaat

SEQ ID NO: 10596 - DNA, 20 bp, human
gccgatggccccctgccttg

SEQ ID NO: 10597 - DNA, 20 bp, human
gggggtggcatgtcgcctct

SEQ ID NO: 10598 - DNA, 20 bp, human
ggcgggagaaagaaccccag

SEQ ID NO: 10599 - DNA, 20 bp, human
gccggaaagaaagtcctctg

SEQ ID NO: 10600 - DNA, 20 bp, human
gaagccaggaagccgatcgc

SEQ ID NO: 10601 - DNA, 20 bp, human
gtggggctgcttgagagatg

SEQ ID NO: 10602 - DNA, 20 bp, human
gtccggaacggctccgaacc

SEQ ID NO: 10603 - DNA, 20 bp, human
gtattcggagatcagacatc

SEQ ID NO: 10604 - DNA, 20 bp, human
ggcaaaaaggctgctcctca

SEQ ID NO: 10605 - DNA, 20 bp, human
ggggcacgccgagatccgag

SEQ ID NO: 10606 - DNA, 20 bp, human
ggaagacgctgctggtgaaa

SEQ ID NO: 10607 - DNA, 20 bp, human
ggagaggaagtgcccgtgga

SEQ ID NO: 10608 - DNA, 20 bp, human
gtaattggcgcgggatgagg

SEQ ID NO: 10609 - DNA, 20 bp, human
gtgccgggtggagcgaagca

SEQ ID NO: 10610 - DNA, 20 bp, human
gggaatgtgtctcctgctgg

SEQ ID NO: 10611 - DNA, 20 bp, human
gccctcgcaacggcttcctg

SEQ ID NO: 10612 - DNA, 20 bp, human
gggcccgagctgaggataat

SEQ ID NO: 10613 - DNA, 20 bp, human
gctaccgtgggccgtgtcgg

SEQ ID NO: 10614 - DNA, 20 bp, human
gagcgagtccagctactgat

SEQ ID NO: 10615 - DNA, 20 bp, human
gcccgcaactccacccgcgg

SEQ ID NO: 10616 - DNA, 20 bp, human
gtaggtagcggtaccttgag

SEQ ID NO: 10617 - DNA, 20 bp, human
gtcggcggtgttgtaggtag

SEQ ID NO: 10618 - DNA, 20 bp, human
ggtgcattagggagaaacgt

SEQ ID NO: 10619 - DNA, 20 bp, human
gcggagcagcgaggaaccga

SEQ ID NO: 10620 - DNA, 20 bp, human
ggcggagtcggcggtgttgt

SEQ ID NO: 10621 - DNA, 20 bp, human
gtaaaccacgacaggcgtgg

SEQ ID NO: 10622 - DNA, 20 bp, human
ggctgctccggccctagaga

SEQ ID NO: 10623 - DNA, 20 bp, human
gctgcgggccagaaactgga

SEQ ID NO: 10624 - DNA, 20 bp, human
gaacgtcggcacgacgtcaa

SEQ ID NO: 10625 - DNA, 20 bp, human
ggtggcaacaggtgagtctc

SEQ ID NO: 10626 - DNA, 20 bp, human
gtaggtagcggtaccttgag

SEQ ID NO: 10627 - DNA, 20 bp, human
gtcggcggtgttgtaggtag

SEQ ID NO: 10628 - DNA, 20 bp, human
ggtgcattagggagaaacgt

SEQ ID NO: 10629 - DNA, 20 bp, human
gcggagcagcgaggaaccga

SEQ ID NO: 10630 - DNA, 20 bp, human
gtaaaccacgacaggcgtgg

SEQ ID NO: 10631 - DNA, 20 bp, human
ggcggagtcggcggtgttgt

SEQ ID NO: 10632 - DNA, 20 bp, human
ggctgctccggccctagaga

SEQ ID NO: 10633 - DNA, 20 bp, human
gctgcgggccagaaactgga

SEQ ID NO: 10634 - DNA, 20 bp, human
gaacgtcggcacgacgtcaa

SEQ ID NO: 10635 - DNA, 20 bp, human
ggtggcaacaggtgagtctc

SEQ ID NO: 10636 - DNA, 20 bp, human
ggcccgcgtggtgacgccag

SEQ ID NO: 10637 - DNA, 20 bp, human
gcggaaccgcgagggtggcg

SEQ ID NO: 10638 - DNA, 20 bp, human
gtaggcggcccgagtgtcag

SEQ ID NO: 10639 - DNA, 20 bp, human
ggaggagatcagagccggga

SEQ ID NO: 10640 - DNA, 20 bp, human
ggcggcccgagtgtcagggg

SEQ ID NO: 10641 - DNA, 20 bp, human
ggtgatagccaacaggaacc

SEQ ID NO: 10642 - DNA, 20 bp, human
gtaactcggacgccaccacc

SEQ ID NO: 10643 - DNA, 20 bp, human
ggtgggtcccggagataact

SEQ ID NO: 10644 - DNA, 20 bp, human
ggagccgcaccccaggactg

SEQ ID NO: 10645 - DNA, 20 bp, human
ggccggggcctggaaccctc

SEQ ID NO: 10646 - DNA, 20 bp, human
gcgcaggcgctgacccgacc

SEQ ID NO: 10647 - DNA, 20 bp, human
gtggcggcagagggtatcca

SEQ ID NO: 10648 - DNA, 20 bp, human
gtgatggaggcgctgatcaa

SEQ ID NO: 10649 - DNA, 20 bp, human
gcccgcaggacaggagtgcg

SEQ ID NO: 10650 - DNA, 20 bp, human
gtcgggcgctcaacccctcc

SEQ ID NO: 10651 - DNA, 20 bp, human
gtggcggctggggattgtga

SEQ ID NO: 10652 - DNA, 20 bp, human
gaggccttaaccccgccggg

SEQ ID NO: 10653 - DNA, 20 bp, human
gtttgctgacagctgagggt

SEQ ID NO: 10654 - DNA, 20 bp, human
gaggccggaccgacgcgtgg

SEQ ID NO: 10655 - DNA, 20 bp, human
gcatcgcagtcgccccgagt

SEQ ID NO: 10656 - DNA, 20 bp, human
gtgcgtgcgagggacgtcgg

SEQ ID NO: 10657 - DNA, 20 bp, human
gctgcctcccccgttaccag

SEQ ID NO: 10658 - DNA, 20 bp, human
gcagttgcccctggtaacgg

SEQ ID NO: 10659 - DNA, 20 bp, human
gttaccaggggcaactgctg

SEQ ID NO: 10660 - DNA, 20 bp, human
gtaaccggccggctccaagg

SEQ ID NO: 10661 - DNA, 20 bp, human
gctgtgcgtgcgagggacgt

SEQ ID NO: 10662 - DNA, 20 bp, human
gtagcaggcttagacttccc

SEQ ID NO: 10663 - DNA, 20 bp, human
gctgcgcttaaagccaagga

SEQ ID NO: 10664 - DNA, 20 bp, human
gtaacgggggaggcagcagg

SEQ ID NO: 10665 - DNA, 20 bp, human
ggggctccatcattactctg

SEQ ID NO: 10666 - DNA, 20 bp, human
gtgccgggcgagcaccgtta

SEQ ID NO: 10667 - DNA, 20 bp, human
gggtcgtgtgcggagggaca

SEQ ID NO: 10668 - DNA, 20 bp, human
gggccacttagaccagatac

SEQ ID NO: 10669 - DNA, 20 bp, human
gacccagactccagatcggg

SEQ ID NO: 10670 - DNA, 20 bp, human
ggcgcgccaggctgccctaa

SEQ ID NO: 10671 - DNA, 20 bp, human
gggcaacagccggcaccctc

SEQ ID NO: 10672 - DNA, 20 bp, human
gaggcgctagagatcccacc

SEQ ID NO: 10673 - DNA, 20 bp, human
gggacaaagggttaacgcgt

SEQ ID NO: 10674 - DNA, 20 bp, human
gcagccagggcgtcaagcca

SEQ ID NO: 10675 - DNA, 20 bp, human
gatcccacttcggggaggat

SEQ ID NO: 10676 - DNA, 20 bp, human
gggactgtgaggctgccgag

SEQ ID NO: 10677 - DNA, 20 bp, human
gggagggcgccgaacatctg

SEQ ID NO: 10678 - DNA, 20 bp, human
gagcagtcacgggcccgacg

SEQ ID NO: 10679 - DNA, 20 bp, human
gggctgtaggacttccacag

SEQ ID NO: 10680 - DNA, 20 bp, human
ggggcgccgaacatctgagg

SEQ ID NO: 10681 - DNA, 20 bp, human
ggctgcggcgccagccactg

SEQ ID NO: 10682 - DNA, 20 bp, human
gcgagcggacagcgactccc

SEQ ID NO: 10683 - DNA, 20 bp, human
ggggcccgtgactgctcggg

SEQ ID NO: 10684 - DNA, 20 bp, human
gcactgcggctgcggcggga

SEQ ID NO: 10685 - DNA, 20 bp, human
ggactcggccggcaagacca

SEQ ID NO: 10686 - DNA, 20 bp, human
gccatcggaggagggcgggc

SEQ ID NO: 10687 - DNA, 20 bp, human
gaggcgcggtgggtgtctgc

SEQ ID NO: 10688 - DNA, 20 bp, human
gagggtcgcggagtaaggaa

SEQ ID NO: 10689 - DNA, 20 bp, human
gccccaggcaagatccccga

SEQ ID NO: 10690 - DNA, 20 bp, human
gggagagcgcggctcacgag

SEQ ID NO: 10691 - DNA, 20 bp, human
gcagcggttggaggcgcggt

SEQ ID NO: 10692 - DNA, 20 bp, human
gggtcctgggccactcaagt

SEQ ID NO: 10693 - DNA, 20 bp, human
ggctctgcagaggcagcggt

SEQ ID NO: 10694 - DNA, 20 bp, human
gagagagactcccaggtcct

SEQ ID NO: 10695 - DNA, 20 bp, human
gcaagatccccgagggacgg

SEQ ID NO: 10696 - DNA, 20 bp, human
gctcgtcgcagacaacgcgg

SEQ ID NO: 10697 - DNA, 20 bp, human
ggaatgtgggcggctcggtc

SEQ ID NO: 10698 - DNA, 20 bp, human
ggctcgggccggctaggtgg

SEQ ID NO: 10699 - DNA, 20 bp, human
ggtgcaggctgcgcggatac

SEQ ID NO: 10700 - DNA, 20 bp, human
gggaaggtctcctaagacaa

SEQ ID NO: 10701 - DNA, 20 bp, human
gagccgggaccgaaccgtcc

SEQ ID NO: 10702 - DNA, 20 bp, human
ggaatacttcggaatgtggg

SEQ ID NO: 10703 - DNA, 20 bp, human
gcgcggatacgggcccggga

SEQ ID NO: 10704 - DNA, 20 bp, human
gaggaaccatccccaagctc

SEQ ID NO: 10705 - DNA, 20 bp, human
gggagagggtcagctcgggc

SEQ ID NO: 10706 - DNA, 20 bp, human
gtacagaccgaggggactac

SEQ ID NO: 10707 - DNA, 20 bp, human
ggaccgaggggactacgggt

SEQ ID NO: 10708 - DNA, 20 bp, human
gggtcggcgttgggctcagt

SEQ ID NO: 10709 - DNA, 20 bp, human
gtaggtgggtacagaccgag

SEQ ID NO: 10710 - DNA, 20 bp, human
gtcagtgggctcgaaacaaa

SEQ ID NO: 10711 - DNA, 20 bp, human
gctgacgtgtgggagaaata

SEQ ID NO: 10712 - DNA, 20 bp, human
ggaggctgtggtaggtaggt

SEQ ID NO: 10713 - DNA, 20 bp, human
gctcgaaacaaagggctgtc

SEQ ID NO: 10714 - DNA, 20 bp, human
gttagacctggaggacgtac

SEQ ID NO: 10715 - DNA, 20 bp, human
gcaggagagacctgacgtgt

SEQ ID NO: 10716 - DNA, 20 bp, human
gccctagacatggcactcag

SEQ ID NO: 10717 - DNA, 20 bp, human
gctccactaccgcaaatcag

SEQ ID NO: 10718 - DNA, 20 bp, human
gagacatggcactcagagga

SEQ ID NO: 10719 - DNA, 20 bp, human
ggcgtccgaccacagatcag

SEQ ID NO: 10720 - DNA, 20 bp, human
gtgggacgctggcccttcgt

SEQ ID NO: 10721 - DNA, 20 bp, human
gtgagcatcttcgggaacca

SEQ ID NO: 10722 - DNA, 20 bp, human
gccggcccgggaagtgccat

SEQ ID NO: 10723 - DNA, 20 bp, human
gcagtctagtgccctagaca

SEQ ID NO: 10724 - DNA, 20 bp, human
gctgggactcctctgatctg

SEQ ID NO: 10725 - DNA, 20 bp, human
gatctgccagaccctcccgg

SEQ ID NO: 10726 - DNA, 20 bp, human
gagctccgggaaaaggtcag

SEQ ID NO: 10727 - DNA, 20 bp, human
gccggctcctcgcaggaaat

SEQ ID NO: 10728 - DNA, 20 bp, human
gcgcgtggagtgaaaaacat

SEQ ID NO: 10729 - DNA, 20 bp, human
gcaaagccgtctctagaagt

SEQ ID NO: 10730 - DNA, 20 bp, human
ggttcccggcgtagcatcat

SEQ ID NO: 10731 - DNA, 20 bp, human
gggaggcgtggcttcaggac

SEQ ID NO: 10732 - DNA, 20 bp, human
gtaaaactgacggggacaga

SEQ ID NO: 10733 - DNA, 20 bp, human
gatcgccaggacccccgggg

SEQ ID NO: 10734 - DNA, 20 bp, human
ggtagcatcatgggagttgt

SEQ ID NO: 10735 - DNA, 20 bp, human
gacttagacccgtgtattgg

SEQ ID NO: 10736 - DNA, 20 bp, human
gtcggttggaggactcgttg

SEQ ID NO: 10737 - DNA, 20 bp, human
gtaggagtcgaggaggaagt

SEQ ID NO: 10738 - DNA, 20 bp, human
ggttggaggactcgttgggg

SEQ ID NO: 10739 - DNA, 20 bp, human
gtcaccgcgagtaggagtcg

SEQ ID NO: 10740 - DNA, 20 bp, human
gcgcctgcccagggagagaa

SEQ ID NO: 10741 - DNA, 20 bp, human
gccgcgagtaggagtcgagg

SEQ ID NO: 10742 - DNA, 20 bp, human
gtgcatccccgagacgatgg

SEQ ID NO: 10743 - DNA, 20 bp, human
gagacggggaaagccgaata

SEQ ID NO: 10744 - DNA, 20 bp, human
ggactgcatccccgagacga

SEQ ID NO: 10745 - DNA, 20 bp, human
ggggctgcgacactagcctg

SEQ ID NO: 10746 - DNA, 20 bp, human
gttacagggcctgccacagt

SEQ ID NO: 10747 - DNA, 20 bp, human
gaaacgccggacagaacaga

SEQ ID NO: 10748 - DNA, 20 bp, human
gaaattctaggcgctagaat

SEQ ID NO: 10749 - DNA, 20 bp, human
gctaatgcttaggtgtctga

SEQ ID NO: 10750 - DNA, 20 bp, human
gtagatccatctgttctgtc

SEQ ID NO: 10751 - DNA, 20 bp, human
gtttggctccaataaatggt

SEQ ID NO: 10752 - DNA, 20 bp, human
gtatttcacagtactttaca

SEQ ID NO: 10753 - DNA, 20 bp, human
ggtgtagttactgaacttgg

SEQ ID NO: 10754 - DNA, 20 bp, human
gggtaggtagcataatgatt

SEQ ID NO: 10755 - DNA, 20 bp, human
gtatgctacctaccatttat

SEQ ID NO: 10756 - DNA, 20 bp, human
gcccgcagggcggtcgaggt

SEQ ID NO: 10757 - DNA, 20 bp, human
ggcggcgccatggctcacgt

SEQ ID NO: 10758 - DNA, 20 bp, human
ggcgccttctcgagaggaag

SEQ ID NO: 10759 - DNA, 20 bp, human
ggggcgcgtcggaaagacca

SEQ ID NO: 10760 - DNA, 20 bp, human
gcgcgggcgggctccaaggg

SEQ ID NO: 10761 - DNA, 20 bp, human
gccttctcgagaggaagcgg

SEQ ID NO: 10762 - DNA, 20 bp, human
ggacggcggccagttcccag

SEQ ID NO: 10763 - DNA, 20 bp, human
gcgggagccgacgtgagcca

SEQ ID NO: 10764 - DNA, 20 bp, human
gagggcggtcgaggtgggaa

SEQ ID NO: 10765 - DNA, 20 bp, human
gccgactccagtccccgcag

SEQ ID NO: 10766 - DNA, 20 bp, human
ggcgaggccgcagtaacctg

SEQ ID NO: 10767 - DNA, 20 bp, human
gcgccgccgccagattctgg

SEQ ID NO: 10768 - DNA, 20 bp, human
ggttcttcgcctccagaatc

SEQ ID NO: 10769 - DNA, 20 bp, human
gctgcaagcggccaagccag

SEQ ID NO: 10770 - DNA, 20 bp, human
ggacttgaggggggccctag

SEQ ID NO: 10771 - DNA, 20 bp, human
gcgcctccagaatctggcgg

SEQ ID NO: 10772 - DNA, 20 bp, human
gccaagggctgagacttgag

SEQ ID NO: 10773 - DNA, 20 bp, human
gtacccgggacaccgatccg

SEQ ID NO: 10774 - DNA, 20 bp, human
ggccctaggggaaagaggac

SEQ ID NO: 10775 - DNA, 20 bp, human
gtcgtcccaggcgcggagtg

SEQ ID NO: 10776 - DNA, 20 bp, human
ggtgagcgtagtggggaaga

SEQ ID NO: 10777 - DNA, 20 bp, human
gagatgggggtgagcagtta

SEQ ID NO: 10778 - DNA, 20 bp, human
gggagacgagagccacaccc

SEQ ID NO: 10779 - DNA, 20 bp, human
ggtcgtttgctgagagcggg

SEQ ID NO: 10780 - DNA, 20 bp, human
gcgggtggcggtcggctctg

SEQ ID NO: 10781 - DNA, 20 bp, human
gctgtccccctgagtaaagg

SEQ ID NO: 10782 - DNA, 20 bp, human
gcagctgtccccctgagtaa

SEQ ID NO: 10783 - DNA, 20 bp, human
gccctggctcaactttactc

SEQ ID NO: 10784 - DNA, 20 bp, human
gatacgatggccgagccaca

SEQ ID NO: 10785 - DNA, 20 bp, human
gctctgcggcgccgcggtcc

SEQ ID NO: 10786 - DNA, 20 bp, human
gcggtacggcccgggtcccg

SEQ ID NO: 10787 - DNA, 20 bp, human
gcgggtcccgcggctcggtg

SEQ ID NO: 10788 - DNA, 20 bp, human
ggcgcggaagccacacccat

SEQ ID NO: 10789 - DNA, 20 bp, human
gttccggggcagcgagtcgt

SEQ ID NO: 10790 - DNA, 20 bp, human
gcatcggcgagccgattccg

SEQ ID NO: 10791 - DNA, 20 bp, human
gaccggcccgggtgagagag

SEQ ID NO: 10792 - DNA, 20 bp, human
ggagcgcttggggcctagta

SEQ ID NO: 10793 - DNA, 20 bp, human
gcggggcaggcggcaccgag

SEQ ID NO: 10794 - DNA, 20 bp, human
ggctccgggccgcagcgcga

SEQ ID NO: 10795 - DNA, 20 bp, human
gcccgtgccgtgggggaccg

SEQ ID NO: 10796 - DNA, 20 bp, human
gcgacacgggcggacaccgg

SEQ ID NO: 10797 - DNA, 20 bp, human
gctcggcgcgatgggactga

SEQ ID NO: 10798 - DNA, 20 bp, human
ggtagcactgagatcggcag

SEQ ID NO: 10799 - DNA, 20 bp, human
gtggtgccccggcgcgacac

SEQ ID NO: 10800 - DNA, 20 bp, human
gcggggcaccaaggagccgt

SEQ ID NO: 10801 - DNA, 20 bp, human
ggcaccaaggagccgttgga

SEQ ID NO: 10802 - DNA, 20 bp, human
gcggggagtagcactgagat

SEQ ID NO: 10803 - DNA, 20 bp, human
gtgccccggcgcgacacggg

SEQ ID NO: 10804 - DNA, 20 bp, human
gccagacccaggaagccgag

SEQ ID NO: 10805 - DNA, 20 bp, human
ggtccgcccgtgtcgcgccg

SEQ ID NO: 10806 - DNA, 20 bp, human
gccggagacgtcagacgcta

SEQ ID NO: 10807 - DNA, 20 bp, human
gggctaagagccttccacgt

SEQ ID NO: 10808 - DNA, 20 bp, human
gagactgcggcccacgtgga

SEQ ID NO: 10809 - DNA, 20 bp, human
gctggggcgtcagaatccag

SEQ ID NO: 10810 - DNA, 20 bp, human
gccgcgggcgctgccaaccc

SEQ ID NO: 10811 - DNA, 20 bp, human
gacgcgggcacgcggcggga

SEQ ID NO: 10812 - DNA, 20 bp, human
ggcatccgcgaggtaagcgg

SEQ ID NO: 10813 - DNA, 20 bp, human
ggaaggaaaccgcggcgctg

SEQ ID NO: 10814 - DNA, 20 bp, human
ggacagagacgtaggccccg

SEQ ID NO: 10815 - DNA, 20 bp, human
gcgattcgctgaacccgcag

SEQ ID NO: 10816 - DNA, 20 bp, human
gtcagggagccaaagagcga

SEQ ID NO: 10817 - DNA, 20 bp, human
gcgggcggcagacaaagcag

SEQ ID NO: 10818 - DNA, 20 bp, human
gcagaggcgtcaggtcacct

SEQ ID NO: 10819 - DNA, 20 bp, human
gggaagcggcccctgtaccg

SEQ ID NO: 10820 - DNA, 20 bp, human
gagccaaagagcgaaggcgc

SEQ ID NO: 10821 - DNA, 20 bp, human
gcaaagagcgaaggcgctgg

SEQ ID NO: 10822 - DNA, 20 bp, human
gaggagggcataagcgacag

SEQ ID NO: 10823 - DNA, 20 bp, human
gggtatgtggggtccacggg

SEQ ID NO: 10824 - DNA, 20 bp, human
gcgcggcgatcgcaagcaac

SEQ ID NO: 10825 - DNA, 20 bp, human
ggccggggctgcgaaccgaa

SEQ ID NO: 10826 - DNA, 20 bp, human
gacgccacctgacctggatg

SEQ ID NO: 10827 - DNA, 20 bp, human
gagtatagtcagcaaagggg

SEQ ID NO: 10828 - DNA, 20 bp, human
gtctccacatccaggtcagg

SEQ ID NO: 10829 - DNA, 20 bp, human
gggaggtctccagcgcacgc

SEQ ID NO: 10830 - DNA, 20 bp, human
ggtgtgctcggggtaaaatg

SEQ ID NO: 10831 - DNA, 20 bp, human
gcagcaaacgccacctgacc

SEQ ID NO: 10832 - DNA, 20 bp, human
gaccagtatagtcagcaaag

SEQ ID NO: 10833 - DNA, 20 bp, human
ggtccgcaggtgggaccccg

SEQ ID NO: 10834 - DNA, 20 bp, human
gctttctccacatccaggtc

SEQ ID NO: 10835 - DNA, 20 bp, human
gccacctgccggaaaccccg

SEQ ID NO: 10836 - DNA, 20 bp, human
gagggcaacactgaagacat

SEQ ID NO: 10837 - DNA, 20 bp, human
gcagttgccccaggtattgg

SEQ ID NO: 10838 - DNA, 20 bp, human
ggaccctgagctagcatctc

SEQ ID NO: 10839 - DNA, 20 bp, human
gtgggtgagttgctacagag

SEQ ID NO: 10840 - DNA, 20 bp, human
gcccagggcccggacactca

SEQ ID NO: 10841 - DNA, 20 bp, human
gtgccagagatgctagctca

SEQ ID NO: 10842 - DNA, 20 bp, human
gctaggcccaaggcacctgt

SEQ ID NO: 10843 - DNA, 20 bp, human
ggtggatcctcagactcatc

SEQ ID NO: 10844 - DNA, 20 bp, human
gcctagggcagaaaagggat

SEQ ID NO: 10845 - DNA, 20 bp, human
ggttccggaaggccccccac

SEQ ID NO: 10846 - DNA, 20 bp, human
gtgagcactggagatagcag

SEQ ID NO: 10847 - DNA, 20 bp, human
gtcatcctccggctctcccc

SEQ ID NO: 10848 - DNA, 20 bp, human
gtctccccgggtagcggcca

SEQ ID NO: 10849 - DNA, 20 bp, human
gcatccctggccgctacccg

SEQ ID NO: 10850 - DNA, 20 bp, human
gtccggctctccccgggtag

SEQ ID NO: 10851 - DNA, 20 bp, human
gaccccatccgaggacacac

SEQ ID NO: 10852 - DNA, 20 bp, human
gtgtccccagcggctcccca

SEQ ID NO: 10853 - DNA, 20 bp, human
gaggacacacaggcggacga

SEQ ID NO: 10854 - DNA, 20 bp, human
ggtggccgagcggcgtcgtg

SEQ ID NO: 10855 - DNA, 20 bp, human
gtcacctcccgctcggacag

SEQ ID NO: 10856 - DNA, 20 bp, human
gggagcagctagctactcgg

SEQ ID NO: 10857 - DNA, 20 bp, human
ggctactcggcgggatctcc

SEQ ID NO: 10858 - DNA, 20 bp, human
gtagcaacgaggcacaacaa

SEQ ID NO: 10859 - DNA, 20 bp, human
ggggatctcccggcaggtaa

SEQ ID NO: 10860 - DNA, 20 bp, human
gtgcggagcagctagctact

SEQ ID NO: 10861 - DNA, 20 bp, human
gaggcacaacaagggactgg

SEQ ID NO: 10862 - DNA, 20 bp, human
gcaggtaaaggtaaccccgt

SEQ ID NO: 10863 - DNA, 20 bp, human
ggcgcccgcagggttagacg

SEQ ID NO: 10864 - DNA, 20 bp, human
gaggagggctcaagaaatcg

SEQ ID NO: 10865 - DNA, 20 bp, human
gacgaggcacaacaagggac

SEQ ID NO: 10866 - DNA, 20 bp, human
gcgcgtggatcgggaaacag

SEQ ID NO: 10867 - DNA, 20 bp, human
gtggtccccgggagggaaag

SEQ ID NO: 10868 - DNA, 20 bp, human
gcgcggaggtcccgagacca

SEQ ID NO: 10869 - DNA, 20 bp, human
gcgggtcttggtccccggga

SEQ ID NO: 10870 - DNA, 20 bp, human
gtacggtgcaacgggtccgc

SEQ ID NO: 10871 - DNA, 20 bp, human
ggagaccagggtaacggact

SEQ ID NO: 10872 - DNA, 20 bp, human
gcccgcgtcctagcaacagg

SEQ ID NO: 10873 - DNA, 20 bp, human
gcccgcctgttgctaggacg

SEQ ID NO: 10874 - DNA, 20 bp, human
ggcgcgggcatacggtgcaa

SEQ ID NO: 10875 - DNA, 20 bp, human
gggcgggcgccgactgcggg

SEQ ID NO: 10876 - DNA, 20 bp, human
gagagcgagtccgtgagggt

SEQ ID NO: 10877 - DNA, 20 bp, human
ggaacgagagcgagtccgtg

SEQ ID NO: 10878 - DNA, 20 bp, human
gtctgaggcccgagccaaga

SEQ ID NO: 10879 - DNA, 20 bp, human
gtcagcggcgagaagcgggg

SEQ ID NO: 10880 - DNA, 20 bp, human
ggagtctgcgcacttcggtc

SEQ ID NO: 10881 - DNA, 20 bp, human
gagaagcggggcggagtctg

SEQ ID NO: 10882 - DNA, 20 bp, human
gggactagacgacgacacag

SEQ ID NO: 10883 - DNA, 20 bp, human
gtcttgcgcaggcgcactgg

SEQ ID NO: 10884 - DNA, 20 bp, human
gctgcgcaagacgctggact

SEQ ID NO: 10885 - DNA, 20 bp, human
gccgaagtgcgcagactcgg

SEQ ID NO: 10886 - DNA, 20 bp, human
gagcgtccgcccagaagaag

SEQ ID NO: 10887 - DNA, 20 bp, human
gggccacgtggggaaaggtg

SEQ ID NO: 10888 - DNA, 20 bp, human
gttctgggcggacgctctgg

SEQ ID NO: 10889 - DNA, 20 bp, human
gtcgcgccagcccgaccctg

SEQ ID NO: 10890 - DNA, 20 bp, human
gtcgggctggcgcgaccctc

SEQ ID NO: 10891 - DNA, 20 bp, human
gcgcctggggacaaaatcct

SEQ ID NO: 10892 - DNA, 20 bp, human
gccacgtggccgcgaagacc

SEQ ID NO: 10893 - DNA, 20 bp, human
ggcgtccgcgagtctctggg

SEQ ID NO: 10894 - DNA, 20 bp, human
ggtgatgggacgggaaagca

SEQ ID NO: 10895 - DNA, 20 bp, human
gaagaccgggtgagacgctg

SEQ ID NO: 10896 - DNA, 20 bp, human
gggacagcgcggcttccgcc

SEQ ID NO: 10897 - DNA, 20 bp, human
ggcgagccccaaccagtaga

SEQ ID NO: 10898 - DNA, 20 bp, human
ggagccacggtgggatcagg

SEQ ID NO: 10899 - DNA, 20 bp, human
ggagacagggaaccgtctac

SEQ ID NO: 10900 - DNA, 20 bp, human
ggggctcgcggagggggcac

SEQ ID NO: 10901 - DNA, 20 bp, human
ggtccgggcggcggtcacag

SEQ ID NO: 10902 - DNA, 20 bp, human
gtactggttggggctcgcgg

SEQ ID NO: 10903 - DNA, 20 bp, human
gggcactggcgcaccgtccc

SEQ ID NO: 10904 - DNA, 20 bp, human
gtggttggggctcgcggagg

SEQ ID NO: 10905 - DNA, 20 bp, human
gcagggaaccgtctactggt

SEQ ID NO: 10906 - DNA, 20 bp, human
ggcgcctgcagcagccgggt

SEQ ID NO: 10907 - DNA, 20 bp, human
gtagcgatgccgcttcccgg

SEQ ID NO: 10908 - DNA, 20 bp, human
ggtggagaggcgggatagac

SEQ ID NO: 10909 - DNA, 20 bp, human
gcggcgggtcactcaccgaa

SEQ ID NO: 10910 - DNA, 20 bp, human
ggcaagcccggcgcttcaca

SEQ ID NO: 10911 - DNA, 20 bp, human
gagcggcatcgctaaaagga

SEQ ID NO: 10912 - DNA, 20 bp, human
gcaccgaaaggacgctcatg

SEQ ID NO: 10913 - DNA, 20 bp, human
gaaaggacgctcatgcggat

SEQ ID NO: 10914 - DNA, 20 bp, human
ggaaaggcccgcagaaagaa

SEQ ID NO: 10915 - DNA, 20 bp, human
gcctagcgttggccaatagt

SEQ ID NO: 10916 - DNA, 20 bp, human
gagcagatggagattatcag

SEQ ID NO: 10917 - DNA, 20 bp, human
gctcccagcaccaggacggc

SEQ ID NO: 10918 - DNA, 20 bp, human
gggtggcccggctgcatccg

SEQ ID NO: 10919 - DNA, 20 bp, human
ggagaagtggtagcatccgg

SEQ ID NO: 10920 - DNA, 20 bp, human
gcggcgcgagcgggttatcc

SEQ ID NO: 10921 - DNA, 20 bp, human
gactgggtgcctcaggaacg

SEQ ID NO: 10922 - DNA, 20 bp, human
gtctgctagccgcgttcctg

SEQ ID NO: 10923 - DNA, 20 bp, human
gcagcaggtaagcgcgtccc

SEQ ID NO: 10924 - DNA, 20 bp, human
gtgaagtctggacttcaact

SEQ ID NO: 10925 - DNA, 20 bp, human
gcttacctgctgctcggccg

SEQ ID NO: 10926 - DNA, 20 bp, human
gtatagcccagagggcgaga

SEQ ID NO: 10927 - DNA, 20 bp, human
gtaaagctggagctgtcccg

SEQ ID NO: 10928 - DNA, 20 bp, human
gagggcaagggatactgcaa

SEQ ID NO: 10929 - DNA, 20 bp, human
gccttggggccggattccag

SEQ ID NO: 10930 - DNA, 20 bp, human
gcgcggcgcccagaaggact

SEQ ID NO: 10931 - DNA, 20 bp, human
gcactcttcctatagcccag

SEQ ID NO: 10932 - DNA, 20 bp, human
gaccggaccaaacgaagact

SEQ ID NO: 10933 - DNA, 20 bp, human
gccgcgccgcagggatcccc

SEQ ID NO: 10934 - DNA, 20 bp, human
ggaaggacgtctgcacgcgt

SEQ ID NO: 10935 - DNA, 20 bp, human
ggaaccgtggaggccgaagg

SEQ ID NO: 10936 - DNA, 20 bp, human
ggcggtggtggggaaagtca

SEQ ID NO: 10937 - DNA, 20 bp, human
gctcgcctgggttaaacgca

SEQ ID NO: 10938 - DNA, 20 bp, human
gccaggactgaaaagacggg

SEQ ID NO: 10939 - DNA, 20 bp, human
gggcggaccctgagagaatc

SEQ ID NO: 10940 - DNA, 20 bp, human
gagaggaggacggagaacga

SEQ ID NO: 10941 - DNA, 20 bp, human
gggacggagaacgacggtca

SEQ ID NO: 10942 - DNA, 20 bp, human
gagcgcatagaaggccagca

SEQ ID NO: 10943 - DNA, 20 bp, human
gaggttgggaaagggtaacc

SEQ ID NO: 10944 - DNA, 20 bp, human
gccctgaatagggtaatcta

SEQ ID NO: 10945 - DNA, 20 bp, human
gctcccaaatcacagagggt

SEQ ID NO: 10946 - DNA, 20 bp, human
gggggagctggtactcagac

SEQ ID NO: 10947 - DNA, 20 bp, human
ggcaggccggcccgccctca

SEQ ID NO: 10948 - DNA, 20 bp, human
gcgagtgggagagacgacgg

SEQ ID NO: 10949 - DNA, 20 bp, human
gtcagacgggaacaacgacc

SEQ ID NO: 10950 - DNA, 20 bp, human
gtagtccaccaggacagtgc

SEQ ID NO: 10951 - DNA, 20 bp, human
gcggcgagtgggagagacga

SEQ ID NO: 10952 - DNA, 20 bp, human
gaccccaagagaggtaatag

SEQ ID NO: 10953 - DNA, 20 bp, human
gcaccaggacagtgccggag

SEQ ID NO: 10954 - DNA, 20 bp, human
gggacagtgccggaggggaa

SEQ ID NO: 10955 - DNA, 20 bp, human
gcaatccggaaagggagctg

SEQ ID NO: 10956 - DNA, 20 bp, human
gtagtggaagggatgcgcca

SEQ ID NO: 10957 - DNA, 20 bp, human
gccttagagactggacggtg

SEQ ID NO: 10958 - DNA, 20 bp, human
ggcatcgggcccggggaaag

SEQ ID NO: 10959 - DNA, 20 bp, human
gggtggtgtctcagactgtg

SEQ ID NO: 10960 - DNA, 20 bp, human
gtggaagggatgcgccacgg

SEQ ID NO: 10961 - DNA, 20 bp, human
gcaggttcctgaacccggaa

SEQ ID NO: 10962 - DNA, 20 bp, human
gtggacggtggggttggtaa

SEQ ID NO: 10963 - DNA, 20 bp, human
gggaagcgagcggacatgtg

SEQ ID NO: 10964 - DNA, 20 bp, human
gggcagaagctcactgaccc

SEQ ID NO: 10965 - DNA, 20 bp, human
gatctgtgcaggcgaaccgt

SEQ ID NO: 10966 - DNA, 20 bp, human
gggatacgcgacctggtcat

SEQ ID NO: 10967 - DNA, 20 bp, human
gcgtggaagaacctcgtctg

SEQ ID NO: 10968 - DNA, 20 bp, human
gacctcgtctgcggaggaaa

SEQ ID NO: 10969 - DNA, 20 bp, human
gtgtatgacacagcacctcg

SEQ ID NO: 10970 - DNA, 20 bp, human
gtacccacaacggcagtggg

SEQ ID NO: 10971 - DNA, 20 bp, human
ggagagatgggtaattggaa

SEQ ID NO: 10972 - DNA, 20 bp, human
ggggtggatgtgggtatcag

SEQ ID NO: 10973 - DNA, 20 bp, human
gtgggaggcgggcggtgaga

SEQ ID NO: 10974 - DNA, 20 bp, human
gaacggcgctggaacaagag

SEQ ID NO: 10975 - DNA, 20 bp, human
gggaagaacctcgtctgcgg

SEQ ID NO: 10976 - DNA, 20 bp, human
gggatacgcgacctggtcat

SEQ ID NO: 10977 - DNA, 20 bp, human
gcgtggaagaacctcgtctg

SEQ ID NO: 10978 - DNA, 20 bp, human
gacctcgtctgcggaggaaa

SEQ ID NO: 10979 - DNA, 20 bp, human
gtgtatgacacagcacctcg

SEQ ID NO: 10980 - DNA, 20 bp, human
gtacccacaacggcagtggg

SEQ ID NO: 10981 - DNA, 20 bp, human
ggagagatgggtaattggaa

SEQ ID NO: 10982 - DNA, 20 bp, human
ggggtggatgtgggtatcag

SEQ ID NO: 10983 - DNA, 20 bp, human
gtgggaggcgggcggtgaga

SEQ ID NO: 10984 - DNA, 20 bp, human
gaacggcgctggaacaagag

SEQ ID NO: 10985 - DNA, 20 bp, human
gggaagaacctcgtctgcgg

SEQ ID NO: 10986 - DNA, 20 bp, human
gacgcctgcagagtaatagg

SEQ ID NO: 10987 - DNA, 20 bp, human
gggggctggtacccagacgg

SEQ ID NO: 10988 - DNA, 20 bp, human
gacctgcaaggttccaacca

SEQ ID NO: 10989 - DNA, 20 bp, human
ggcaggacttgtgctctagg

SEQ ID NO: 10990 - DNA, 20 bp, human
gctgcagagtaatagggggc

SEQ ID NO: 10991 - DNA, 20 bp, human
gcctgctagtcgcctccgtc

SEQ ID NO: 10992 - DNA, 20 bp, human
gcacacgcctgcagagtaat

SEQ ID NO: 10993 - DNA, 20 bp, human
ggcaggcgtgtgaagaaaga

SEQ ID NO: 10994 - DNA, 20 bp, human
gcaaacagacaagggaccga

SEQ ID NO: 10995 - DNA, 20 bp, human
ggctgcttgagaggaggtat

SEQ ID NO: 10996 - DNA, 20 bp, human
gggtataggcgcagcatgta

SEQ ID NO: 10997 - DNA, 20 bp, human
gagggtacagggacataatg

SEQ ID NO: 10998 - DNA, 20 bp, human
gggaccgatggtaactgagg

SEQ ID NO: 10999 - DNA, 20 bp, human
ggcgcagcatgtagggtaca

SEQ ID NO: 11000 - DNA, 20 bp, human
gtaccatcggtcctgggtat

SEQ ID NO: 11001 - DNA, 20 bp, human
gggacataatgtggtgacaa

SEQ ID NO: 11002 - DNA, 20 bp, human
gctctcctgctggaacccag

SEQ ID NO: 11003 - DNA, 20 bp, human
gtggtaagcagagctcagtg

SEQ ID NO: 11004 - DNA, 20 bp, human
gcctccgcctcagttaccat

SEQ ID NO: 11005 - DNA, 20 bp, human
gaattgcctaggcctccctg

SEQ ID NO: 11006 - DNA, 20 bp, human
ggcttgatgccgaaaactgt

SEQ ID NO: 11007 - DNA, 20 bp, human
gactactgccaaccccggtg

SEQ ID NO: 11008 - DNA, 20 bp, human
gtatacccaagggagcgagg

SEQ ID NO: 11009 - DNA, 20 bp, human
gcggcgactactgccaaccc

SEQ ID NO: 11010 - DNA, 20 bp, human
gaccgcggaatccaagatgg

SEQ ID NO: 11011 - DNA, 20 bp, human
gcggcatcaagcggctccag

SEQ ID NO: 11012 - DNA, 20 bp, human
ggactggggcgcctctaaag

SEQ ID NO: 11013 - DNA, 20 bp, human
gtagactcgagtatacccaa

SEQ ID NO: 11014 - DNA, 20 bp, human
gaactgtaggcagagtgtct

SEQ ID NO: 11015 - DNA, 20 bp, human
gggtgaggagacggaggact

SEQ ID NO: 11016 - DNA, 20 bp, human
ggccgccgccacacaaagga

SEQ ID NO: 11017 - DNA, 20 bp, human
ggcatcctcgggaacccgaa

SEQ ID NO: 11018 - DNA, 20 bp, human
ggcccgcgccgtcctttgtg

SEQ ID NO: 11019 - DNA, 20 bp, human
gcgcctgcccgggaccggat

SEQ ID NO: 11020 - DNA, 20 bp, human
gacgctggcctcgcatcctc

SEQ ID NO: 11021 - DNA, 20 bp, human
gataggcgcccgcttggcag

SEQ ID NO: 11022 - DNA, 20 bp, human
gatgccacaaaagccgggac

SEQ ID NO: 11023 - DNA, 20 bp, human
gcgcgccgtcctttgtgtgg

SEQ ID NO: 11024 - DNA, 20 bp, human
ggggcctgaccgggtccccg

SEQ ID NO: 11025 - DNA, 20 bp, human
gcatcttgctcggagaggat

SEQ ID NO: 11026 - DNA, 20 bp, human
ggaaagtaggtcagggacgg

SEQ ID NO: 11027 - DNA, 20 bp, human
ggcagaaagtaggtcaggga

SEQ ID NO: 11028 - DNA, 20 bp, human
ggagtccggcgcgggtaaac

SEQ ID NO: 11029 - DNA, 20 bp, human
gccgcactcggatcccgcgg

SEQ ID NO: 11030 - DNA, 20 bp, human
ggctgcaggagcccttaaag

SEQ ID NO: 11031 - DNA, 20 bp, human
gtgcctgccctagcccgcag

SEQ ID NO: 11032 - DNA, 20 bp, human
gagcgatgcccgcggaaggg

SEQ ID NO: 11033 - DNA, 20 bp, human
ggtggtgcgacatttaggga

SEQ ID NO: 11034 - DNA, 20 bp, human
gcgcccgcactcggatcccg

SEQ ID NO: 11035 - DNA, 20 bp, human
gggtagcgatgcccgcggaa

SEQ ID NO: 11036 - DNA, 20 bp, human
ggcagcccgtaggcgcgcac

SEQ ID NO: 11037 - DNA, 20 bp, human
gggccgccaccgcagcccgt

SEQ ID NO: 11038 - DNA, 20 bp, human
ggcgtcccgtgcgcgcctac

SEQ ID NO: 11039 - DNA, 20 bp, human
gccggagcatcgcctccgag

SEQ ID NO: 11040 - DNA, 20 bp, human
ggcgcgcctacgggctgcgg

SEQ ID NO: 11041 - DNA, 20 bp, human
gcgaggcgacggccccaggt

SEQ ID NO: 11042 - DNA, 20 bp, human
ggcacctgtgccccacgggg

SEQ ID NO: 11043 - DNA, 20 bp, human
ggggacaaggccgccccgtg

SEQ ID NO: 11044 - DNA, 20 bp, human
ggcgcccggcgcgtcctccc

SEQ ID NO: 11045 - DNA, 20 bp, human
gcaagtggctcctgcgatgg

SEQ ID NO: 11046 - DNA, 20 bp, human
gcgacgcgaacaggctccgt

SEQ ID NO: 11047 - DNA, 20 bp, human
gggccgttacctgggatcgg

SEQ ID NO: 11048 - DNA, 20 bp, human
gcccaggtaacggccagcag

SEQ ID NO: 11049 - DNA, 20 bp, human
ggctcggagcggaggattcg

SEQ ID NO: 11050 - DNA, 20 bp, human
ggagcaggcaaacatcctat

SEQ ID NO: 11051 - DNA, 20 bp, human
gtggacaagagaggccgaca

SEQ ID NO: 11052 - DNA, 20 bp, human
gctgggcagtcgacgcgaac

SEQ ID NO: 11053 - DNA, 20 bp, human
ggtcctccgcccgcgcccga

SEQ ID NO: 11054 - DNA, 20 bp, human
gtccggactcccccgatccc

SEQ ID NO: 11055 - DNA, 20 bp, human
gctcccccgatcccaggtaa

SEQ ID NO: 11056 - DNA, 20 bp, human
ggcggagcccagagccggtt

SEQ ID NO: 11057 - DNA, 20 bp, human
ggccggggcgcgggaggtga

SEQ ID NO: 11058 - DNA, 20 bp, human
gggcagtcgacgcgccgaac

SEQ ID NO: 11059 - DNA, 20 bp, human
gaggggcggaaggcacgagg

SEQ ID NO: 11060 - DNA, 20 bp, human
ggcagcagccacttcctcgt

SEQ ID NO: 11061 - DNA, 20 bp, human
ggtgaggacgcatagatgtg

SEQ ID NO: 11062 - DNA, 20 bp, human
gcgaccgcggggcaaggctg

SEQ ID NO: 11063 - DNA, 20 bp, human
ggcgccccggccgcggactc

SEQ ID NO: 11064 - DNA, 20 bp, human
gtccccgtgcccctattggg

SEQ ID NO: 11065 - DNA, 20 bp, human
ggacgcgccgaaccggctct

SEQ ID NO: 11066 - DNA, 20 bp, human
gaccgggcttgtcggtgaag

SEQ ID NO: 11067 - DNA, 20 bp, human
gcttgtcggtgaagcggcag

SEQ ID NO: 11068 - DNA, 20 bp, human
gtaagggaggcaaggacgga

SEQ ID NO: 11069 - DNA, 20 bp, human
gcgggcgcgcgctcacccgg

SEQ ID NO: 11070 - DNA, 20 bp, human
gagtggccggctagagccgg

SEQ ID NO: 11071 - DNA, 20 bp, human
gtggcggcggctgcccccag

SEQ ID NO: 11072 - DNA, 20 bp, human
ggccccagcggggtagacgt

SEQ ID NO: 11073 - DNA, 20 bp, human
gtcccacgtctaccccgctg

SEQ ID NO: 11074 - DNA, 20 bp, human
gaacaagggccggtgagggt

SEQ ID NO: 11075 - DNA, 20 bp, human
gggcccacgcacgcagactg

SEQ ID NO: 11076 - DNA, 20 bp, human
gtggtgtagcagccatatcc

SEQ ID NO: 11077 - DNA, 20 bp, human
gtggtcctgaagcctggata

SEQ ID NO: 11078 - DNA, 20 bp, human
gagccaggaagtagatgata

SEQ ID NO: 11079 - DNA, 20 bp, human
gtatggctgctacaccacca

SEQ ID NO: 11080 - DNA, 20 bp, human
gcagcaggcagggtgaccat

SEQ ID NO: 11081 - DNA, 20 bp, human
gagggcagttatccattata

SEQ ID NO: 11082 - DNA, 20 bp, human
ggtgccttaaaggaaagcac

SEQ ID NO: 11083 - DNA, 20 bp, human
ggatactgagagctgacaga

SEQ ID NO: 11084 - DNA, 20 bp, human
gtaaacatgactcagaacag

SEQ ID NO: 11085 - DNA, 20 bp, human
gaaaatgaatgccctaagag

SEQ ID NO: 11086 - DNA, 20 bp, human
ggagcaggatccaggtacag

SEQ ID NO: 11087 - DNA, 20 bp, human
gcactagagagcgaagccaa

SEQ ID NO: 11088 - DNA, 20 bp, human
gctggcagcctgggcgaggt

SEQ ID NO: 11089 - DNA, 20 bp, human
gcagcggagcgcttccggtc

SEQ ID NO: 11090 - DNA, 20 bp, human
gacctggatcctgctcctct

SEQ ID NO: 11091 - DNA, 20 bp, human
gagggagcctgaccccgggg

SEQ ID NO: 11092 - DNA, 20 bp, human
gcagagggagcctgaccccg

SEQ ID NO: 11093 - DNA, 20 bp, human
gccgtggatcgaaccctcac

SEQ ID NO: 11094 - DNA, 20 bp, human
gcggagtcggaaggagtaga

SEQ ID NO: 11095 - DNA, 20 bp, human
ggcagcctgggcgaggtagg

SEQ ID NO: 11096 - DNA, 20 bp, human
gaagagtggtaagcctgtaa

SEQ ID NO: 11097 - DNA, 20 bp, human
gggttgatgacagaaaggat

SEQ ID NO: 11098 - DNA, 20 bp, human
gaaggaagtagatttagacg

SEQ ID NO: 11099 - DNA, 20 bp, human
ggtagatttagacgaggaag

SEQ ID NO: 11100 - DNA, 20 bp, human
gctttgcttggtagatactg

SEQ ID NO: 11101 - DNA, 20 bp, human
gttcctgggcttgccattac

SEQ ID NO: 11102 - DNA, 20 bp, human
gtctagacctttcaagatag

SEQ ID NO: 11103 - DNA, 20 bp, human
gatctaccaagcaaagtaca

SEQ ID NO: 11104 - DNA, 20 bp, human
gggtttagacttactctctc

SEQ ID NO: 11105 - DNA, 20 bp, human
ggaggaaatgtgcttaattc

SEQ ID NO: 11106 - DNA, 20 bp, human
gagcgccaggagctgcgggt

SEQ ID NO: 11107 - DNA, 20 bp, human
ggcccagccagcgcccgcga

SEQ ID NO: 11108 - DNA, 20 bp, human
ggggccggaaagcggaagta

SEQ ID NO: 11109 - DNA, 20 bp, human
gagcaaagccgctagaggtg

SEQ ID NO: 11110 - DNA, 20 bp, human
gcctgaggccgaacagccgg

SEQ ID NO: 11111 - DNA, 20 bp, human
gcctcgagcaaagccgctag

SEQ ID NO: 11112 - DNA, 20 bp, human
gccacttccgggttcctaca

SEQ ID NO: 11113 - DNA, 20 bp, human
gggctggaggtaccaagaat

SEQ ID NO: 11114 - DNA, 20 bp, human
gacccgcaccccacctctag

SEQ ID NO: 11115 - DNA, 20 bp, human
gcagaaccggaagaaacgaa

SEQ ID NO: 11116 - DNA, 20 bp, human
gagcaaagccgctagaggtg

SEQ ID NO: 11117 - DNA, 20 bp, human
gcctcgagcaaagccgctag

SEQ ID NO: 11118 - DNA, 20 bp, human
gacccgcaccccacctctag

SEQ ID NO: 11119 - DNA, 20 bp, human
gaccccgctcggagcataga

SEQ ID NO: 11120 - DNA, 20 bp, human
gaaggcccaagcgttcgtaa

SEQ ID NO: 11121 - DNA, 20 bp, human
gtacagcccagcttcagatt

SEQ ID NO: 11122 - DNA, 20 bp, human
gtaccgtccggaagtccggg

SEQ ID NO: 11123 - DNA, 20 bp, human
gagcgccaggagctgcgggt

SEQ ID NO: 11124 - DNA, 20 bp, human
gtggtaccgtccggaagtcc

SEQ ID NO: 11125 - DNA, 20 bp, human
gctccgcccggacttccgga

SEQ ID NO: 11126 - DNA, 20 bp, human
gccgcacggcactcaggtag

SEQ ID NO: 11127 - DNA, 20 bp, human
gcagagggcagcctgcaatg

SEQ ID NO: 11128 - DNA, 20 bp, human
gctcaggtaggggcggagag

SEQ ID NO: 11129 - DNA, 20 bp, human
gtgtggcccgcacggcactc

SEQ ID NO: 11130 - DNA, 20 bp, human
gttggcaggacagaacccag

SEQ ID NO: 11131 - DNA, 20 bp, human
gtgtcgttccacaacctggg

SEQ ID NO: 11132 - DNA, 20 bp, human
ggcctgcaatgtggcccgca

SEQ ID NO: 11133 - DNA, 20 bp, human
ggccgtgcgggccacattgc

SEQ ID NO: 11134 - DNA, 20 bp, human
ggcggagagtggcagtctat

SEQ ID NO: 11135 - DNA, 20 bp, human
gttgtgtcgttccacaacct

SEQ ID NO: 11136 - DNA, 20 bp, human
gtgcaacctgaggaatctgg

SEQ ID NO: 11137 - DNA, 20 bp, human
gagtcggcgacgcctcagag

SEQ ID NO: 11138 - DNA, 20 bp, human
gtagaggcagcgccaagaag

SEQ ID NO: 11139 - DNA, 20 bp, human
gagggcaggcttccaagagt

SEQ ID NO: 11140 - DNA, 20 bp, human
gtcgtggacgaagaagatgg

SEQ ID NO: 11141 - DNA, 20 bp, human
ggggatcgcccgctctgaga

SEQ ID NO: 11142 - DNA, 20 bp, human
gcagtcggcaggagacgcga

SEQ ID NO: 11143 - DNA, 20 bp, human
ggacgcgagggtcccactct

SEQ ID NO: 11144 - DNA, 20 bp, human
gagcccagcaacccactacc

SEQ ID NO: 11145 - DNA, 20 bp, human
gacatcccaatcccgaccag

SEQ ID NO: 11146 - DNA, 20 bp, human
gggccaagggtcggagacag

SEQ ID NO: 11147 - DNA, 20 bp, human
gggctctgctccgctcgcac

SEQ ID NO: 11148 - DNA, 20 bp, human
ggctggggacgagggaccca

SEQ ID NO: 11149 - DNA, 20 bp, human
gcgaaagggcccgagaaggt

SEQ ID NO: 11150 - DNA, 20 bp, human
gtccgctcgcggcccgacct

SEQ ID NO: 11151 - DNA, 20 bp, human
ggagcaggagccggtgcgag

SEQ ID NO: 11152 - DNA, 20 bp, human
gctgccgacccggcttccct

SEQ ID NO: 11153 - DNA, 20 bp, human
ggctgcagaagaaggcgcca

SEQ ID NO: 11154 - DNA, 20 bp, human
gggacccgagcgaggtggac

SEQ ID NO: 11155 - DNA, 20 bp, human
gacgagggacccagggagac

SEQ ID NO: 11156 - DNA, 20 bp, human
gacgccgacctcgctatcag

SEQ ID NO: 11157 - DNA, 20 bp, human
ggcacccctgatagcgaggt

SEQ ID NO: 11158 - DNA, 20 bp, human
ggaggtcggcgtcacggtgt

SEQ ID NO: 11159 - DNA, 20 bp, human
gggaaaccgaggcccaacgt

SEQ ID NO: 11160 - DNA, 20 bp, human
ggatagcgaggtcggcgtca

SEQ ID NO: 11161 - DNA, 20 bp, human
ggaatgaggcgagcactaca

SEQ ID NO: 11162 - DNA, 20 bp, human
gatcaggggtgccgtgaatg

SEQ ID NO: 11163 - DNA, 20 bp, human
gaaccgaggcccaacgtggg

SEQ ID NO: 11164 - DNA, 20 bp, human
gggtagctgccgcccacgtt

SEQ ID NO: 11165 - DNA, 20 bp, human
gcacggcacccctgatagcg

SEQ ID NO: 11166 - DNA, 20 bp, human
gcggcgggaagccaaaggtg

SEQ ID NO: 11167 - DNA, 20 bp, human
ggctccgtgtcgtcataagg

SEQ ID NO: 11168 - DNA, 20 bp, human
gcgggaaaagatgcaattag

SEQ ID NO: 11169 - DNA, 20 bp, human
gtgaggaacaccgcgaccca

SEQ ID NO: 11170 - DNA, 20 bp, human
gcccacggaggtgttacaaa

SEQ ID NO: 11171 - DNA, 20 bp, human
gagcgacggcgggaagccaa

SEQ ID NO: 11172 - DNA, 20 bp, human
gacgcgagagcccaggacgc

SEQ ID NO: 11173 - DNA, 20 bp, human
ggaggcttacagaaaaactt

SEQ ID NO: 11174 - DNA, 20 bp, human
gtagttggagagttcttcaa

SEQ ID NO: 11175 - DNA, 20 bp, human
gatgtctgcggaagtccccg

SEQ ID NO: 11176 - DNA, 20 bp, human
gaaaggtaaaggctgaccat

SEQ ID NO: 11177 - DNA, 20 bp, human
gtatcatatgaatggaaata

SEQ ID NO: 11178 - DNA, 20 bp, human
ggttagagcatgctccactg

SEQ ID NO: 11179 - DNA, 20 bp, human
ggatactggacaaggatatt

SEQ ID NO: 11180 - DNA, 20 bp, human
gtctgagctaaatactgcaa

SEQ ID NO: 11181 - DNA, 20 bp, human
gtattgttcggtgaaaggtt

SEQ ID NO: 11182 - DNA, 20 bp, human
ggaaaatgaagcaattcaca

SEQ ID NO: 11183 - DNA, 20 bp, human
gtggttatggatactggaca

SEQ ID NO: 11184 - DNA, 20 bp, human
gtctaagagggaaagtcact

SEQ ID NO: 11185 - DNA, 20 bp, human
gactcaactgggatctaaga

SEQ ID NO: 11186 - DNA, 20 bp, human
gagtatgggctagaagtaga

SEQ ID NO: 11187 - DNA, 20 bp, human
ggctaagagcaagggatata

SEQ ID NO: 11188 - DNA, 20 bp, human
ggtgacagaagtctctatgg

SEQ ID NO: 11189 - DNA, 20 bp, human
gggctttggaatattacctg

SEQ ID NO: 11190 - DNA, 20 bp, human
gcaggctcagtaagcatcaa

SEQ ID NO: 11191 - DNA, 20 bp, human
gccaaaaactgagagcatga

SEQ ID NO: 11192 - DNA, 20 bp, human
ggggatatagggcttagtat

SEQ ID NO: 11193 - DNA, 20 bp, human
gttggtgacagaagtctcta

SEQ ID NO: 11194 - DNA, 20 bp, human
ggagagtcaagggcatcatg

SEQ ID NO: 11195 - DNA, 20 bp, human
gggcatcatgaggtgaactc

SEQ ID NO: 11196 - DNA, 20 bp, human
ggcacgggcacactaacccg

SEQ ID NO: 11197 - DNA, 20 bp, human
gtgcgaccgtcgcggaccat

SEQ ID NO: 11198 - DNA, 20 bp, human
gacggtcgcagggaggtccg

SEQ ID NO: 11199 - DNA, 20 bp, human
gggcatgctggcgcacacac

SEQ ID NO: 11200 - DNA, 20 bp, human
gcagccgcagagacgcacgg

SEQ ID NO: 11201 - DNA, 20 bp, human
gtgacacacaatacacgcac

SEQ ID NO: 11202 - DNA, 20 bp, human
gccacacaggagacctcggg

SEQ ID NO: 11203 - DNA, 20 bp, human
gtgtcgcccatggtccgcga

SEQ ID NO: 11204 - DNA, 20 bp, human
ggtctcctgtgtggtctccc

SEQ ID NO: 11205 - DNA, 20 bp, human
gcatgggcgacaaagggacc

SEQ ID NO: 11206 - DNA, 20 bp, human
gatcttggcagcgggcgagg

SEQ ID NO: 11207 - DNA, 20 bp, human
gcggccctcgggacaggtgt

SEQ ID NO: 11208 - DNA, 20 bp, human
ggcgggcgcgcgcaccatgg

SEQ ID NO: 11209 - DNA, 20 bp, human
gcgaggggtcgtgtacgggg

SEQ ID NO: 11210 - DNA, 20 bp, human
ggagtggatcccccccgtcc

SEQ ID NO: 11211 - DNA, 20 bp, human
ggaaacccgggaccaggtaa

SEQ ID NO: 11212 - DNA, 20 bp, human
gccgcgtgtctgctaggaga

SEQ ID NO: 11213 - DNA, 20 bp, human
gaggtcctcgaggataatga

SEQ ID NO: 11214 - DNA, 20 bp, human
gacccgggaccaggtaaggg

SEQ ID NO: 11215 - DNA, 20 bp, human
ggatgtggggccagactact

SEQ ID NO: 11216 - DNA, 20 bp, human
gctcagggcgtcctccacag

SEQ ID NO: 11217 - DNA, 20 bp, human
gcccagccaacggctccccg

SEQ ID NO: 11218 - DNA, 20 bp, human
gccccatgccgcggcctcac

SEQ ID NO: 11219 - DNA, 20 bp, human
gcccggggctgtagacgacg

SEQ ID NO: 11220 - DNA, 20 bp, human
gctgcactcgccccatgccg

SEQ ID NO: 11221 - DNA, 20 bp, human
gtgaagcgggtccactgtgg

SEQ ID NO: 11222 - DNA, 20 bp, human
gcggctggccggtgaggccg

SEQ ID NO: 11223 - DNA, 20 bp, human
ggctgcgcggctggccggtg

SEQ ID NO: 11224 - DNA, 20 bp, human
gacccgcgcccacctcggaa

SEQ ID NO: 11225 - DNA, 20 bp, human
gactccgcgggcccaacccg

SEQ ID NO: 11226 - DNA, 20 bp, human
gacgctcctggcgccaggta

SEQ ID NO: 11227 - DNA, 20 bp, human
gtggcctcgaactcgcgaac

SEQ ID NO: 11228 - DNA, 20 bp, human
gccgccgtccaggtggtggg

SEQ ID NO: 11229 - DNA, 20 bp, human
gcgcaggcgcgctcaccaac

SEQ ID NO: 11230 - DNA, 20 bp, human
gcctggccgccgctaaacac

SEQ ID NO: 11231 - DNA, 20 bp, human
gcgttctgaggctgcagcgt

SEQ ID NO: 11232 - DNA, 20 bp, human
gtcctggcgccaggtacgga

SEQ ID NO: 11233 - DNA, 20 bp, human
gggtaccgccgtccaggtgg

SEQ ID NO: 11234 - DNA, 20 bp, human
gggaggtaccgccgtccagg

SEQ ID NO: 11235 - DNA, 20 bp, human
ggtgcctcccaccacctgga

SEQ ID NO: 11236 - DNA, 20 bp, human
gcgccgcaggtaggtctccg

SEQ ID NO: 11237 - DNA, 20 bp, human
ggggcccccccggcgaactt

SEQ ID NO: 11238 - DNA, 20 bp, human
ggaacttgggccggcgccgg

SEQ ID NO: 11239 - DNA, 20 bp, human
gccccccggcgaacttgggc

SEQ ID NO: 11240 - DNA, 20 bp, human
gagctgccgacgccgcaggt

SEQ ID NO: 11241 - DNA, 20 bp, human
gaggcttccggccctgaaga

SEQ ID NO: 11242 - DNA, 20 bp, human
ggcccgggcggcgcctaccg

SEQ ID NO: 11243 - DNA, 20 bp, human
ggggggcccggaggaagctt

SEQ ID NO: 11244 - DNA, 20 bp, human
gcgccggcccaagttcgccg

SEQ ID NO: 11245 - DNA, 20 bp, human
gtcggccgcgaccctcttca

SEQ ID NO: 11246 - DNA, 20 bp, human
gttagccgcccgtctttgta

SEQ ID NO: 11247 - DNA, 20 bp, human
ggtctccttacaaagacggg

SEQ ID NO: 11248 - DNA, 20 bp, human
gtaaaaagtcagggcagcag

SEQ ID NO: 11249 - DNA, 20 bp, human
gaggagaccactgagacgag

SEQ ID NO: 11250 - DNA, 20 bp, human
ggcgctcccgctcgtctcag

SEQ ID NO: 11251 - DNA, 20 bp, human
ggagatttcttaaaaagtca

SEQ ID NO: 11252 - DNA, 20 bp, human
ggtggtctccttacaaagac

SEQ ID NO: 11253 - DNA, 20 bp, human
gttctgtgtataggcagtat

SEQ ID NO: 11254 - DNA, 20 bp, human
gtcagtgtaattctgtgtat

SEQ ID NO: 11255 - DNA, 20 bp, human
ggtataggcagtattggagc

SEQ ID NO: 11256 - DNA, 20 bp, human
gagccgtgcggtacccgatg

SEQ ID NO: 11257 - DNA, 20 bp, human
gaggcgctcgcggcagggta

SEQ ID NO: 11258 - DNA, 20 bp, human
ggccctggctgtcttctcgg

SEQ ID NO: 11259 - DNA, 20 bp, human
gccgctgtcacaggcgctcg

SEQ ID NO: 11260 - DNA, 20 bp, human
ggggcctctgccgacctcag

SEQ ID NO: 11261 - DNA, 20 bp, human
gacctccgagaagacagcca

SEQ ID NO: 11262 - DNA, 20 bp, human
gggcgagccggtgccccatc

SEQ ID NO: 11263 - DNA, 20 bp, human
gcaggctgaggcgcacgttc

SEQ ID NO: 11264 - DNA, 20 bp, human
gtattccagcggcgagacag

SEQ ID NO: 11265 - DNA, 20 bp, human
gcgcgtgaagagcctgggtc

SEQ ID NO: 11266 - DNA, 20 bp, human
gccaggtagattctatcctc

SEQ ID NO: 11267 - DNA, 20 bp, human
gtctagggctatcagaaata

SEQ ID NO: 11268 - DNA, 20 bp, human
gtagtgaaggtggagctcgt

SEQ ID NO: 11269 - DNA, 20 bp, human
gtcactagggccaacgaacc

SEQ ID NO: 11270 - DNA, 20 bp, human
gtccctcctagggagaaatc

SEQ ID NO: 11271 - DNA, 20 bp, human
gggctatcagaaatagggag

SEQ ID NO: 11272 - DNA, 20 bp, human
ggggaatttcagggacatgg

SEQ ID NO: 11273 - DNA, 20 bp, human
gcttcatggcctccctccta

SEQ ID NO: 11274 - DNA, 20 bp, human
gcaacgaaccgggaatttca

SEQ ID NO: 11275 - DNA, 20 bp, human
gctagccatgacaggaacct

SEQ ID NO: 11276 - DNA, 20 bp, human
gcccggtaccggctcctcct

SEQ ID NO: 11277 - DNA, 20 bp, human
gagcgcccgcagcccggtac

SEQ ID NO: 11278 - DNA, 20 bp, human
ggtcacttggcgctgaccag

SEQ ID NO: 11279 - DNA, 20 bp, human
gagcggtccgggctcagggt

SEQ ID NO: 11280 - DNA, 20 bp, human
gggtccgggctcagggtcgg

SEQ ID NO: 11281 - DNA, 20 bp, human
gcggaactcctccaggacca

SEQ ID NO: 11282 - DNA, 20 bp, human
gaggggtctgtcccaagaga

SEQ ID NO: 11283 - DNA, 20 bp, human
gcaagagagggagggctact

SEQ ID NO: 11284 - DNA, 20 bp, human
gagatcagcacgatgttggg

SEQ ID NO: 11285 - DNA, 20 bp, human
ggcggtgcccccatggacat

SEQ ID NO: 11286 - DNA, 20 bp, human
gggcgccgcgtacctggtag

SEQ ID NO: 11287 - DNA, 20 bp, human
gaccgcgggcggacaaggat

SEQ ID NO: 11288 - DNA, 20 bp, human
gccagcgcccgcggcctcaa

SEQ ID NO: 11289 - DNA, 20 bp, human
gcgcggagccagctgctcac

SEQ ID NO: 11290 - DNA, 20 bp, human
ggccgccgggacccataact

SEQ ID NO: 11291 - DNA, 20 bp, human
ggcggcctcaagggccgggt

SEQ ID NO: 11292 - DNA, 20 bp, human
gccgggacccataactgggt

SEQ ID NO: 11293 - DNA, 20 bp, human
gtccgcgacggcgtgcacag

SEQ ID NO: 11294 - DNA, 20 bp, human
gccgccagcgcgtccaggtg

SEQ ID NO: 11295 - DNA, 20 bp, human
gccagcaagaagaccaggtg

SEQ ID NO: 11296 - DNA, 20 bp, human
gaggctggccgggacccgga

SEQ ID NO: 11297 - DNA, 20 bp, human
gaactgaagggaaggcggaa

SEQ ID NO: 11298 - DNA, 20 bp, human
ggagcctgggcccctgtaaa

SEQ ID NO: 11299 - DNA, 20 bp, human
gtggaggagaccgaactgaa

SEQ ID NO: 11300 - DNA, 20 bp, human
ggcggaagccttggcactag

SEQ ID NO: 11301 - DNA, 20 bp, human
gagctgggcgtggaaggcgg

SEQ ID NO: 11302 - DNA, 20 bp, human
ggatcccgcagctgagaggg

SEQ ID NO: 11303 - DNA, 20 bp, human
ggggcgactgaggggacgaa

SEQ ID NO: 11304 - DNA, 20 bp, human
gcgggacgcggcccatacta

SEQ ID NO: 11305 - DNA, 20 bp, human
gtgtagctgggcgtggaagg

SEQ ID NO: 11306 - DNA, 20 bp, human
gtcctaggcctgtaagtcac

SEQ ID NO: 11307 - DNA, 20 bp, human
ggaggaaggttctctcccaa

SEQ ID NO: 11308 - DNA, 20 bp, human
gccaaaggaagcaagcgtga

SEQ ID NO: 11309 - DNA, 20 bp, human
gtgaatccccgatcaagaag

SEQ ID NO: 11310 - DNA, 20 bp, human
gggcagagagcacttgcaca

SEQ ID NO: 11311 - DNA, 20 bp, human
gaccttcctcttcttgatcg

SEQ ID NO: 11312 - DNA, 20 bp, human
gacccgtgacttacaggcct

SEQ ID NO: 11313 - DNA, 20 bp, human
gggatttgggctccgtgacc

SEQ ID NO: 11314 - DNA, 20 bp, human
gtgaccaggcatgaatagcg

SEQ ID NO: 11315 - DNA, 20 bp, human
gaaacgtacccgtgacttac

SEQ ID NO: 11316 - DNA, 20 bp, human
ggtctaggagcagaacagac

SEQ ID NO: 11317 - DNA, 20 bp, human
gtcgaggcagctgccaaaag

SEQ ID NO: 11318 - DNA, 20 bp, human
ggagagataatacggctgat

SEQ ID NO: 11319 - DNA, 20 bp, human
gcagcttaggcactgagaaa

SEQ ID NO: 11320 - DNA, 20 bp, human
ggggtatgagagtaacagaa

SEQ ID NO: 11321 - DNA, 20 bp, human
gctatgcccgtttctaccag

SEQ ID NO: 11322 - DNA, 20 bp, human
gctcaatggatcatcagctt

SEQ ID NO: 11323 - DNA, 20 bp, human
gttttaacctctggtagaaa

SEQ ID NO: 11324 - DNA, 20 bp, human
gtaacttgcagactacagat

SEQ ID NO: 11325 - DNA, 20 bp, human
gtacggctgataggtgagtt

SEQ ID NO: 11326 - DNA, 20 bp, human
gctgctgggcccgccggcct

SEQ ID NO: 11327 - DNA, 20 bp, human
ggccggcggttcgcagctgc

SEQ ID NO: 11328 - DNA, 20 bp, human
gaccctgggtcgctgacgcc

SEQ ID NO: 11329 - DNA, 20 bp, human
gccccgggcgcggaaacagg

SEQ ID NO: 11330 - DNA, 20 bp, human
ggccccgccggggaagtccc

SEQ ID NO: 11331 - DNA, 20 bp, human
gacggcagcagagcagtgag

SEQ ID NO: 11332 - DNA, 20 bp, human
gtggaaagtcaggaccgcga

SEQ ID NO: 11333 - DNA, 20 bp, human
gcggcggggctcagaagtgt

SEQ ID NO: 11334 - DNA, 20 bp, human
gagtccccgggcgcggaaac

SEQ ID NO: 11335 - DNA, 20 bp, human
gggaaacgcgtcgctgtccc

SEQ ID NO: 11336 - DNA, 20 bp, human
gccatcagcaggacaatgtt

SEQ ID NO: 11337 - DNA, 20 bp, human
gtgctgatggcagatgacct

SEQ ID NO: 11338 - DNA, 20 bp, human
ggcacaaatcccccactcca

SEQ ID NO: 11339 - DNA, 20 bp, human
gtggcagatgaccttggagt

SEQ ID NO: 11340 - DNA, 20 bp, human
gagggagactcccacataca

SEQ ID NO: 11341 - DNA, 20 bp, human
gagcaggacaatgttgggtc

SEQ ID NO: 11342 - DNA, 20 bp, human
gctacggtaataactcagtg

SEQ ID NO: 11343 - DNA, 20 bp, human
gttatcggcaggaatagcag

SEQ ID NO: 11344 - DNA, 20 bp, human
ggagactcccacatacaggg

SEQ ID NO: 11345 - DNA, 20 bp, human
ggctagaatctaaggaaact

SEQ ID NO: 11346 - DNA, 20 bp, human
ggcgggtcgaggggacacgg

SEQ ID NO: 11347 - DNA, 20 bp, human
gaggaggcgggagaaatcca

SEQ ID NO: 11348 - DNA, 20 bp, human
gtgggcgggtcgaggggaca

SEQ ID NO: 11349 - DNA, 20 bp, human
gggggagggaggcacaagtt

SEQ ID NO: 11350 - DNA, 20 bp, human
gacactggaccgtccccggg

SEQ ID NO: 11351 - DNA, 20 bp, human
gccagtcccggaccagacac

SEQ ID NO: 11352 - DNA, 20 bp, human
gagggaggcacaagttgggc

SEQ ID NO: 11353 - DNA, 20 bp, human
ggacggtccagtgtctggtc

SEQ ID NO: 11354 - DNA, 20 bp, human
gcagatccggcccagccgtc

SEQ ID NO: 11355 - DNA, 20 bp, human
gcacaagttgggcgggtcga

SEQ ID NO: 11356 - DNA, 20 bp, human
gtcaggaggccggtccacta

SEQ ID NO: 11357 - DNA, 20 bp, human
ggccagagcgccctcgacgt

SEQ ID NO: 11358 - DNA, 20 bp, human
gctgggagtgctggtacgga

SEQ ID NO: 11359 - DNA, 20 bp, human
gtagttggcgcacccggcgc

SEQ ID NO: 11360 - DNA, 20 bp, human
gtctcctgggagtgctggta

SEQ ID NO: 11361 - DNA, 20 bp, human
gagccgggtccctagccccg

SEQ ID NO: 11362 - DNA, 20 bp, human
gaactacgcaaagaccaagc

SEQ ID NO: 11363 - DNA, 20 bp, human
gggagtgctggtacggaggg

SEQ ID NO: 11364 - DNA, 20 bp, human
gggagcctgaaggccaaagc

SEQ ID NO: 11365 - DNA, 20 bp, human
ggcctcgctccccaacgtcg

SEQ ID NO: 11366 - DNA, 20 bp, human
ggtcgcagccttggcgctgg

SEQ ID NO: 11367 - DNA, 20 bp, human
gtgcgcgctctccgcctgat

SEQ ID NO: 11368 - DNA, 20 bp, human
ggggagagaacgccagaggg

SEQ ID NO: 11369 - DNA, 20 bp, human
ggcagtagcatcgccggtag

SEQ ID NO: 11370 - DNA, 20 bp, human
ggctagggagagaacgccag

SEQ ID NO: 11371 - DNA, 20 bp, human
gtgcctcgcggtacttacga

SEQ ID NO: 11372 - DNA, 20 bp, human
gtagttctgcgggtgaagct

SEQ ID NO: 11373 - DNA, 20 bp, human
gactcccaaagcttgcagtt

SEQ ID NO: 11374 - DNA, 20 bp, human
ggtactggcccccggagcag

SEQ ID NO: 11375 - DNA, 20 bp, human
gtgaggtcgccgatccccag

SEQ ID NO: 11376 - DNA, 20 bp, human
gccaggacaaggcctaggta

SEQ ID NO: 11377 - DNA, 20 bp, human
gagatgtggtgggaaccgga

SEQ ID NO: 11378 - DNA, 20 bp, human
gccttggtgaccagtgtcag

SEQ ID NO: 11379 - DNA, 20 bp, human
gagtggtgcactccttacct

SEQ ID NO: 11380 - DNA, 20 bp, human
gacagaagcgcagctccctt

SEQ ID NO: 11381 - DNA, 20 bp, human
gggtgggaaccggagggatg

SEQ ID NO: 11382 - DNA, 20 bp, human
gagtgtcaggggagatgtgg

SEQ ID NO: 11383 - DNA, 20 bp, human
gttgggagccatgggaagtt

SEQ ID NO: 11384 - DNA, 20 bp, human
gtgggatacctaggaaggtt

SEQ ID NO: 11385 - DNA, 20 bp, human
gagctcccttgggctagaaa

SEQ ID NO: 11386 - DNA, 20 bp, human
ggcttaccacaactgagagt

SEQ ID NO: 11387 - DNA, 20 bp, human
ggactccccactctcagttg

SEQ ID NO: 11388 - DNA, 20 bp, human
ggtaagcaagtcttcaggat

SEQ ID NO: 11389 - DNA, 20 bp, human
gatgagaatgaacagcacag

SEQ ID NO: 11390 - DNA, 20 bp, human
gtgacagtgagagctgagac

SEQ ID NO: 11391 - DNA, 20 bp, human
ggaatccagaatatggtgat

SEQ ID NO: 11392 - DNA, 20 bp, human
gaaatactgggatgaatatt

SEQ ID NO: 11393 - DNA, 20 bp, human
gtcacttaaacttcctccaa

SEQ ID NO: 11394 - DNA, 20 bp, human
gagagtggggagtcagtttg

SEQ ID NO: 11395 - DNA, 20 bp, human
ggccaaaatgatctataaaa

SEQ ID NO: 11396 - DNA, 20 bp, human
gtggcagcaaacgtacccag

SEQ ID NO: 11397 - DNA, 20 bp, human
gtcagtgaggaggttatacc

SEQ ID NO: 11398 - DNA, 20 bp, human
ggtgaggaggttatacccgg

SEQ ID NO: 11399 - DNA, 20 bp, human
gagcgagcgtcgagacctcc

SEQ ID NO: 11400 - DNA, 20 bp, human
gggcccttcggataagagaa

SEQ ID NO: 11401 - DNA, 20 bp, human
gcctccggctggatcagcac

SEQ ID NO: 11402 - DNA, 20 bp, human
gccttcggataagagaaagg

SEQ ID NO: 11403 - DNA, 20 bp, human
ggatagcaagcggaatggga

SEQ ID NO: 11404 - DNA, 20 bp, human
gtccagaaccttcttcagtg

SEQ ID NO: 11405 - DNA, 20 bp, human
ggaggctgcgggccgctcag

SEQ ID NO: 11406 - DNA, 20 bp, human
gttgcaggaggtacagtagt

SEQ ID NO: 11407 - DNA, 20 bp, human
gtgatctagtctgtattcag

SEQ ID NO: 11408 - DNA, 20 bp, human
gctgacacttaacaggactt

SEQ ID NO: 11409 - DNA, 20 bp, human
ggaatggcagcaggcctcca

SEQ ID NO: 11410 - DNA, 20 bp, human
ggatgaagctgcaagggcaa

SEQ ID NO: 11411 - DNA, 20 bp, human
gctacctcagaaccctctgt

SEQ ID NO: 11412 - DNA, 20 bp, human
gcaagctattggttgttggt

SEQ ID NO: 11413 - DNA, 20 bp, human
gagattctcatcgttgcagg

SEQ ID NO: 11414 - DNA, 20 bp, human
gggtagggggacaattgagg

SEQ ID NO: 11415 - DNA, 20 bp, human
gcagatgcgcacaccaaata

SEQ ID NO: 11416 - DNA, 20 bp, human
gtcccgtgcgcctggagaca

SEQ ID NO: 11417 - DNA, 20 bp, human
gctggagtcctggtttcgag

SEQ ID NO: 11418 - DNA, 20 bp, human
gtccaggcgcacgggatccc

SEQ ID NO: 11419 - DNA, 20 bp, human
ggaggtggggaggagaacgt

SEQ ID NO: 11420 - DNA, 20 bp, human
gtgcgctgggagatgagagg

SEQ ID NO: 11421 - DNA, 20 bp, human
gccccgcaggccttgagaaa

SEQ ID NO: 11422 - DNA, 20 bp, human
gaccctgtctccaggcgcac

SEQ ID NO: 11423 - DNA, 20 bp, human
gcccgccggggccctaatcc

SEQ ID NO: 11424 - DNA, 20 bp, human
ggaggagacgtgagggccag

SEQ ID NO: 11425 - DNA, 20 bp, human
gatccctggaggagacgtga

SEQ ID NO: 11426 - DNA, 20 bp, human
gctgccaggtgtacagtcct

SEQ ID NO: 11427 - DNA, 20 bp, human
ggcccccagacaaggcccgg

SEQ ID NO: 11428 - DNA, 20 bp, human
ggccagtctgcaccctgtag

SEQ ID NO: 11429 - DNA, 20 bp, human
ggagcccccgggccttgtct

SEQ ID NO: 11430 - DNA, 20 bp, human
gccgagggcccaagagaggg

SEQ ID NO: 11431 - DNA, 20 bp, human
gtgacaccggacggctgcgg

SEQ ID NO: 11432 - DNA, 20 bp, human
gatgcccaggactgtacacc

SEQ ID NO: 11433 - DNA, 20 bp, human
gtgctgctggcggagccccc

SEQ ID NO: 11434 - DNA, 20 bp, human
ggccgctacagggtgcagac

SEQ ID NO: 11435 - DNA, 20 bp, human
gagcgacaagagggactgag

SEQ ID NO: 11436 - DNA, 20 bp, human
gctgagatcaggccgggcat

SEQ ID NO: 11437 - DNA, 20 bp, human
ggcatgggctcctagctgtg

SEQ ID NO: 11438 - DNA, 20 bp, human
gggctcctagctgtgtggag

SEQ ID NO: 11439 - DNA, 20 bp, human
gctgtcctcgggctgagatc

SEQ ID NO: 11440 - DNA, 20 bp, human
gtggaggggaaactcaggaa

SEQ ID NO: 11441 - DNA, 20 bp, human
ggtgcagtggaagagcccgg

SEQ ID NO: 11442 - DNA, 20 bp, human
gctcgggctgagatcaggcc

SEQ ID NO: 11443 - DNA, 20 bp, human
gggaggaaggacctcaagga

SEQ ID NO: 11444 - DNA, 20 bp, human
ggcgtcgcagaggcctccct

SEQ ID NO: 11445 - DNA, 20 bp, human
gtcaaggaggggctgtcctc

SEQ ID NO: 11446 - DNA, 20 bp, human
gggaccggaccgacagacag

SEQ ID NO: 11447 - DNA, 20 bp, human
ggagtggaaatgggcaacgg

SEQ ID NO: 11448 - DNA, 20 bp, human
gctgtactggcaggaggccg

SEQ ID NO: 11449 - DNA, 20 bp, human
ggttctggactgcagttgag

SEQ ID NO: 11450 - DNA, 20 bp, human
gcctaagccggcgaacggac

SEQ ID NO: 11451 - DNA, 20 bp, human
gcgacagacagaggtagatg

SEQ ID NO: 11452 - DNA, 20 bp, human
ggactgcagttgagtggaaa

SEQ ID NO: 11453 - DNA, 20 bp, human
ggtatgagaaaagcgctgtc

SEQ ID NO: 11454 - DNA, 20 bp, human
gggaaatgggcaacggcggg

SEQ ID NO: 11455 - DNA, 20 bp, human
gcagaggaccctgctcctcg

SEQ ID NO: 11456 - DNA, 20 bp, human
gcatcgggccgggactcggg

SEQ ID NO: 11457 - DNA, 20 bp, human
ggtccccaggcacctgtcct

SEQ ID NO: 11458 - DNA, 20 bp, human
ggcccgccctgcatacccgg

SEQ ID NO: 11459 - DNA, 20 bp, human
gggtccgggccggtgccaag

SEQ ID NO: 11460 - DNA, 20 bp, human
ggaggagggtcaaactgcca

SEQ ID NO: 11461 - DNA, 20 bp, human
gagaagcgtccatccggtcc

SEQ ID NO: 11462 - DNA, 20 bp, human
gcggctccgcggaacaaaag

SEQ ID NO: 11463 - DNA, 20 bp, human
gccccccaggccccgcggat

SEQ ID NO: 11464 - DNA, 20 bp, human
gaacaaaagcgggtcctccc

SEQ ID NO: 11465 - DNA, 20 bp, human
gcggccgaactcagacaggt

SEQ ID NO: 11466 - DNA, 20 bp, human
ggcgcgcaacccgagacccc

SEQ ID NO: 11467 - DNA, 20 bp, human
gttgcgcacgggccgcgtga

SEQ ID NO: 11468 - DNA, 20 bp, human
ggagcgcgcggacaagacgc

SEQ ID NO: 11469 - DNA, 20 bp, human
gccggacagggtcctatccc

SEQ ID NO: 11470 - DNA, 20 bp, human
ggcggcctcggaccccagaa

SEQ ID NO: 11471 - DNA, 20 bp, human
gcgcggacaagacgcgggtg

SEQ ID NO: 11472 - DNA, 20 bp, human
ggagggtctgggccggacgt

SEQ ID NO: 11473 - DNA, 20 bp, human
ggccgcaactcggaccggtg

SEQ ID NO: 11474 - DNA, 20 bp, human
gatccctggagtcgagatcc

SEQ ID NO: 11475 - DNA, 20 bp, human
gctgcggcgtccgagacccc

SEQ ID NO: 11476 - DNA, 20 bp, human
gcccgtcaggcacttactaa

SEQ ID NO: 11477 - DNA, 20 bp, human
gtctccgcgctcaggacaag

SEQ ID NO: 11478 - DNA, 20 bp, human
gaggtaaggatgctcccgtc

SEQ ID NO: 11479 - DNA, 20 bp, human
ggaaaaggccgtgcaaggta

SEQ ID NO: 11480 - DNA, 20 bp, human
gatgctgtcgatgcagtagg

SEQ ID NO: 11481 - DNA, 20 bp, human
gatgagcaatcagtaccagg

SEQ ID NO: 11482 - DNA, 20 bp, human
gggtcggcgcggctggtcag

SEQ ID NO: 11483 - DNA, 20 bp, human
gtaacaagtgtagtgagcag

SEQ ID NO: 11484 - DNA, 20 bp, human
ggaggagcccgtgcaaaatg

SEQ ID NO: 11485 - DNA, 20 bp, human
ggcaatcagtaccaggagga

SEQ ID NO: 11486 - DNA, 20 bp, human
gcgagtcgctgcccgcagag

SEQ ID NO: 11487 - DNA, 20 bp, human
ggctgagggcaaggacggcg

SEQ ID NO: 11488 - DNA, 20 bp, human
gagggtggtcgcggtcgcag

SEQ ID NO: 11489 - DNA, 20 bp, human
gagagcgcacgcgggcccca

SEQ ID NO: 11490 - DNA, 20 bp, human
gtttcgggcgctctttggag

SEQ ID NO: 11491 - DNA, 20 bp, human
gccggaagacgctgagggca

SEQ ID NO: 11492 - DNA, 20 bp, human
gccagggagggacagcgggc

SEQ ID NO: 11493 - DNA, 20 bp, human
gtatgcgcgtagggtggtcg

SEQ ID NO: 11494 - DNA, 20 bp, human
gagtttgggtgagcaagggt

SEQ ID NO: 11495 - DNA, 20 bp, human
gagctggtagctggtgaacg

SEQ ID NO: 11496 - DNA, 20 bp, human
gccgactccaggagtcccgg

SEQ ID NO: 11497 - DNA, 20 bp, human
gcgtgcaggtgagagctgta

SEQ ID NO: 11498 - DNA, 20 bp, human
gggcctgcgactcaggacgg

SEQ ID NO: 11499 - DNA, 20 bp, human
ggagggagggggccagtaaa

SEQ ID NO: 11500 - DNA, 20 bp, human
ggccagacttccattagcct

SEQ ID NO: 11501 - DNA, 20 bp, human
ggtctcgagacacagctcgg

SEQ ID NO: 11502 - DNA, 20 bp, human
ggcctaggctaatggaagtc

SEQ ID NO: 11503 - DNA, 20 bp, human
gggactcctggagtcggggt

SEQ ID NO: 11504 - DNA, 20 bp, human
gggagcaagcctgccagcct

SEQ ID NO: 11505 - DNA, 20 bp, human
gagtcccgggggacagggtg

SEQ ID NO: 11506 - DNA, 20 bp, human
gaggcgacgcaactccggcc

SEQ ID NO: 11507 - DNA, 20 bp, human
gactccccggactccagcag

SEQ ID NO: 11508 - DNA, 20 bp, human
ggcgacggcacagctgacgg

SEQ ID NO: 11509 - DNA, 20 bp, human
gcacccgtggcgcctcgatg

SEQ ID NO: 11510 - DNA, 20 bp, human
gttgcctctgctggagtccg

SEQ ID NO: 11511 - DNA, 20 bp, human
gtccaggaagtgcaacccag

SEQ ID NO: 11512 - DNA, 20 bp, human
gtggctgctagagcgatgcc

SEQ ID NO: 11513 - DNA, 20 bp, human
gagcagccaacgccactccc

SEQ ID NO: 11514 - DNA, 20 bp, human
ggcgcgactgtgtccacgga

SEQ ID NO: 11515 - DNA, 20 bp, human
ggacgcgagtagctcggcag

SEQ ID NO: 11516 - DNA, 20 bp, human
gattcgtcaaggtctagtaa

SEQ ID NO: 11517 - DNA, 20 bp, human
ggatggcactcatcattaca

SEQ ID NO: 11518 - DNA, 20 bp, human
gcacagctcaagattcgtca

SEQ ID NO: 11519 - DNA, 20 bp, human
gggagaaaatgatgtctaca

SEQ ID NO: 11520 - DNA, 20 bp, human
ggaaaatgatgtctacaagg

SEQ ID NO: 11521 - DNA, 20 bp, human
gggcactcatcattacaagg

SEQ ID NO: 11522 - DNA, 20 bp, human
gggaccattgaaaaccacaa

SEQ ID NO: 11523 - DNA, 20 bp, human
gaaagggagacggctattcc

SEQ ID NO: 11524 - DNA, 20 bp, human
gttctcaggtacagcagaga

SEQ ID NO: 11525 - DNA, 20 bp, human
gccacaaaggcaagtgtcat

SEQ ID NO: 11526 - DNA, 20 bp, human
gccataacgtcaaggaacac

SEQ ID NO: 11527 - DNA, 20 bp, human
gaggcgtgcccgggagtcgt

SEQ ID NO: 11528 - DNA, 20 bp, human
gccctgcagagagcctgacg

SEQ ID NO: 11529 - DNA, 20 bp, human
gacgtcaaggaacaccggct

SEQ ID NO: 11530 - DNA, 20 bp, human
gtaacccggaggaccaggga

SEQ ID NO: 11531 - DNA, 20 bp, human
ggtcgttgggagagggaacg

SEQ ID NO: 11532 - DNA, 20 bp, human
gaagataacccggaggacca

SEQ ID NO: 11533 - DNA, 20 bp, human
gggaacaccggctgggagtt

SEQ ID NO: 11534 - DNA, 20 bp, human
gaggtccgcttccacaccgc

SEQ ID NO: 11535 - DNA, 20 bp, human
gagaaacattagtacagctt

SEQ ID NO: 11536 - DNA, 20 bp, human
gccgagcgcggcgcaggaag

SEQ ID NO: 11537 - DNA, 20 bp, human
gcagtgctcgcccgcggcag

SEQ ID NO: 11538 - DNA, 20 bp, human
gagcgcacagtgctcgcccg

SEQ ID NO: 11539 - DNA, 20 bp, human
gccagcggcccgccaggtcc

SEQ ID NO: 11540 - DNA, 20 bp, human
gcttcttcgcgcgagagact

SEQ ID NO: 11541 - DNA, 20 bp, human
gcgcgcggccaggctctgcg

SEQ ID NO: 11542 - DNA, 20 bp, human
gctcgcctccagctcgggag

SEQ ID NO: 11543 - DNA, 20 bp, human
gagggggcgcccgcgactgt

SEQ ID NO: 11544 - DNA, 20 bp, human
ggggaaagcgaactgcgacc

SEQ ID NO: 11545 - DNA, 20 bp, human
gggggacgcgaaacccccca

SEQ ID NO: 11546 - DNA, 20 bp, human
gctcagagcgagccccgagg

SEQ ID NO: 11547 - DNA, 20 bp, human
gtcgctctgagaggacgcgg

SEQ ID NO: 11548 - DNA, 20 bp, human
gggctcgctctgagaggacg

SEQ ID NO: 11549 - DNA, 20 bp, human
gcctctcagagcgagccccg

SEQ ID NO: 11550 - DNA, 20 bp, human
gactgtggcggccatcgagg

SEQ ID NO: 11551 - DNA, 20 bp, human
gggccgcctcacctcctcga

SEQ ID NO: 11552 - DNA, 20 bp, human
gggcggccatcgaggaggtg

SEQ ID NO: 11553 - DNA, 20 bp, human
gcgaggcgggcgcgcacagc

SEQ ID NO: 11554 - DNA, 20 bp, human
gctggggcgcgggatacctg

SEQ ID NO: 11555 - DNA, 20 bp, human
ggatggccgccacagtgttc

SEQ ID NO: 11556 - DNA, 20 bp, human
gcggcgacgctgaactgctc

SEQ ID NO: 11557 - DNA, 20 bp, human
gaagatgccccggtaccgag

SEQ ID NO: 11558 - DNA, 20 bp, human
gacgctgaactgctccggca

SEQ ID NO: 11559 - DNA, 20 bp, human
gtgaactgctccggcatggc

SEQ ID NO: 11560 - DNA, 20 bp, human
ggatgacaaactccacaggt

SEQ ID NO: 11561 - DNA, 20 bp, human
ggacaaactccacaggtcgg

SEQ ID NO: 11562 - DNA, 20 bp, human
gccccggccggcggtgaggc

SEQ ID NO: 11563 - DNA, 20 bp, human
gacctcgaggccccccaaaa

SEQ ID NO: 11564 - DNA, 20 bp, human
ggacacgcctgtggaggtca

SEQ ID NO: 11565 - DNA, 20 bp, human
ggtcctcaccgtcgaggcgg

SEQ ID NO: 11566 - DNA, 20 bp, human
gcagagggtagccctaggga

SEQ ID NO: 11567 - DNA, 20 bp, human
ggaggcggaagcatccatgg

SEQ ID NO: 11568 - DNA, 20 bp, human
ggcggaggcggaagcatcca

SEQ ID NO: 11569 - DNA, 20 bp, human
gcggccctgcccgcccgtct

SEQ ID NO: 11570 - DNA, 20 bp, human
gcagccagagggtagcccta

SEQ ID NO: 11571 - DNA, 20 bp, human
gtgacccgcgcacgcccctc

SEQ ID NO: 11572 - DNA, 20 bp, human
gaaagtgcctgccctcccta

SEQ ID NO: 11573 - DNA, 20 bp, human
gggagggcggcagcccagac

SEQ ID NO: 11574 - DNA, 20 bp, human
gcaaccgcaaaagtaggacg

SEQ ID NO: 11575 - DNA, 20 bp, human
gcggcgccgagggcaatggg

SEQ ID NO: 11576 - DNA, 20 bp, human
gggccaaggtgtaggctatt

SEQ ID NO: 11577 - DNA, 20 bp, human
gccagggcatggcttgttct

SEQ ID NO: 11578 - DNA, 20 bp, human
gcccagatggtgtccccagt

SEQ ID NO: 11579 - DNA, 20 bp, human
ggtcggggagaaacagccgg

SEQ ID NO: 11580 - DNA, 20 bp, human
gtgttcttgggccaaggtgt

SEQ ID NO: 11581 - DNA, 20 bp, human
ggccaggtccccggtgtaga

SEQ ID NO: 11582 - DNA, 20 bp, human
ggcgatgttgctggtggact

SEQ ID NO: 11583 - DNA, 20 bp, human
gatgcccctcacccctctgg

SEQ ID NO: 11584 - DNA, 20 bp, human
gcagccaccagaggggtgag

SEQ ID NO: 11585 - DNA, 20 bp, human
gggagggaaggcaccccaga

SEQ ID NO: 11586 - DNA, 20 bp, human
gaaatagaaaagaagcggct

SEQ ID NO: 11587 - DNA, 20 bp, human
gtagcagaagagatctatgg

SEQ ID NO: 11588 - DNA, 20 bp, human
gaagatggtcctgttttcta

SEQ ID NO: 11589 - DNA, 20 bp, human
gatgctctgtatagggtcct

SEQ ID NO: 11590 - DNA, 20 bp, human
gtttggcttatgctctgtat

SEQ ID NO: 11591 - DNA, 20 bp, human
gtatatacaagtaattactt

SEQ ID NO: 11592 - DNA, 20 bp, human
gctagtcatatgaattatct

SEQ ID NO: 11593 - DNA, 20 bp, human
gtggctgcatcaatttgtgg

SEQ ID NO: 11594 - DNA, 20 bp, human
gttttaaagccatagaaaac

SEQ ID NO: 11595 - DNA, 20 bp, human
ggacgatatagaaatgggtt

SEQ ID NO: 11596 - DNA, 20 bp, human
gagtccaacaaagtcaatat

SEQ ID NO: 11597 - DNA, 20 bp, human
gtctgatgcttcgtccttgg

SEQ ID NO: 11598 - DNA, 20 bp, human
gcattctgatgcttcgtcct

SEQ ID NO: 11599 - DNA, 20 bp, human
gtttgtcacacatttcaggg

SEQ ID NO: 11600 - DNA, 20 bp, human
gaataatgcgcaggtgcaac

SEQ ID NO: 11601 - DNA, 20 bp, human
gtctgagttgtctagtgtat

SEQ ID NO: 11602 - DNA, 20 bp, human
gtatcagaaggtccggacca

SEQ ID NO: 11603 - DNA, 20 bp, human
gaatttgtcaatttgggcaa

SEQ ID NO: 11604 - DNA, 20 bp, human
gcagaacgtatcagaaggtc

SEQ ID NO: 11605 - DNA, 20 bp, human
gaaagacagaaataatgcgc

SEQ ID NO: 11606 - DNA, 20 bp, human
ggccccttggaccaagacta

SEQ ID NO: 11607 - DNA, 20 bp, human
gtatgtctgcctaggacctc

SEQ ID NO: 11608 - DNA, 20 bp, human
gtatcctcttgggacacaca

SEQ ID NO: 11609 - DNA, 20 bp, human
gcaacggcattgttaacagt

SEQ ID NO: 11610 - DNA, 20 bp, human
gcctccttagggagccccca

SEQ ID NO: 11611 - DNA, 20 bp, human
gagcccccacggccccaacc

SEQ ID NO: 11612 - DNA, 20 bp, human
gccctggtgtcccctcctta

SEQ ID NO: 11613 - DNA, 20 bp, human
ggactagccaacaccacaca

SEQ ID NO: 11614 - DNA, 20 bp, human
gacgggaagtgggtgatcac

SEQ ID NO: 11615 - DNA, 20 bp, human
gcaggtctgtgggcccgcag

SEQ ID NO: 11616 - DNA, 20 bp, human
gtagatgctaccaccaggag

SEQ ID NO: 11617 - DNA, 20 bp, human
gctcctgcagcccgacaagg

SEQ ID NO: 11618 - DNA, 20 bp, human
gaagctggtgcctctcctgg

SEQ ID NO: 11619 - DNA, 20 bp, human
gaaagctaaactaccagtct

SEQ ID NO: 11620 - DNA, 20 bp, human
gatggtctaggagctcctgc

SEQ ID NO: 11621 - DNA, 20 bp, human
gtgctcacagctgcccgtga

SEQ ID NO: 11622 - DNA, 20 bp, human
gctcctagaccatggtgcag

SEQ ID NO: 11623 - DNA, 20 bp, human
gggcctctgcaccatggtct

SEQ ID NO: 11624 - DNA, 20 bp, human
gaaaagctggtccaaagtat

SEQ ID NO: 11625 - DNA, 20 bp, human
ggacttgcaaacagctcaag

SEQ ID NO: 11626 - DNA, 20 bp, human
ggtggtggcgcgccccgcgc

SEQ ID NO: 11627 - DNA, 20 bp, human
gcgggggcgtttggcggggt

SEQ ID NO: 11628 - DNA, 20 bp, human
ggtgagccgcatggagcccc

SEQ ID NO: 11629 - DNA, 20 bp, human
gcgccgcccggggctccatg

SEQ ID NO: 11630 - DNA, 20 bp, human
ggcggccgcgcggcgactct

SEQ ID NO: 11631 - DNA, 20 bp, human
gagagcctgggaaacgccca

SEQ ID NO: 11632 - DNA, 20 bp, human
ggaagccaggcgcgagccca

SEQ ID NO: 11633 - DNA, 20 bp, human
gagagcccgtctgggatgcg

SEQ ID NO: 11634 - DNA, 20 bp, human
gtccccgagagggagcaccg

SEQ ID NO: 11635 - DNA, 20 bp, human
gggaggtcagagcgaggcag

SEQ ID NO: 11636 - DNA, 20 bp, human
gaacttcactgctgtcctag

SEQ ID NO: 11637 - DNA, 20 bp, human
gttaagtcaatggctactca

SEQ ID NO: 11638 - DNA, 20 bp, human
gtcagcatcacactgtgtgt

SEQ ID NO: 11639 - DNA, 20 bp, human
gagtgttgtcagtgttagag

SEQ ID NO: 11640 - DNA, 20 bp, human
gcgaagtcttatttgaaagg

SEQ ID NO: 11641 - DNA, 20 bp, human
gaccttttgttttatcctct

SEQ ID NO: 11642 - DNA, 20 bp, human
gttactaggcaatatctaaa

SEQ ID NO: 11643 - DNA, 20 bp, human
gctaatttttgttgaatctg

SEQ ID NO: 11644 - DNA, 20 bp, human
gaaccgaagtcttatttgaa

SEQ ID NO: 11645 - DNA, 20 bp, human
gagtgaagttttcactgtta

SEQ ID NO: 11646 - DNA, 20 bp, human
ggaagcacacattggctcca

SEQ ID NO: 11647 - DNA, 20 bp, human
ggatacacagaagcacacat

SEQ ID NO: 11648 - DNA, 20 bp, human
gatcttgtcattcttatcca

SEQ ID NO: 11649 - DNA, 20 bp, human
gtctaaacaggtaagcccgt

SEQ ID NO: 11650 - DNA, 20 bp, human
gttactatagaatcccagaa

SEQ ID NO: 11651 - DNA, 20 bp, human
gaagcccgtaggtgatcaag

SEQ ID NO: 11652 - DNA, 20 bp, human
gttcaataagctagttggtg

SEQ ID NO: 11653 - DNA, 20 bp, human
gtaaagaaatgtttcaatct

SEQ ID NO: 11654 - DNA, 20 bp, human
gaattaaaaaggctctaaac

SEQ ID NO: 11655 - DNA, 20 bp, human
gaactattcaataagctagt

SEQ ID NO: 11656 - DNA, 20 bp, human
gtggcctggtcggctgaaca

SEQ ID NO: 11657 - DNA, 20 bp, human
gaacccctgggccccatcca

SEQ ID NO: 11658 - DNA, 20 bp, human
gtggtcggctgaacagggta

SEQ ID NO: 11659 - DNA, 20 bp, human
gtagtcgggtcgagggaacc

SEQ ID NO: 11660 - DNA, 20 bp, human
gtcagagcaagggaggtagt

SEQ ID NO: 11661 - DNA, 20 bp, human
gggtctcggcaggaacggtg

SEQ ID NO: 11662 - DNA, 20 bp, human
gagggaggtagtcgggtcga

SEQ ID NO: 11663 - DNA, 20 bp, human
gagggtggctcctcagagca

SEQ ID NO: 11664 - DNA, 20 bp, human
gaaagggctgctatagtctg

SEQ ID NO: 11665 - DNA, 20 bp, human
gcggagagagcgcagcatgg

SEQ ID NO: 11666 - DNA, 20 bp, human
gtgtcaaaatatgtaactgg

SEQ ID NO: 11667 - DNA, 20 bp, human
ggaagcaattccacaaagtc

SEQ ID NO: 11668 - DNA, 20 bp, human
gtttctggttacagtttaaa

SEQ ID NO: 11669 - DNA, 20 bp, human
gtgacccaaaaactgtaggg

SEQ ID NO: 11670 - DNA, 20 bp, human
gatcactggcaaaaattctg

SEQ ID NO: 11671 - DNA, 20 bp, human
ggttacatattttgacaatg

SEQ ID NO: 11672 - DNA, 20 bp, human
gttgtaacctggcactgata

SEQ ID NO: 11673 - DNA, 20 bp, human
gtaaagggcacttctgtttg

SEQ ID NO: 11674 - DNA, 20 bp, human
gccaaggatttacagatcac

SEQ ID NO: 11675 - DNA, 20 bp, human
gcatattttgacaatgtggc

SEQ ID NO: 11676 - DNA, 20 bp, human
gtacctagcagcatgccggt

SEQ ID NO: 11677 - DNA, 20 bp, human
gtcgggaaggtaatccgagt

SEQ ID NO: 11678 - DNA, 20 bp, human
ggactttggagtcgctttag

SEQ ID NO: 11679 - DNA, 20 bp, human
gggacaggcttggaaaacaa

SEQ ID NO: 11680 - DNA, 20 bp, human
gcacggacagctgctgactt

SEQ ID NO: 11681 - DNA, 20 bp, human
ggttgagtgggtagtcggga

SEQ ID NO: 11682 - DNA, 20 bp, human
gcagcagctgtccgtgagag

SEQ ID NO: 11683 - DNA, 20 bp, human
ggactggatgaaagacccct

SEQ ID NO: 11684 - DNA, 20 bp, human
ggacgtaacaatgtccaact

SEQ ID NO: 11685 - DNA, 20 bp, human
gtgtcgcacacgcatgtaca

SEQ ID NO: 11686 - DNA, 20 bp, human
gcagggcagaaggaaaactc

SEQ ID NO: 11687 - DNA, 20 bp, human
gcaattcaggggtaatacaa

SEQ ID NO: 11688 - DNA, 20 bp, human
gctgttaggctctgaaacaa

SEQ ID NO: 11689 - DNA, 20 bp, human
gatgcacccggaggaacgga

SEQ ID NO: 11690 - DNA, 20 bp, human
gatgctattgttgggtctgt

SEQ ID NO: 11691 - DNA, 20 bp, human
gttcgatgcacccggaggaa

SEQ ID NO: 11692 - DNA, 20 bp, human
gctgtattcgatgcacccgg

SEQ ID NO: 11693 - DNA, 20 bp, human
gcaagaaaatacgagagaga

SEQ ID NO: 11694 - DNA, 20 bp, human
gttgttgggtctgtaggtct

SEQ ID NO: 11695 - DNA, 20 bp, human
ggaaacaagggtacaattca

SEQ ID NO: 11696 - DNA, 20 bp, human
ggaagggtgaggtgacggta

SEQ ID NO: 11697 - DNA, 20 bp, human
gcggcaagacgcgggcgcag

SEQ ID NO: 11698 - DNA, 20 bp, human
gagtcctgcatcatccagag

SEQ ID NO: 11699 - DNA, 20 bp, human
gaatgccgcagaggggtggt

SEQ ID NO: 11700 - DNA, 20 bp, human
gccgcggctcccgggatgcg

SEQ ID NO: 11701 - DNA, 20 bp, human
gctcccgggatgcgcggagg

SEQ ID NO: 11702 - DNA, 20 bp, human
ggggagccgcggcaagacgc

SEQ ID NO: 11703 - DNA, 20 bp, human
gaaagaatgccgcagagggg

SEQ ID NO: 11704 - DNA, 20 bp, human
gccacggccgagcagagcct

SEQ ID NO: 11705 - DNA, 20 bp, human
ggcaaaagaatgccgcagag

SEQ ID NO: 11706 - DNA, 20 bp, human
gaagtcctaggcccaagggt

SEQ ID NO: 11707 - DNA, 20 bp, human
gtttcaagtcctaggcccaa

SEQ ID NO: 11708 - DNA, 20 bp, human
ggctccagatttagtgacag

SEQ ID NO: 11709 - DNA, 20 bp, human
ggatttagtgacaggggcag

SEQ ID NO: 11710 - DNA, 20 bp, human
gatcacaacaaagcttccag

SEQ ID NO: 11711 - DNA, 20 bp, human
gaaacaaggtaaaaacatat

SEQ ID NO: 11712 - DNA, 20 bp, human
gtggagagtccacaaactgt

SEQ ID NO: 11713 - DNA, 20 bp, human
ggtctgggatttcaagtcct

SEQ ID NO: 11714 - DNA, 20 bp, human
gatccaaaggcaaatagatg

SEQ ID NO: 11715 - DNA, 20 bp, human
gagaacagcaccgagcaaac

SEQ ID NO: 11716 - DNA, 20 bp, human
gatgtgcctggctctcgtcc

SEQ ID NO: 11717 - DNA, 20 bp, human
gagcatcccggacgagagcc

SEQ ID NO: 11718 - DNA, 20 bp, human
gtcctcaggaccagctgttc

SEQ ID NO: 11719 - DNA, 20 bp, human
ggattcttctgcagcaatgt

SEQ ID NO: 11720 - DNA, 20 bp, human
ggctgcagaagaatctgcgg

SEQ ID NO: 11721 - DNA, 20 bp, human
gatagtgaaaggcaaccgca

SEQ ID NO: 11722 - DNA, 20 bp, human
gcaaccgcaaggaagcggca

SEQ ID NO: 11723 - DNA, 20 bp, human
ggccaggcacatttgagact

SEQ ID NO: 11724 - DNA, 20 bp, human
gtatccttgccgcttccttg

SEQ ID NO: 11725 - DNA, 20 bp, human
gatctgcggcggtctttagt

SEQ ID NO: 11726 - DNA, 20 bp, human
ggacgccgaccggaacgctc

SEQ ID NO: 11727 - DNA, 20 bp, human
gtggactggcggagcaggtg

SEQ ID NO: 11728 - DNA, 20 bp, human
gacaggacaggcaggcgaca

SEQ ID NO: 11729 - DNA, 20 bp, human
ggacaggcaggcgacagggt

SEQ ID NO: 11730 - DNA, 20 bp, human
ggcgcgggcaggaagtacga

SEQ ID NO: 11731 - DNA, 20 bp, human
gcaggagtgggatccgcgcg

SEQ ID NO: 11732 - DNA, 20 bp, human
ggccgaccggaacgctccgg

SEQ ID NO: 11733 - DNA, 20 bp, human
gttggactgaggagcggacc

SEQ ID NO: 11734 - DNA, 20 bp, human
gtcggggtcctggatcccca

SEQ ID NO: 11735 - DNA, 20 bp, human
gcccgagcggcaggagtctc

SEQ ID NO: 11736 - DNA, 20 bp, human
gctccactgcgggcgctgat

SEQ ID NO: 11737 - DNA, 20 bp, human
ggtgaccccaaagtgctgaa

SEQ ID NO: 11738 - DNA, 20 bp, human
gtgaggcaccgaggaggatc

SEQ ID NO: 11739 - DNA, 20 bp, human
ggatcaggaacaccagggtc

SEQ ID NO: 11740 - DNA, 20 bp, human
ggcccgaagtgccagccgtg

SEQ ID NO: 11741 - DNA, 20 bp, human
gccccaaagtgctgaaggga

SEQ ID NO: 11742 - DNA, 20 bp, human
gcgtggggtctccggacagg

SEQ ID NO: 11743 - DNA, 20 bp, human
gggccggaggcttccagcta

SEQ ID NO: 11744 - DNA, 20 bp, human
gcaggctcaggctccactgc

SEQ ID NO: 11745 - DNA, 20 bp, human
gggaggcttccagctacgga

SEQ ID NO: 11746 - DNA, 20 bp, human
ggtgagtgcggtccttggag

SEQ ID NO: 11747 - DNA, 20 bp, human
gctcggccaaggttctcccg

SEQ ID NO: 11748 - DNA, 20 bp, human
gtcccgccccgggagaacct

SEQ ID NO: 11749 - DNA, 20 bp, human
gcctgctgcgggagggcccg

SEQ ID NO: 11750 - DNA, 20 bp, human
ggggttgaaagccgctgtca

SEQ ID NO: 11751 - DNA, 20 bp, human
gccgcactcaccgaattgct

SEQ ID NO: 11752 - DNA, 20 bp, human
gctgtctcgctgaggctagg

SEQ ID NO: 11753 - DNA, 20 bp, human
gtcccgcagcaggtgcggtg

SEQ ID NO: 11754 - DNA, 20 bp, human
gggccaaggttctcccgggg

SEQ ID NO: 11755 - DNA, 20 bp, human
gaacagctctgatgcgaggg

SEQ ID NO: 11756 - DNA, 20 bp, human
ggagggttgggcagtttcag

SEQ ID NO: 11757 - DNA, 20 bp, human
gcatgcctctctctgatcac

SEQ ID NO: 11758 - DNA, 20 bp, human
ggatgggcggtgagtcatag

SEQ ID NO: 11759 - DNA, 20 bp, human
gtaatgtgcttaggagagga

SEQ ID NO: 11760 - DNA, 20 bp, human
gtgtccatggggctgttact

SEQ ID NO: 11761 - DNA, 20 bp, human
gtaggagagagcatcatgga

SEQ ID NO: 11762 - DNA, 20 bp, human
gtctgtgtgaggtgtccatg

SEQ ID NO: 11763 - DNA, 20 bp, human
gagtggaatcagccctgggg

SEQ ID NO: 11764 - DNA, 20 bp, human
gacattagccaacctcccca

SEQ ID NO: 11765 - DNA, 20 bp, human
gcgcttaggagagagcatca

SEQ ID NO: 11766 - DNA, 20 bp, human
gggcggctgcaggtaaacca

SEQ ID NO: 11767 - DNA, 20 bp, human
gctgcaggtaaaccaaggta

SEQ ID NO: 11768 - DNA, 20 bp, human
gctagaaaaatggagaaggt

SEQ ID NO: 11769 - DNA, 20 bp, human
gaaaccaaggtagggcgagg

SEQ ID NO: 11770 - DNA, 20 bp, human
gactgctcggaaggaaagag

SEQ ID NO: 11771 - DNA, 20 bp, human
gcccagtggcctattccccg

SEQ ID NO: 11772 - DNA, 20 bp, human
ggctcgcgtagaggaattcc

SEQ ID NO: 11773 - DNA, 20 bp, human
gggctgcgctcaccacgacg

SEQ ID NO: 11774 - DNA, 20 bp, human
ggggactagaaaaatggaga

SEQ ID NO: 11775 - DNA, 20 bp, human
gcctcggcctcttacctcag

SEQ ID NO: 11776 - DNA, 20 bp, human
ggagctgtcaccgtggtcgg

SEQ ID NO: 11777 - DNA, 20 bp, human
gagggagctgtcaccgtggt

SEQ ID NO: 11778 - DNA, 20 bp, human
gctggcggccaagtctcgag

SEQ ID NO: 11779 - DNA, 20 bp, human
gctgtcaccgtggtcggcgg

SEQ ID NO: 11780 - DNA, 20 bp, human
gccggaagtgcgggcgctca

SEQ ID NO: 11781 - DNA, 20 bp, human
gggcggcggcacagagccgg

SEQ ID NO: 11782 - DNA, 20 bp, human
gaggcggctcacaacccctc

SEQ ID NO: 11783 - DNA, 20 bp, human
gcgccagggtcaggagccac

SEQ ID NO: 11784 - DNA, 20 bp, human
gtcaccgtggtcggcggcgg

SEQ ID NO: 11785 - DNA, 20 bp, human
ggcggccaagtctcgagagg

SEQ ID NO: 11786 - DNA, 20 bp, human
gcgcacagacccggcgagga

SEQ ID NO: 11787 - DNA, 20 bp, human
gacgcaaagacgcacagacc

SEQ ID NO: 11788 - DNA, 20 bp, human
gaagacgcacagacccggcg

SEQ ID NO: 11789 - DNA, 20 bp, human
gcagcggggcggtgacgtgt

SEQ ID NO: 11790 - DNA, 20 bp, human
gtgccactgaaaaggatgac

SEQ ID NO: 11791 - DNA, 20 bp, human
ggacctgtcatccttttcag

SEQ ID NO: 11792 - DNA, 20 bp, human
gcccgctgcagcgccaacgt

SEQ ID NO: 11793 - DNA, 20 bp, human
gcgagtcgacgtgccgacgt

SEQ ID NO: 11794 - DNA, 20 bp, human
gggggtcgcgcccagtcaca

SEQ ID NO: 11795 - DNA, 20 bp, human
gaggtcgggacttgccccgg

SEQ ID NO: 11796 - DNA, 20 bp, human
gtccctggccggatccctgt

SEQ ID NO: 11797 - DNA, 20 bp, human
gcgtggaaggcgcaccgaca

SEQ ID NO: 11798 - DNA, 20 bp, human
gtctggccagggaacgtgga

SEQ ID NO: 11799 - DNA, 20 bp, human
gaccgacagggatccggcca

SEQ ID NO: 11800 - DNA, 20 bp, human
gcaacccgcgaagggaggag

SEQ ID NO: 11801 - DNA, 20 bp, human
gcacttctggccagggaacg

SEQ ID NO: 11802 - DNA, 20 bp, human
gaggcgcaccgacagggatc

SEQ ID NO: 11803 - DNA, 20 bp, human
gcccgggagacttcttagag

SEQ ID NO: 11804 - DNA, 20 bp, human
gaggagaggaacgcgagacg

SEQ ID NO: 11805 - DNA, 20 bp, human
gccagaagtgagagagtgct

SEQ ID NO: 11806 - DNA, 20 bp, human
gaggcgcgcaagatccccgg

SEQ ID NO: 11807 - DNA, 20 bp, human
gcgcagcgcgcgctgtggga

SEQ ID NO: 11808 - DNA, 20 bp, human
gcgcggccctggcgacaaca

SEQ ID NO: 11809 - DNA, 20 bp, human
gcgctgcgcgtgcgaaggtc

SEQ ID NO: 11810 - DNA, 20 bp, human
gcgtacgcgccagggagcgt

SEQ ID NO: 11811 - DNA, 20 bp, human
gtgcgcgtgcgaaggtctgg

SEQ ID NO: 11812 - DNA, 20 bp, human
ggacaacacggctgttcggg

SEQ ID NO: 11813 - DNA, 20 bp, human
ggcggagacctgggagagtc

SEQ ID NO: 11814 - DNA, 20 bp, human
ggccgcgcctgcggagacct

SEQ ID NO: 11815 - DNA, 20 bp, human
gggcgtgagaaaggcgacgg

SEQ ID NO: 11816 - DNA, 20 bp, human
gttctccagagtggcccgtg

SEQ ID NO: 11817 - DNA, 20 bp, human
gcatcctgacgacaaaactc

SEQ ID NO: 11818 - DNA, 20 bp, human
gtcttccccacgggccactc

SEQ ID NO: 11819 - DNA, 20 bp, human
gcccatataatggaagatcc

SEQ ID NO: 11820 - DNA, 20 bp, human
gtgttcttattcttccccac

SEQ ID NO: 11821 - DNA, 20 bp, human
gttctgggaaataaatgatg

SEQ ID NO: 11822 - DNA, 20 bp, human
gtatttatcaactgtaccta

SEQ ID NO: 11823 - DNA, 20 bp, human
gttccataattcaattatat

SEQ ID NO: 11824 - DNA, 20 bp, human
gcaaagctagtagcagagca

SEQ ID NO: 11825 - DNA, 20 bp, human
gatttggaagtcgggacact

SEQ ID NO: 11826 - DNA, 20 bp, human
gacctagagtggtggattac

SEQ ID NO: 11827 - DNA, 20 bp, human
gcgcgaccaggtctaatgga

SEQ ID NO: 11828 - DNA, 20 bp, human
gtcaagtcaaggaagacccg

SEQ ID NO: 11829 - DNA, 20 bp, human
gcggagggaaagtggaccag

SEQ ID NO: 11830 - DNA, 20 bp, human
gtcttgaagacctagagtgg

SEQ ID NO: 11831 - DNA, 20 bp, human
gtggtcgcgggaaaccacaa

SEQ ID NO: 11832 - DNA, 20 bp, human
gttcccgcgaccaggtctaa

SEQ ID NO: 11833 - DNA, 20 bp, human
ggaacctgcagatctggcgg

SEQ ID NO: 11834 - DNA, 20 bp, human
gatctcttgaagacctagag

SEQ ID NO: 11835 - DNA, 20 bp, human
gggcattgaaaagcttttgg

SEQ ID NO: 11836 - DNA, 20 bp, human
gtgctcgtcgtgaagggtct

SEQ ID NO: 11837 - DNA, 20 bp, human
gcccggccagaggctgctga

SEQ ID NO: 11838 - DNA, 20 bp, human
gggggactgcggaatctccg

SEQ ID NO: 11839 - DNA, 20 bp, human
gggctgctgaaggtgctgct

SEQ ID NO: 11840 - DNA, 20 bp, human
gtgggaaaatgcccgctcag

SEQ ID NO: 11841 - DNA, 20 bp, human
gtcacgacgagcaagtccat

SEQ ID NO: 11842 - DNA, 20 bp, human
gcgtcgtgaagggtctaggc

SEQ ID NO: 11843 - DNA, 20 bp, human
gtaggcctgggtctgaactt

SEQ ID NO: 11844 - DNA, 20 bp, human
gggtaaccgtgcgaaggtgg

SEQ ID NO: 11845 - DNA, 20 bp, human
gtggctcccggtgctgtggc

SEQ ID NO: 11846 - DNA, 20 bp, human
gccggccagacgtcgtgcag

SEQ ID NO: 11847 - DNA, 20 bp, human
ggttcaggtgaacaatgtag

SEQ ID NO: 11848 - DNA, 20 bp, human
gctcgggtgcagccaatcga

SEQ ID NO: 11849 - DNA, 20 bp, human
ggggtctgcgctctcccgag

SEQ ID NO: 11850 - DNA, 20 bp, human
gggctgtagtttagtgaaat

SEQ ID NO: 11851 - DNA, 20 bp, human
gaggaggagggtcagaactc

SEQ ID NO: 11852 - DNA, 20 bp, human
gctacttatcagagcagaat

SEQ ID NO: 11853 - DNA, 20 bp, human
gcgcgctgggcggctgtgtt

SEQ ID NO: 11854 - DNA, 20 bp, human
ggcagacaaagctgacaaca

SEQ ID NO: 11855 - DNA, 20 bp, human
gacttgtttgagcggaggag

SEQ ID NO: 11856 - DNA, 20 bp, human
ggccgcgcctgggtccggtg

SEQ ID NO: 11857 - DNA, 20 bp, human
gtgggtccggtggggtcagt

SEQ ID NO: 11858 - DNA, 20 bp, human
gcagtgggggaggaggtcac

SEQ ID NO: 11859 - DNA, 20 bp, human
ggaagaggcgggagtggacc

SEQ ID NO: 11860 - DNA, 20 bp, human
gagtcaaccggatctcccgg

SEQ ID NO: 11861 - DNA, 20 bp, human
gcggcgctcgctaaagaagg

SEQ ID NO: 11862 - DNA, 20 bp, human
ggtctccacccgggaggtca

SEQ ID NO: 11863 - DNA, 20 bp, human
ggactcctcggaccaatcag

SEQ ID NO: 11864 - DNA, 20 bp, human
gtcgctaaagaaggcgggaa

SEQ ID NO: 11865 - DNA, 20 bp, human
ggcgcggcgctcgctaaaga

SEQ ID NO: 11866 - DNA, 20 bp, human
gcagccgtggacaatgggag

SEQ ID NO: 11867 - DNA, 20 bp, human
ggcgggcagggtccatagga

SEQ ID NO: 11868 - DNA, 20 bp, human
ggggagcgggcagggtccat

SEQ ID NO: 11869 - DNA, 20 bp, human
gagatgccgaactaaggagg

SEQ ID NO: 11870 - DNA, 20 bp, human
ggctgggtgggaaacatcag

SEQ ID NO: 11871 - DNA, 20 bp, human
ggcggacagccgtggacaat

SEQ ID NO: 11872 - DNA, 20 bp, human
gggggtgcggagggaaccca

SEQ ID NO: 11873 - DNA, 20 bp, human
ggcactggagatgccacgtt

SEQ ID NO: 11874 - DNA, 20 bp, human
gacagagacaccggggccca

SEQ ID NO: 11875 - DNA, 20 bp, human
ggaacccagggtgtgttggg

SEQ ID NO: 11876 - DNA, 20 bp, human
gtccagcccgggccccatca

SEQ ID NO: 11877 - DNA, 20 bp, human
gtggctcccgcaggcaaccc

SEQ ID NO: 11878 - DNA, 20 bp, human
gggtgtggagagcggacacc

SEQ ID NO: 11879 - DNA, 20 bp, human
ggtggcctgggtaggatctg

SEQ ID NO: 11880 - DNA, 20 bp, human
gcctgggtaggatctgaggt

SEQ ID NO: 11881 - DNA, 20 bp, human
gaaagtccttggccatgatg

SEQ ID NO: 11882 - DNA, 20 bp, human
ggcagaggtgcagattcacg

SEQ ID NO: 11883 - DNA, 20 bp, human
ggtgggatggaacgcagggt

SEQ ID NO: 11884 - DNA, 20 bp, human
ggaggtgcagattcacgtgg

SEQ ID NO: 11885 - DNA, 20 bp, human
ggaccgcttgggccttgacc

SEQ ID NO: 11886 - DNA, 20 bp, human
gaaaggtggaaggctaaagg

SEQ ID NO: 11887 - DNA, 20 bp, human
gagtgagggactggacgagg

SEQ ID NO: 11888 - DNA, 20 bp, human
gaagggggcaaactgagggg

SEQ ID NO: 11889 - DNA, 20 bp, human
gctgaggggtagtgagggac

SEQ ID NO: 11890 - DNA, 20 bp, human
gctaaagggggcaaactgag

SEQ ID NO: 11891 - DNA, 20 bp, human
ggggtcccgcaaccgagact

SEQ ID NO: 11892 - DNA, 20 bp, human
gggggagacgatcccagtct

SEQ ID NO: 11893 - DNA, 20 bp, human
gtggacgagggggttcctgt

SEQ ID NO: 11894 - DNA, 20 bp, human
gggtagtgagggactggacg

SEQ ID NO: 11895 - DNA, 20 bp, human
gctacgcggacggagtcggg

SEQ ID NO: 11896 - DNA, 20 bp, human
gtcacgggcggtgggagctg

SEQ ID NO: 11897 - DNA, 20 bp, human
gattctcgcgagaagtccag

SEQ ID NO: 11898 - DNA, 20 bp, human
gccaccgcccgtgaaaggtg

SEQ ID NO: 11899 - DNA, 20 bp, human
gccccttccgcacctttcac

SEQ ID NO: 11900 - DNA, 20 bp, human
gctcgcgagaagtccagggg

SEQ ID NO: 11901 - DNA, 20 bp, human
gcttccgcacctttcacggg

SEQ ID NO: 11902 - DNA, 20 bp, human
ggctcctgccgccgccatca

SEQ ID NO: 11903 - DNA, 20 bp, human
gaaggatcagagataacgac

SEQ ID NO: 11904 - DNA, 20 bp, human
gctgggagaggttcaaagag

SEQ ID NO: 11905 - DNA, 20 bp, human
gctcccgcgtcttcctcggg

SEQ ID NO: 11906 - DNA, 20 bp, human
gtccagagggaggagagtcc

SEQ ID NO: 11907 - DNA, 20 bp, human
gcggctccgggactggagag

SEQ ID NO: 11908 - DNA, 20 bp, human
ggatccatcgtccggccggg

SEQ ID NO: 11909 - DNA, 20 bp, human
gcagccggcggcgggtcctg

SEQ ID NO: 11910 - DNA, 20 bp, human
gtcagcgccgagtcgcggag

SEQ ID NO: 11911 - DNA, 20 bp, human
gtgccgaagccccctcaggt

SEQ ID NO: 11912 - DNA, 20 bp, human
ggcctcggctcggtctgccc

SEQ ID NO: 11913 - DNA, 20 bp, human
gcgcgcaccgcgccgagccc

SEQ ID NO: 11914 - DNA, 20 bp, human
gtgcgcggtgctctcagccc

SEQ ID NO: 11915 - DNA, 20 bp, human
gccgcctcccggccggacga

SEQ ID NO: 11916 - DNA, 20 bp, human
ggaccggtatctggagactg

SEQ ID NO: 11917 - DNA, 20 bp, human
gggcgcggagaggcgaggac

SEQ ID NO: 11918 - DNA, 20 bp, human
gagaggcgaggaccggtatc

SEQ ID NO: 11919 - DNA, 20 bp, human
gggaagcggggagctcagac

SEQ ID NO: 11920 - DNA, 20 bp, human
gtctagtggcgtgtgtaggg

SEQ ID NO: 11921 - DNA, 20 bp, human
ggtccccagtctccagatac

SEQ ID NO: 11922 - DNA, 20 bp, human
gcatgggaaaaggaaccgag

SEQ ID NO: 11923 - DNA, 20 bp, human
ggcgaggagagaatggatcc

SEQ ID NO: 11924 - DNA, 20 bp, human
gggaggccggcggcgagaaa

SEQ ID NO: 11925 - DNA, 20 bp, human
gcggccacgctgatgcactg

SEQ ID NO: 11926 - DNA, 20 bp, human
gtacgccaaggagctctcca

SEQ ID NO: 11927 - DNA, 20 bp, human
gcggctcgggatccgcacca

SEQ ID NO: 11928 - DNA, 20 bp, human
gcgcaccatggagagctcct

SEQ ID NO: 11929 - DNA, 20 bp, human
ggccagcacgcgctacgcca

SEQ ID NO: 11930 - DNA, 20 bp, human
gcgcgatgtaggcctcgctg

SEQ ID NO: 11931 - DNA, 20 bp, human
gcggagccccagagccagtg

SEQ ID NO: 11932 - DNA, 20 bp, human
gagagccagtgaggctgcgg

SEQ ID NO: 11933 - DNA, 20 bp, human
gttccgggccaggaagcgcg

SEQ ID NO: 11934 - DNA, 20 bp, human
gctagtgcgcacagcccggg

SEQ ID NO: 11935 - DNA, 20 bp, human
gtcgctgcggttgagcttcc

SEQ ID NO: 11936 - DNA, 20 bp, human
ggctgtgctggtgctgataa

SEQ ID NO: 11937 - DNA, 20 bp, human
gccctcccgagtggcagtgg

SEQ ID NO: 11938 - DNA, 20 bp, human
ggatgagcagagcctcctcg

SEQ ID NO: 11939 - DNA, 20 bp, human
gagccacaaggagacgatcg

SEQ ID NO: 11940 - DNA, 20 bp, human
ggccctggtgccctcccgag

SEQ ID NO: 11941 - DNA, 20 bp, human
ggccactcgggagggcacca

SEQ ID NO: 11942 - DNA, 20 bp, human
ggtgctggtgctggcaaagg

SEQ ID NO: 11943 - DNA, 20 bp, human
gagggtgctggtgctggcaa

SEQ ID NO: 11944 - DNA, 20 bp, human
gtgctggctagggagggaca

SEQ ID NO: 11945 - DNA, 20 bp, human
gtctcggggggctgctccag

SEQ ID NO: 11946 - DNA, 20 bp, human
gagttaagcaagagtcctca

SEQ ID NO: 11947 - DNA, 20 bp, human
gtgaaaattgggttaccctg

SEQ ID NO: 11948 - DNA, 20 bp, human
gcactgtatatactccagtc

SEQ ID NO: 11949 - DNA, 20 bp, human
gttgatcagcactcaatgca

SEQ ID NO: 11950 - DNA, 20 bp, human
gtttggtttctatttatcct

SEQ ID NO: 11951 - DNA, 20 bp, human
ggaaaaatattactgctctg

SEQ ID NO: 11952 - DNA, 20 bp, human
gctatttatcctgggcctgc

SEQ ID NO: 11953 - DNA, 20 bp, human
gtcaacatagaagcattttg

SEQ ID NO: 11954 - DNA, 20 bp, human
gatctctcttttcttacttc

SEQ ID NO: 11955 - DNA, 20 bp, human
ggcttaactgaaatcacaaa

SEQ ID NO: 11956 - DNA, 20 bp, human
ggaatctggggatctctggt

SEQ ID NO: 11957 - DNA, 20 bp, human
ggctcctgactccaagctgt

SEQ ID NO: 11958 - DNA, 20 bp, human
gtagagagaggtgagctcca

SEQ ID NO: 11959 - DNA, 20 bp, human
gagtggaatctggggatctc

SEQ ID NO: 11960 - DNA, 20 bp, human
ggtcgaaatgcaagcgtgtt

SEQ ID NO: 11961 - DNA, 20 bp, human
ggaaatgcaagcgtgttggg

SEQ ID NO: 11962 - DNA, 20 bp, human
gataccagtggcagcagaga

SEQ ID NO: 11963 - DNA, 20 bp, human
gatttcttccaggcgttcag

SEQ ID NO: 11964 - DNA, 20 bp, human
gactcagcccgctgaacgcc

SEQ ID NO: 11965 - DNA, 20 bp, human
gatggagaaagaggaaaacg

SEQ ID NO: 11966 - DNA, 20 bp, human
gtactggtgagtcctggtaa

SEQ ID NO: 11967 - DNA, 20 bp, human
gccagatgatgcgcccggga

SEQ ID NO: 11968 - DNA, 20 bp, human
gtggaggacgccgagcaccg

SEQ ID NO: 11969 - DNA, 20 bp, human
ggcggccggatgggcgggac

SEQ ID NO: 11970 - DNA, 20 bp, human
gcgggtctggaagacaagac

SEQ ID NO: 11971 - DNA, 20 bp, human
ggggcgcgacactatccgtg

SEQ ID NO: 11972 - DNA, 20 bp, human
gtcacctccgaggccatgtt

SEQ ID NO: 11973 - DNA, 20 bp, human
gcctagtagtgtgggttggt

SEQ ID NO: 11974 - DNA, 20 bp, human
gcggtcctcctagcctccaa

SEQ ID NO: 11975 - DNA, 20 bp, human
gctcacgtccgcgtccccaa

SEQ ID NO: 11976 - DNA, 20 bp, human
gtacgctctgtgggacaagg

SEQ ID NO: 11977 - DNA, 20 bp, human
gactcctgaggctacatcgt

SEQ ID NO: 11978 - DNA, 20 bp, human
gacagagcctgctggcaagg

SEQ ID NO: 11979 - DNA, 20 bp, human
gcttgaagcaagcgctccag

SEQ ID NO: 11980 - DNA, 20 bp, human
gggaacgtgagtgtgatgaa

SEQ ID NO: 11981 - DNA, 20 bp, human
gtgggacaccatgaagccgt

SEQ ID NO: 11982 - DNA, 20 bp, human
gccagaggctccggaagcca

SEQ ID NO: 11983 - DNA, 20 bp, human
ggacaagatgggatcctcag

SEQ ID NO: 11984 - DNA, 20 bp, human
gcacagagcgtatcctacct

SEQ ID NO: 11985 - DNA, 20 bp, human
gttctcgactgacacaacaa

SEQ ID NO: 11986 - DNA, 20 bp, human
gcagcgactcaggaactcta

SEQ ID NO: 11987 - DNA, 20 bp, human
gagtgacctgggtccccata

SEQ ID NO: 11988 - DNA, 20 bp, human
gcctgggtccccatagggat

SEQ ID NO: 11989 - DNA, 20 bp, human
gatcaccgggcacagcacca

SEQ ID NO: 11990 - DNA, 20 bp, human
ggaactctagggatagggat

SEQ ID NO: 11991 - DNA, 20 bp, human
gcagcagcttcccaatcacc

SEQ ID NO: 11992 - DNA, 20 bp, human
ggagtgacccggaacctcta

SEQ ID NO: 11993 - DNA, 20 bp, human
gcggaaccccctaggcatgg

SEQ ID NO: 11994 - DNA, 20 bp, human
gggacggaggggctgaaccc

SEQ ID NO: 11995 - DNA, 20 bp, human
ggctcccggcgtggacgcca

SEQ ID NO: 11996 - DNA, 20 bp, human
ggatataccactgggcgaag

SEQ ID NO: 11997 - DNA, 20 bp, human
gggtgtttggctggttgcta

SEQ ID NO: 11998 - DNA, 20 bp, human
gtgctaagtgtaggctccag

SEQ ID NO: 11999 - DNA, 20 bp, human
gccgggcgctgagttcactg

SEQ ID NO: 12000 - DNA, 20 bp, human
ggctccagcggctccacatc

SEQ ID NO: 12001 - DNA, 20 bp, human
gagttccaaaatggcggcag

SEQ ID NO: 12002 - DNA, 20 bp, human
gcgaaggggaggccaaggac

SEQ ID NO: 12003 - DNA, 20 bp, human
gactggctcacgtgatccag

SEQ ID NO: 12004 - DNA, 20 bp, human
gcacaactctggattcactc

SEQ ID NO: 12005 - DNA, 20 bp, human
gcacggatggtccaactcag

SEQ ID NO: 12006 - DNA, 20 bp, human
gcgcaggacccggctcacct

SEQ ID NO: 12007 - DNA, 20 bp, human
gtaagcaggtcagggtgatg

SEQ ID NO: 12008 - DNA, 20 bp, human
gcctgggcgtaagcaggtca

SEQ ID NO: 12009 - DNA, 20 bp, human
gatgtggacagcttgacggg

SEQ ID NO: 12010 - DNA, 20 bp, human
gcgcgttacaggagccaggt

SEQ ID NO: 12011 - DNA, 20 bp, human
ggggatgtggacagcttgac

SEQ ID NO: 12012 - DNA, 20 bp, human
ggcggctcctgcggtaggga

SEQ ID NO: 12013 - DNA, 20 bp, human
ggtccctgcggcggacgggt

SEQ ID NO: 12014 - DNA, 20 bp, human
ggcggtccgggtccctgcgg

SEQ ID NO: 12015 - DNA, 20 bp, human
gaggtcggtataagcgccag

SEQ ID NO: 12016 - DNA, 20 bp, human
ggcgctgtggctaatgccgt

SEQ ID NO: 12017 - DNA, 20 bp, human
gactggacccaggtgacagt

SEQ ID NO: 12018 - DNA, 20 bp, human
gagccgagggacgcgaccag

SEQ ID NO: 12019 - DNA, 20 bp, human
gagactcgcgggaaaagaaa

SEQ ID NO: 12020 - DNA, 20 bp, human
gccaccgagcgcaagacacg

SEQ ID NO: 12021 - DNA, 20 bp, human
ggaccaccttcagggtccag

SEQ ID NO: 12022 - DNA, 20 bp, human
gtgtcacctgggtccagtct

SEQ ID NO: 12023 - DNA, 20 bp, human
gtaatgccgtaggctccttc

SEQ ID NO: 12024 - DNA, 20 bp, human
gccgctgcggaccaccttca

SEQ ID NO: 12025 - DNA, 20 bp, human
gcgccactggaccctgaagg

SEQ ID NO: 12026 - DNA, 20 bp, human
gagtacagaattcccttgag

SEQ ID NO: 12027 - DNA, 20 bp, human
gccggttagctcattcccat

SEQ ID NO: 12028 - DNA, 20 bp, human
gaagggagtgtccataaacg

SEQ ID NO: 12029 - DNA, 20 bp, human
gtaaatgagactttacccaa

SEQ ID NO: 12030 - DNA, 20 bp, human
gacacttcttcactgctctg

SEQ ID NO: 12031 - DNA, 20 bp, human
gcaacatacgactgcatgta

SEQ ID NO: 12032 - DNA, 20 bp, human
gtgcttaaccagaaatactc

SEQ ID NO: 12033 - DNA, 20 bp, human
gatgtatgttgtgtgaaaag

SEQ ID NO: 12034 - DNA, 20 bp, human
gtacaaaaggttgctatctt

SEQ ID NO: 12035 - DNA, 20 bp, human
ggagattcagagaacagggc

SEQ ID NO: 12036 - DNA, 20 bp, human
gaggcaccctcaaggcacag

SEQ ID NO: 12037 - DNA, 20 bp, human
gaagccttcgaggcctggag

SEQ ID NO: 12038 - DNA, 20 bp, human
ggtggccctagccctcccag

SEQ ID NO: 12039 - DNA, 20 bp, human
gacctggccggccagagagg

SEQ ID NO: 12040 - DNA, 20 bp, human
gggaggagaggtgagcacga

SEQ ID NO: 12041 - DNA, 20 bp, human
gggcggctaaggtctgaggg

SEQ ID NO: 12042 - DNA, 20 bp, human
gtgaggagaagccacaacca

SEQ ID NO: 12043 - DNA, 20 bp, human
gtggcctctccaggcctcga

SEQ ID NO: 12044 - DNA, 20 bp, human
gagtgaaaggtagcaagtca

SEQ ID NO: 12045 - DNA, 20 bp, human
gtcggaaatggcgcaggctg

SEQ ID NO: 12046 - DNA, 20 bp, human
gtcaggacgctggccctcag

SEQ ID NO: 12047 - DNA, 20 bp, human
gatgccggaccggggaccac

SEQ ID NO: 12048 - DNA, 20 bp, human
gggaccggggaccacgggag

SEQ ID NO: 12049 - DNA, 20 bp, human
ggcgcgcgccatgccggacc

SEQ ID NO: 12050 - DNA, 20 bp, human
ggcagggcctgcgggactca

SEQ ID NO: 12051 - DNA, 20 bp, human
gggtgtgcagcggggacgca

SEQ ID NO: 12052 - DNA, 20 bp, human
gggctgctggccgtctacac

SEQ ID NO: 12053 - DNA, 20 bp, human
gggagcgccctgcgaccctg

SEQ ID NO: 12054 - DNA, 20 bp, human
gctggccctcaggggcgcag

SEQ ID NO: 12055 - DNA, 20 bp, human
ggcggtgagtccgagaccct

SEQ ID NO: 12056 - DNA, 20 bp, human
gtctgagaaggcacaaggac

SEQ ID NO: 12057 - DNA, 20 bp, human
gtgggctgggagtccagtga

SEQ ID NO: 12058 - DNA, 20 bp, human
ggccggcgctcttccaccga

SEQ ID NO: 12059 - DNA, 20 bp, human
ggagatgacgccaccctcgg

SEQ ID NO: 12060 - DNA, 20 bp, human
ggctacccgggcacagtcag

SEQ ID NO: 12061 - DNA, 20 bp, human
gtaccagctcagggtctcca

SEQ ID NO: 12062 - DNA, 20 bp, human
ggctgaccaaggaccttcgg

SEQ ID NO: 12063 - DNA, 20 bp, human
gctggagggtcgggctaccc

SEQ ID NO: 12064 - DNA, 20 bp, human
gcgacagttaggggagcctc

SEQ ID NO: 12065 - DNA, 20 bp, human
gccagaggctggcaacccaa

SEQ ID NO: 12066 - DNA, 20 bp, human
gcgccccgcgcgcctaaagg

SEQ ID NO: 12067 - DNA, 20 bp, human
gcggcgcgcggtgggacctg

SEQ ID NO: 12068 - DNA, 20 bp, human
gtaaaggaggagcgtcgcgg

SEQ ID NO: 12069 - DNA, 20 bp, human
ggcctaaaggaggagcgtcg

SEQ ID NO: 12070 - DNA, 20 bp, human
ggcgtcgcgggggatggagg

SEQ ID NO: 12071 - DNA, 20 bp, human
gccgccaggcccgccgaatg

SEQ ID NO: 12072 - DNA, 20 bp, human
gcaggcggtgctgaggcaca

SEQ ID NO: 12073 - DNA, 20 bp, human
ggccattgcacggtccgcgg

SEQ ID NO: 12074 - DNA, 20 bp, human
ggaagacttcacccgcctgc

SEQ ID NO: 12075 - DNA, 20 bp, human
gccctcgggatgctagtctc

SEQ ID NO: 12076 - DNA, 20 bp, human
gagcccaggaaggagcgagt

SEQ ID NO: 12077 - DNA, 20 bp, human
gcagcgtggagagaggaccg

SEQ ID NO: 12078 - DNA, 20 bp, human
ggacagcccagagtggaatg

SEQ ID NO: 12079 - DNA, 20 bp, human
ggagagccaggcaggaccgc

SEQ ID NO: 12080 - DNA, 20 bp, human
gcggggctagtgaggagcga

SEQ ID NO: 12081 - DNA, 20 bp, human
ggggcagccatggaagggac

SEQ ID NO: 12082 - DNA, 20 bp, human
gaggcaggaccgcagggtcg

SEQ ID NO: 12083 - DNA, 20 bp, human
ggcttcctcctagctcccct

SEQ ID NO: 12084 - DNA, 20 bp, human
gttggaggtgcatgaaggag

SEQ ID NO: 12085 - DNA, 20 bp, human
gccggaaagggcgccacgtg

SEQ ID NO: 12086 - DNA, 20 bp, human
gcgcagcgcggcgtcggcac

SEQ ID NO: 12087 - DNA, 20 bp, human
gggaggaagggaccacgatg

SEQ ID NO: 12088 - DNA, 20 bp, human
ggtaggaggaggtctaggga

SEQ ID NO: 12089 - DNA, 20 bp, human
gaccggcgcggcttaggctc

SEQ ID NO: 12090 - DNA, 20 bp, human
gtgggccgaccccaggacag

SEQ ID NO: 12091 - DNA, 20 bp, human
ggaggaaagaggggtcacag

SEQ ID NO: 12092 - DNA, 20 bp, human
gaccggcaggggcaccggcg

SEQ ID NO: 12093 - DNA, 20 bp, human
gagggtgatgcccggctccg

SEQ ID NO: 12094 - DNA, 20 bp, human
gggtcccggagcatcctcgg

SEQ ID NO: 12095 - DNA, 20 bp, human
ggccgcgccggtgcccctgc

SEQ ID NO: 12096 - DNA, 20 bp, human
gcccactcgccggttcgcca

SEQ ID NO: 12097 - DNA, 20 bp, human
gaagcggtcagcgtaagtcc

SEQ ID NO: 12098 - DNA, 20 bp, human
ggggcggctgtagaggtcgt

SEQ ID NO: 12099 - DNA, 20 bp, human
gctagacaaccctaacgagg

SEQ ID NO: 12100 - DNA, 20 bp, human
ggacaaccctaacgaggagg

SEQ ID NO: 12101 - DNA, 20 bp, human
ggccagagacagcgtccgtg

SEQ ID NO: 12102 - DNA, 20 bp, human
ggccctagacaaccctaacg

SEQ ID NO: 12103 - DNA, 20 bp, human
ggctgaccgcttcccctcag

SEQ ID NO: 12104 - DNA, 20 bp, human
gcgtccccgaagcaaaggaa

SEQ ID NO: 12105 - DNA, 20 bp, human
gggaagtgagcccgaccgag

SEQ ID NO: 12106 - DNA, 20 bp, human
gactaacatggactaatctg

SEQ ID NO: 12107 - DNA, 20 bp, human
gtatggtaaggcataatgac

SEQ ID NO: 12108 - DNA, 20 bp, human
gcccagggtgcagccacacc

SEQ ID NO: 12109 - DNA, 20 bp, human
gtcctggtgtggctgcaccc

SEQ ID NO: 12110 - DNA, 20 bp, human
gtttattccagtatcaccca

SEQ ID NO: 12111 - DNA, 20 bp, human
gcatgttaacatttatggta

SEQ ID NO: 12112 - DNA, 20 bp, human
gacacccttcaacacagtcc

SEQ ID NO: 12113 - DNA, 20 bp, human
gaggactactctcttctgac

SEQ ID NO: 12114 - DNA, 20 bp, human
gttagtccatgttagtactg

SEQ ID NO: 12115 - DNA, 20 bp, human
gcacaccaggactgtgttga

SEQ ID NO: 12116 - DNA, 20 bp, human
gggtagtcccccttcaacag

SEQ ID NO: 12117 - DNA, 20 bp, human
gcacaggccagggagggtac

SEQ ID NO: 12118 - DNA, 20 bp, human
gtattctggaacacaggcca

SEQ ID NO: 12119 - DNA, 20 bp, human
gggccagcctctgttgaagg

SEQ ID NO: 12120 - DNA, 20 bp, human
ggactaccctgtaccctccc

SEQ ID NO: 12121 - DNA, 20 bp, human
gggtccaaggatggatgcag

SEQ ID NO: 12122 - DNA, 20 bp, human
gagaataacagatgaggaca

SEQ ID NO: 12123 - DNA, 20 bp, human
gcccatcagctcagagaccg

SEQ ID NO: 12124 - DNA, 20 bp, human
gcctctccaggaaatcccat

SEQ ID NO: 12125 - DNA, 20 bp, human
gagaccggggaagccgccat

SEQ ID NO: 12126 - DNA, 20 bp, human
gtcacgtgagcggaaaatgg

SEQ ID NO: 12127 - DNA, 20 bp, human
gcggtggcgagccttcccag

SEQ ID NO: 12128 - DNA, 20 bp, human
gggccgagcccagctcgcga

SEQ ID NO: 12129 - DNA, 20 bp, human
gcaatgagcggcctcctgag

SEQ ID NO: 12130 - DNA, 20 bp, human
gcggcggcgggtcacgtgag

SEQ ID NO: 12131 - DNA, 20 bp, human
ggaatgggaacgcgggtcta

SEQ ID NO: 12132 - DNA, 20 bp, human
ggggtcacgtgagcggaaaa

SEQ ID NO: 12133 - DNA, 20 bp, human
ggagcggaaaatggcggccc

SEQ ID NO: 12134 - DNA, 20 bp, human
gtcccaggggtgaggtagaa

SEQ ID NO: 12135 - DNA, 20 bp, human
ggggcgccgagtactcgatg

SEQ ID NO: 12136 - DNA, 20 bp, human
ggccgttcagaacagagact

SEQ ID NO: 12137 - DNA, 20 bp, human
gagggccgccgacttaccca

SEQ ID NO: 12138 - DNA, 20 bp, human
ggcgcgggtacaaggtcctc

SEQ ID NO: 12139 - DNA, 20 bp, human
ggacgccgagacctcaagct

SEQ ID NO: 12140 - DNA, 20 bp, human
gtcgagccggcgtcggggag

SEQ ID NO: 12141 - DNA, 20 bp, human
gcccagggcaccgcaggacg

SEQ ID NO: 12142 - DNA, 20 bp, human
ggtcgtccaaagccagccca

SEQ ID NO: 12143 - DNA, 20 bp, human
gcggtttcgagccggcgtcg

SEQ ID NO: 12144 - DNA, 20 bp, human
gtaccgccgctccccgacgc

SEQ ID NO: 12145 - DNA, 20 bp, human
ggtccccacagggtctcccg

SEQ ID NO: 12146 - DNA, 20 bp, human
gccgctgcccgagcccggta

SEQ ID NO: 12147 - DNA, 20 bp, human
ggtgctctcggctagggagt

SEQ ID NO: 12148 - DNA, 20 bp, human
gagacggcgagtccgagaga

SEQ ID NO: 12149 - DNA, 20 bp, human
gaagcgggtgctctcggcta

SEQ ID NO: 12150 - DNA, 20 bp, human
gtagggagtgggcagcgaga

SEQ ID NO: 12151 - DNA, 20 bp, human
gttataagcacagggcccgg

SEQ ID NO: 12152 - DNA, 20 bp, human
ggagcccggtaaggagccct

SEQ ID NO: 12153 - DNA, 20 bp, human
gcgcttcccgggcccagagg

SEQ ID NO: 12154 - DNA, 20 bp, human
ggaggaagccggatccgaca

SEQ ID NO: 12155 - DNA, 20 bp, human
gtgtgcttataacctgggat

SEQ ID NO: 12156 - DNA, 20 bp, human
ggttgcatagagctgcatag

SEQ ID NO: 12157 - DNA, 20 bp, human
ggaaagcagaggaggaccgg

SEQ ID NO: 12158 - DNA, 20 bp, human
gggcgctaagtagctaaaga

SEQ ID NO: 12159 - DNA, 20 bp, human
gatagagctgcataggggaa

SEQ ID NO: 12160 - DNA, 20 bp, human
gagtgttcgccgacccaagt

SEQ ID NO: 12161 - DNA, 20 bp, human
ggaggagctactcctctggg

SEQ ID NO: 12162 - DNA, 20 bp, human
ggttcgccgacccaagtagg

SEQ ID NO: 12163 - DNA, 20 bp, human
gtctagcgggcttctgatgg

SEQ ID NO: 12164 - DNA, 20 bp, human
ggacacctcgggcttcaata

SEQ ID NO: 12165 - DNA, 20 bp, human
gtgggacgtacgttccgaaa

SEQ ID NO: 12166 - DNA, 20 bp, human
gcacctatgaggtagaggag

SEQ ID NO: 12167 - DNA, 20 bp, human
gagcagggctctaccatgga

SEQ ID NO: 12168 - DNA, 20 bp, human
gctaccatggagggtgtagg

SEQ ID NO: 12169 - DNA, 20 bp, human
ggacaggcagccagcttacc

SEQ ID NO: 12170 - DNA, 20 bp, human
gagagcagacccagcaccca

SEQ ID NO: 12171 - DNA, 20 bp, human
ggctctaccatggagggtgt

SEQ ID NO: 12172 - DNA, 20 bp, human
ggggctgagagagagtcata

SEQ ID NO: 12173 - DNA, 20 bp, human
gtcacgggcgtcagaacccg

SEQ ID NO: 12174 - DNA, 20 bp, human
ggtcaggcagggagtcatcc

SEQ ID NO: 12175 - DNA, 20 bp, human
gagaccccctacaccctcca

SEQ ID NO: 12176 - DNA, 20 bp, human
gggatccgggaggtaggagt

SEQ ID NO: 12177 - DNA, 20 bp, human
gaggcggccggggctcaaga

SEQ ID NO: 12178 - DNA, 20 bp, human
gggagaagtcaggtgcacag

SEQ ID NO: 12179 - DNA, 20 bp, human
gcatcgcagcgctaggagga

SEQ ID NO: 12180 - DNA, 20 bp, human
gcctagcgctgcgatggtgg

SEQ ID NO: 12181 - DNA, 20 bp, human
gactcacccagcacgaagta

SEQ ID NO: 12182 - DNA, 20 bp, human
ggcaccgagaagaggagctt

SEQ ID NO: 12183 - DNA, 20 bp, human
ggtcgttgcgcaccgagaag

SEQ ID NO: 12184 - DNA, 20 bp, human
gggagaatggtccgggagtg

SEQ ID NO: 12185 - DNA, 20 bp, human
gtgagtcccgggggaggtcg

SEQ ID NO: 12186 - DNA, 20 bp, human
gggacgcccgagctaaggag

SEQ ID NO: 12187 - DNA, 20 bp, human
gagcaggaggcgcgactcgg

SEQ ID NO: 12188 - DNA, 20 bp, human
gccctgcgggagagcgacat

SEQ ID NO: 12189 - DNA, 20 bp, human
gaaccaggacgcccgagcta

SEQ ID NO: 12190 - DNA, 20 bp, human
gagagcgacatcggctggag

SEQ ID NO: 12191 - DNA, 20 bp, human
gaagagcaggaggcgcgact

SEQ ID NO: 12192 - DNA, 20 bp, human
gtgccggctgaagaccgtca

SEQ ID NO: 12193 - DNA, 20 bp, human
gggcagtgtggacaccgtga

SEQ ID NO: 12194 - DNA, 20 bp, human
gcgggcgtcctggttcgctt

SEQ ID NO: 12195 - DNA, 20 bp, human
gtctctccgctccttagctc

SEQ ID NO: 12196 - DNA, 20 bp, human
gtagcacaccggtccttccc

SEQ ID NO: 12197 - DNA, 20 bp, human
ggtgtgctaggagatgatcg

SEQ ID NO: 12198 - DNA, 20 bp, human
gtcctgctcttaggaagcct

SEQ ID NO: 12199 - DNA, 20 bp, human
gtcccaggcttcctaagagc

SEQ ID NO: 12200 - DNA, 20 bp, human
gagaggccgagcgaaagcct

SEQ ID NO: 12201 - DNA, 20 bp, human
ggcgcacagtcgggagtgtc

SEQ ID NO: 12202 - DNA, 20 bp, human
gggagagtcagcgcacagtc

SEQ ID NO: 12203 - DNA, 20 bp, human
gagtggatagggaagacctc

SEQ ID NO: 12204 - DNA, 20 bp, human
ggtggggggtggaaaataca

SEQ ID NO: 12205 - DNA, 20 bp, human
ggcgggtggaaaatctcgag

SEQ ID NO: 12206 - DNA, 20 bp, human
gctgcgtcagtcgcccacgg

SEQ ID NO: 12207 - DNA, 20 bp, human
gagctccacgcgggacctcc

SEQ ID NO: 12208 - DNA, 20 bp, human
ggctccgccgggatgggatg

SEQ ID NO: 12209 - DNA, 20 bp, human
ggtgcgtgcgtgtctgccgt

SEQ ID NO: 12210 - DNA, 20 bp, human
ggtgtgtgtgaagagtgagg

SEQ ID NO: 12211 - DNA, 20 bp, human
ggcgctgcgtcagtcgccca

SEQ ID NO: 12212 - DNA, 20 bp, human
gccagcccggaggtcccgcg

SEQ ID NO: 12213 - DNA, 20 bp, human
gcgagacgcggctttccctt

SEQ ID NO: 12214 - DNA, 20 bp, human
gcacgcacccgggcgccgaa

SEQ ID NO: 12215 - DNA, 20 bp, human
gactgagacaggaccgacgg

SEQ ID NO: 12216 - DNA, 20 bp, human
ggcggcggtagcagtggcaa

SEQ ID NO: 12217 - DNA, 20 bp, human
gagcggtcacatgaccgtag

SEQ ID NO: 12218 - DNA, 20 bp, human
gcccagggacccggctgaag

SEQ ID NO: 12219 - DNA, 20 bp, human
ggtacagtaagaacccaata

SEQ ID NO: 12220 - DNA, 20 bp, human
gggcgagggctaccacagag

SEQ ID NO: 12221 - DNA, 20 bp, human
gtaagaacccaatatggcag

SEQ ID NO: 12222 - DNA, 20 bp, human
ggcaacggcagcaagaggac

SEQ ID NO: 12223 - DNA, 20 bp, human
gtgcgactggcgggcgacaa

SEQ ID NO: 12224 - DNA, 20 bp, human
ggcggccggagcccggacac

SEQ ID NO: 12225 - DNA, 20 bp, human
gcacagagcggaggtgatat

SEQ ID NO: 12226 - DNA, 20 bp, human
gcccggagctgtcaccgcag

SEQ ID NO: 12227 - DNA, 20 bp, human
ggggccgagcggagcatccc

SEQ ID NO: 12228 - DNA, 20 bp, human
gaagaagaaggaccgcacct

SEQ ID NO: 12229 - DNA, 20 bp, human
gggggcggtacgtaccaggc

SEQ ID NO: 12230 - DNA, 20 bp, human
gtgcaaacatgaaagacaag

SEQ ID NO: 12231 - DNA, 20 bp, human
gcacacaaaggtctccggag

SEQ ID NO: 12232 - DNA, 20 bp, human
ggagccccgagagcgaagta

SEQ ID NO: 12233 - DNA, 20 bp, human
gggccgggctcgctcgtgcg

SEQ ID NO: 12234 - DNA, 20 bp, human
gggaggcgcgggcggcgtgt

SEQ ID NO: 12235 - DNA, 20 bp, human
gcgtaccaggcgggcagcct

SEQ ID NO: 12236 - DNA, 20 bp, human
gatgcgcccggagagctgaa

SEQ ID NO: 12237 - DNA, 20 bp, human
ggcgctgcgaggcctgccag

SEQ ID NO: 12238 - DNA, 20 bp, human
gagggcgcgcggtgccgaca

SEQ ID NO: 12239 - DNA, 20 bp, human
gatacacgtgagggagtagg

SEQ ID NO: 12240 - DNA, 20 bp, human
gatggatccaaacccaactg

SEQ ID NO: 12241 - DNA, 20 bp, human
ggtagcgagagcgaggatga

SEQ ID NO: 12242 - DNA, 20 bp, human
ggaccggacgtctcaggtag

SEQ ID NO: 12243 - DNA, 20 bp, human
ggaaatacacgtgagggagt

SEQ ID NO: 12244 - DNA, 20 bp, human
ggggagtaggaggtttcacg

SEQ ID NO: 12245 - DNA, 20 bp, human
ggcgcatgcgcaccggggtg

SEQ ID NO: 12246 - DNA, 20 bp, human
gtggttcccgtggggcctca

SEQ ID NO: 12247 - DNA, 20 bp, human
gggaaccagctactcaccca

SEQ ID NO: 12248 - DNA, 20 bp, human
gaccaggcgaacctagacga

SEQ ID NO: 12249 - DNA, 20 bp, human
gaggcgaacctagacgaagg

SEQ ID NO: 12250 - DNA, 20 bp, human
gccatcccatgaggccccac

SEQ ID NO: 12251 - DNA, 20 bp, human
gagggcgtgggagaagaccg

SEQ ID NO: 12252 - DNA, 20 bp, human
gcctgtgtgaggccggctga

SEQ ID NO: 12253 - DNA, 20 bp, human
gtgggggcggcactgaggta

SEQ ID NO: 12254 - DNA, 20 bp, human
ggtgagtagctggttcccgt

SEQ ID NO: 12255 - DNA, 20 bp, human
gctgcccctgggtgagtagc

SEQ ID NO: 12256 - DNA, 20 bp, human
ggcgcacgccgaggccagta

SEQ ID NO: 12257 - DNA, 20 bp, human
gcggagagagatccagctcc

SEQ ID NO: 12258 - DNA, 20 bp, human
gagcttgtggcgccagaatt

SEQ ID NO: 12259 - DNA, 20 bp, human
gcctcttgcgtaaaagtagg

SEQ ID NO: 12260 - DNA, 20 bp, human
gctccaggcgctcgcagctc

SEQ ID NO: 12261 - DNA, 20 bp, human
gtcagggtgacagttgtcgg

SEQ ID NO: 12262 - DNA, 20 bp, human
gtggcctcggcgtgcgcgac

SEQ ID NO: 12263 - DNA, 20 bp, human
gtggtcgaggacgagtaaaa

SEQ ID NO: 12264 - DNA, 20 bp, human
gtccagactgaggaagtcac

SEQ ID NO: 12265 - DNA, 20 bp, human
gcggcgaccacagccaaagc

SEQ ID NO: 12266 - DNA, 20 bp, human
ggcgagaacgggagagaaag

SEQ ID NO: 12267 - DNA, 20 bp, human
gggagctcgagagcgagaac

SEQ ID NO: 12268 - DNA, 20 bp, human
gctcctcagcgggagccgag

SEQ ID NO: 12269 - DNA, 20 bp, human
gctccgctcggctcccgctg

SEQ ID NO: 12270 - DNA, 20 bp, human
gggcagcacagacactccgc

SEQ ID NO: 12271 - DNA, 20 bp, human
gcccgccggccggtcagtca

SEQ ID NO: 12272 - DNA, 20 bp, human
gcggcttcgccctcctcagc

SEQ ID NO: 12273 - DNA, 20 bp, human
gagagagccgggcagaggaa

SEQ ID NO: 12274 - DNA, 20 bp, human
ggcgctggagccttgacgca

SEQ ID NO: 12275 - DNA, 20 bp, human
gctggcggcgcgggtcttgg

SEQ ID NO: 12276 - DNA, 20 bp, human
ggtcaggagcgggtcaggtg

SEQ ID NO: 12277 - DNA, 20 bp, human
gggcggtgaccaccggctcg

SEQ ID NO: 12278 - DNA, 20 bp, human
ggcgggtcaggtgcggaaag

SEQ ID NO: 12279 - DNA, 20 bp, human
ggtggtcaccgccactgcgc

SEQ ID NO: 12280 - DNA, 20 bp, human
gacgcgcttctatcgccggg

SEQ ID NO: 12281 - DNA, 20 bp, human
gcggcggtaactgaagacca

SEQ ID NO: 12282 - DNA, 20 bp, human
gtggcgctcataggttacag

SEQ ID NO: 12283 - DNA, 20 bp, human
gcagctgcagaggtgcaaac

SEQ ID NO: 12284 - DNA, 20 bp, human
gcttggcctgtgccacgtgg

SEQ ID NO: 12285 - DNA, 20 bp, human
gccgctcctgacagctgcag

SEQ ID NO: 12286 - DNA, 20 bp, human
gcccccacccgagtctgact

SEQ ID NO: 12287 - DNA, 20 bp, human
ggtggccaggaccactgcgc

SEQ ID NO: 12288 - DNA, 20 bp, human
gttcgcctgcgcagtggtcc

SEQ ID NO: 12289 - DNA, 20 bp, human
gacgcatttccgtcgccggg

SEQ ID NO: 12290 - DNA, 20 bp, human
gatttccgtcgccgggagga

SEQ ID NO: 12291 - DNA, 20 bp, human
gcccgagtctgactcgggcg

SEQ ID NO: 12292 - DNA, 20 bp, human
gatcctcccggcacgcgaga

SEQ ID NO: 12293 - DNA, 20 bp, human
gtgccgctcctcgctgctgt

SEQ ID NO: 12294 - DNA, 20 bp, human
gcggccggtctcccaaaccg

SEQ ID NO: 12295 - DNA, 20 bp, human
ggtgtgtttcgcctgcgcag

SEQ ID NO: 12296 - DNA, 20 bp, human
gtagagagtccctctcaagg

SEQ ID NO: 12297 - DNA, 20 bp, human
gagatcgctcggctgacaga

SEQ ID NO: 12298 - DNA, 20 bp, human
gcagagcccgggctactagg

SEQ ID NO: 12299 - DNA, 20 bp, human
gaagggtggggccatgtcag

SEQ ID NO: 12300 - DNA, 20 bp, human
ggccagatgcccccttgaga

SEQ ID NO: 12301 - DNA, 20 bp, human
gggctactaggaggccgcac

SEQ ID NO: 12302 - DNA, 20 bp, human
gcctgctccagcaagaaggg

SEQ ID NO: 12303 - DNA, 20 bp, human
gggcggaacttggctgtcac

SEQ ID NO: 12304 - DNA, 20 bp, human
gaggtagagagtccctctca

SEQ ID NO: 12305 - DNA, 20 bp, human
gcggaagacaggcagccagg

SEQ ID NO: 12306 - DNA, 20 bp, human
gccgaatcgaacacggaaag

SEQ ID NO: 12307 - DNA, 20 bp, human
gtcggaccacagagcttcgg

SEQ ID NO: 12308 - DNA, 20 bp, human
gaagcaagcggaccgcagat

SEQ ID NO: 12309 - DNA, 20 bp, human
gtctcgcagtccttcacggg

SEQ ID NO: 12310 - DNA, 20 bp, human
gagctctgtggtccgatctg

SEQ ID NO: 12311 - DNA, 20 bp, human
gcaatctcgcagtccttcac

SEQ ID NO: 12312 - DNA, 20 bp, human
gggaagcggggagtatggtg

SEQ ID NO: 12313 - DNA, 20 bp, human
ggctgctccgcctcccgtga

SEQ ID NO: 12314 - DNA, 20 bp, human
gttccgggaagcggggagta

SEQ ID NO: 12315 - DNA, 20 bp, human
ggctcccgctctctgtcggt

SEQ ID NO: 12316 - DNA, 20 bp, human
gggacgcgctgttcccggag

SEQ ID NO: 12317 - DNA, 20 bp, human
gatggagttcccgttcgatg

SEQ ID NO: 12318 - DNA, 20 bp, human
gctgttcccggagcggatca

SEQ ID NO: 12319 - DNA, 20 bp, human
gcagcaccgtgatccgctcc

SEQ ID NO: 12320 - DNA, 20 bp, human
gacagcgcgtccacatcgaa

SEQ ID NO: 12321 - DNA, 20 bp, human
ggcggaagtgacgtcgtgtg

SEQ ID NO: 12322 - DNA, 20 bp, human
ggaccgcgcacaatgggcca

SEQ ID NO: 12323 - DNA, 20 bp, human
gcaggcctggacatcaaaag

SEQ ID NO: 12324 - DNA, 20 bp, human
gtttgggtttcagaagggtg

SEQ ID NO: 12325 - DNA, 20 bp, human
gttggaagactcccaggcaa

SEQ ID NO: 12326 - DNA, 20 bp, human
ggaagaagcagctacctcgg

SEQ ID NO: 12327 - DNA, 20 bp, human
gtgggaagaagcagctacct

SEQ ID NO: 12328 - DNA, 20 bp, human
gtcacggagtcacaagaccg

SEQ ID NO: 12329 - DNA, 20 bp, human
gaggaagaggatgctcgcag

SEQ ID NO: 12330 - DNA, 20 bp, human
gggcgggcggcgatgagagg

SEQ ID NO: 12331 - DNA, 20 bp, human
gctgccggataaaccttcca

SEQ ID NO: 12332 - DNA, 20 bp, human
gagcagctacctcggaggca

SEQ ID NO: 12333 - DNA, 20 bp, human
gtaccgggaacagggatgtg

SEQ ID NO: 12334 - DNA, 20 bp, human
gagggatttagaggcggcaa

SEQ ID NO: 12335 - DNA, 20 bp, human
gatccgaggaaggtcaccca

SEQ ID NO: 12336 - DNA, 20 bp, human
gtcagggccggctaccactg

SEQ ID NO: 12337 - DNA, 20 bp, human
gggaatcgcagtagccgcag

SEQ ID NO: 12338 - DNA, 20 bp, human
gtggtggtctccccagagtc

SEQ ID NO: 12339 - DNA, 20 bp, human
gggcggccgcgctagcgacg

SEQ ID NO: 12340 - DNA, 20 bp, human
gggagacggacgcccgtctg

SEQ ID NO: 12341 - DNA, 20 bp, human
ggattgtgtgaggtgaagga

SEQ ID NO: 12342 - DNA, 20 bp, human
ggcggtagaagtcctcgcta

SEQ ID NO: 12343 - DNA, 20 bp, human
gggcccggctcgctcaccat

SEQ ID NO: 12344 - DNA, 20 bp, human
gcccgagcggaccctcgcgg

SEQ ID NO: 12345 - DNA, 20 bp, human
ggagagtacgggcaccggtt

SEQ ID NO: 12346 - DNA, 20 bp, human
gggggaaggacgcgggaacg

SEQ ID NO: 12347 - DNA, 20 bp, human
gcagtcagggccgctactgg

SEQ ID NO: 12348 - DNA, 20 bp, human
gaggagacgcacgactggaa

SEQ ID NO: 12349 - DNA, 20 bp, human
ggccctgactgccgaggaaa

SEQ ID NO: 12350 - DNA, 20 bp, human
gcggcagtcagggccgctac

SEQ ID NO: 12351 - DNA, 20 bp, human
gtgaggcgaaagccaccccg

SEQ ID NO: 12352 - DNA, 20 bp, human
ggcagcgcagctctgcaccg

SEQ ID NO: 12353 - DNA, 20 bp, human
gtagatcatgccgccagtag

SEQ ID NO: 12354 - DNA, 20 bp, human
ggctctgcaccgaggcgcgg

SEQ ID NO: 12355 - DNA, 20 bp, human
gggacaagcctccttctcgg

SEQ ID NO: 12356 - DNA, 20 bp, human
gcctctcgcgcgctttccta

SEQ ID NO: 12357 - DNA, 20 bp, human
gtcggagggaggggtctaag

SEQ ID NO: 12358 - DNA, 20 bp, human
gctctgaactgacccaagta

SEQ ID NO: 12359 - DNA, 20 bp, human
gcgaggtgatgggaaacggg

SEQ ID NO: 12360 - DNA, 20 bp, human
gagagaggacggaagcctgt

SEQ ID NO: 12361 - DNA, 20 bp, human
gtagggtgaagataattcgg

SEQ ID NO: 12362 - DNA, 20 bp, human
gagcacgtcaggagcacccg

SEQ ID NO: 12363 - DNA, 20 bp, human
gcaacccaaggactgtgggt

SEQ ID NO: 12364 - DNA, 20 bp, human
ggcgcgctttcctaaggcag

SEQ ID NO: 12365 - DNA, 20 bp, human
gcagcagggctggagactgt

SEQ ID NO: 12366 - DNA, 20 bp, human
ggctgaagggtgcgctcggg

SEQ ID NO: 12367 - DNA, 20 bp, human
gggccggcgcgcgggctgaa

SEQ ID NO: 12368 - DNA, 20 bp, human
gggcgagcaccgaggactca

SEQ ID NO: 12369 - DNA, 20 bp, human
gaggggcgcgaagggaatga

SEQ ID NO: 12370 - DNA, 20 bp, human
ggcctggctgcgtgcgactg

SEQ ID NO: 12371 - DNA, 20 bp, human
gggcaagccagcgccgtcgg

SEQ ID NO: 12372 - DNA, 20 bp, human
gtcgaagcgccgaggagcag

SEQ ID NO: 12373 - DNA, 20 bp, human
gccgggcaagccagcgccgt

SEQ ID NO: 12374 - DNA, 20 bp, human
gtccggggtgggtcaggggt

SEQ ID NO: 12375 - DNA, 20 bp, human
ggaaaggttcctggtgacgg

SEQ ID NO: 12376 - DNA, 20 bp, human
ggacgaagtctataaagggc

SEQ ID NO: 12377 - DNA, 20 bp, human
gcatggcgtgagtaccgggg

SEQ ID NO: 12378 - DNA, 20 bp, human
ggctgttgccccacgaaacg

SEQ ID NO: 12379 - DNA, 20 bp, human
gccggcggcgaaggaaagaa

SEQ ID NO: 12380 - DNA, 20 bp, human
gtgcggggctcggggtccga

SEQ ID NO: 12381 - DNA, 20 bp, human
ggacccctgggacccttgcg

SEQ ID NO: 12382 - DNA, 20 bp, human
ggccagggcggtgccgccaa

SEQ ID NO: 12383 - DNA, 20 bp, human
gggatcgggaaagcgtagtc

SEQ ID NO: 12384 - DNA, 20 bp, human
ggggcaacagccaagacccc

SEQ ID NO: 12385 - DNA, 20 bp, human
gagatcactccgcgctccgg

SEQ ID NO: 12386 - DNA, 20 bp, human
gactggggacagatatatac

SEQ ID NO: 12387 - DNA, 20 bp, human
gccctcgcgcggccccaacc

SEQ ID NO: 12388 - DNA, 20 bp, human
gctgggcctgagcactccag

SEQ ID NO: 12389 - DNA, 20 bp, human
ggcctgagcactccagggga

SEQ ID NO: 12390 - DNA, 20 bp, human
ggccatggccggggctacgc

SEQ ID NO: 12391 - DNA, 20 bp, human
gagggccacgagctgcgaaa

SEQ ID NO: 12392 - DNA, 20 bp, human
gggtcgaggctacagagcca

SEQ ID NO: 12393 - DNA, 20 bp, human
ggagaagagactgtgatccg

SEQ ID NO: 12394 - DNA, 20 bp, human
gggcgcagaagtagtacggt

SEQ ID NO: 12395 - DNA, 20 bp, human
gccccagggctccctaaaga

SEQ ID NO: 12396 - DNA, 20 bp, human
gttaatatctgggacggcgg

SEQ ID NO: 12397 - DNA, 20 bp, human
gtattaatcacggagttcca

SEQ ID NO: 12398 - DNA, 20 bp, human
gccacgagtgggcggaagta

SEQ ID NO: 12399 - DNA, 20 bp, human
ggaaggaacttgtgaaatgg

SEQ ID NO: 12400 - DNA, 20 bp, human
ggggctaaaaggtgactcca

SEQ ID NO: 12401 - DNA, 20 bp, human
gcacacctgtcaccacgagt

SEQ ID NO: 12402 - DNA, 20 bp, human
gcacgaacaggagtgacgag

SEQ ID NO: 12403 - DNA, 20 bp, human
gcgagtgggcggaagtaggg

SEQ ID NO: 12404 - DNA, 20 bp, human
ggaaagagtcccgggctaaa

SEQ ID NO: 12405 - DNA, 20 bp, human
gtagcccgggactctttcac

SEQ ID NO: 12406 - DNA, 20 bp, human
ggcggagccaatgagggatg

SEQ ID NO: 12407 - DNA, 20 bp, human
gggccgagcggagccaatga

SEQ ID NO: 12408 - DNA, 20 bp, human
gtgtcggtgaagaaacgcgt

SEQ ID NO: 12409 - DNA, 20 bp, human
ggggcttgtgtgcgatctgt

SEQ ID NO: 12410 - DNA, 20 bp, human
gggccttgggaaccgtctcc

SEQ ID NO: 12411 - DNA, 20 bp, human
gtcatctaggccagaataca

SEQ ID NO: 12412 - DNA, 20 bp, human
ggtgtgcgatctgtaggctg

SEQ ID NO: 12413 - DNA, 20 bp, human
gcccaccaagggttagagaa

SEQ ID NO: 12414 - DNA, 20 bp, human
gtcggcaggagttcccatgg

SEQ ID NO: 12415 - DNA, 20 bp, human
gtgcccggagcaggatgtcc

SEQ ID NO: 12416 - DNA, 20 bp, human
gaagtagccccggggggcac

SEQ ID NO: 12417 - DNA, 20 bp, human
gagcctaatggaaggatcat

SEQ ID NO: 12418 - DNA, 20 bp, human
gtggtgtaagtagccccggg

SEQ ID NO: 12419 - DNA, 20 bp, human
ggccagaggcttgaagtgtg

SEQ ID NO: 12420 - DNA, 20 bp, human
gggagctggagacagattgt

SEQ ID NO: 12421 - DNA, 20 bp, human
gcacagggcgtggcaaggag

SEQ ID NO: 12422 - DNA, 20 bp, human
gttgaagtgtggggagaact

SEQ ID NO: 12423 - DNA, 20 bp, human
ggtatccgttccgccaaggg

SEQ ID NO: 12424 - DNA, 20 bp, human
gccgccttccccccaaagga

SEQ ID NO: 12425 - DNA, 20 bp, human
gtgagggaagggtagtctag

SEQ ID NO: 12426 - DNA, 20 bp, human
ggcgcgtgcaagggagaagc

SEQ ID NO: 12427 - DNA, 20 bp, human
gtgaagcgcgcgaaaagctg

SEQ ID NO: 12428 - DNA, 20 bp, human
gagcgcgcgaaaagctgagg

SEQ ID NO: 12429 - DNA, 20 bp, human
gagctgaggcggcaacgtcg

SEQ ID NO: 12430 - DNA, 20 bp, human
gctgcgcgggacggctctgt

SEQ ID NO: 12431 - DNA, 20 bp, human
gacggccccggcgcgtgcaa

SEQ ID NO: 12432 - DNA, 20 bp, human
gagtcaagaccgcattatgg

SEQ ID NO: 12433 - DNA, 20 bp, human
ggaggcggcaacgtcgggga

SEQ ID NO: 12434 - DNA, 20 bp, human
ggcgggacggctctgtagga

SEQ ID NO: 12435 - DNA, 20 bp, human
gtttgtttttgaatctgcgg

SEQ ID NO: 12436 - DNA, 20 bp, human
gtcacatgcatcaggaccag

SEQ ID NO: 12437 - DNA, 20 bp, human
gggccagaaatgcactacta

SEQ ID NO: 12438 - DNA, 20 bp, human
gctagtctttgtagctgctt

SEQ ID NO: 12439 - DNA, 20 bp, human
gaaacagtacatagcatggt

SEQ ID NO: 12440 - DNA, 20 bp, human
gagtaattggttcttacctc

SEQ ID NO: 12441 - DNA, 20 bp, human
gcatagcatggtggggtcaa

SEQ ID NO: 12442 - DNA, 20 bp, human
ggtagtctttgtgcaaaaca

SEQ ID NO: 12443 - DNA, 20 bp, human
gatggaaacagtacatagca

SEQ ID NO: 12444 - DNA, 20 bp, human
gggttttgtgaggtattgtg

SEQ ID NO: 12445 - DNA, 20 bp, human
ggaggggtgaacttagagct

SEQ ID NO: 12446 - DNA, 20 bp, human
gtaacggctgcggttcgaag

SEQ ID NO: 12447 - DNA, 20 bp, human
ggccggaccagcattgttaa

SEQ ID NO: 12448 - DNA, 20 bp, human
gtagggactgcggagggaag

SEQ ID NO: 12449 - DNA, 20 bp, human
ggtggctgtgggtattgctg

SEQ ID NO: 12450 - DNA, 20 bp, human
ggcgcccgtccgcccctcag

SEQ ID NO: 12451 - DNA, 20 bp, human
gccagcattgttaacggctg

SEQ ID NO: 12452 - DNA, 20 bp, human
gggcgagtgtcctgcgagag

SEQ ID NO: 12453 - DNA, 20 bp, human
gtatccctctgcgaaaacgg

SEQ ID NO: 12454 - DNA, 20 bp, human
ggctggtgcgtcgtcgctct

SEQ ID NO: 12455 - DNA, 20 bp, human
gcgtcgctctaggtacgttg

SEQ ID NO: 12456 - DNA, 20 bp, human
gaggccgcggacctgactga

SEQ ID NO: 12457 - DNA, 20 bp, human
gccgtggcggacctgactga

SEQ ID NO: 12458 - DNA, 20 bp, human
gccccgaggccaaccagaag

SEQ ID NO: 12459 - DNA, 20 bp, human
gacaggcctgcagttaccgg

SEQ ID NO: 12460 - DNA, 20 bp, human
gagcacaggcctgcagttac

SEQ ID NO: 12461 - DNA, 20 bp, human
gaggaagggcacgcgcgggt

SEQ ID NO: 12462 - DNA, 20 bp, human
gagtggggcaaggaccgtgt

SEQ ID NO: 12463 - DNA, 20 bp, human
ggggaggagacaaccggcaa

SEQ ID NO: 12464 - DNA, 20 bp, human
ggcgaggacactccctcctc

SEQ ID NO: 12465 - DNA, 20 bp, human
gggccgccgcgagcggggaa

SEQ ID NO: 12466 - DNA, 20 bp, human
gctccagcagcaattgaagt

SEQ ID NO: 12467 - DNA, 20 bp, human
ggcttggagacactcgagag

SEQ ID NO: 12468 - DNA, 20 bp, human
gacctcgggagaggagcggt

SEQ ID NO: 12469 - DNA, 20 bp, human
gagtgtggcagccaagtatc

SEQ ID NO: 12470 - DNA, 20 bp, human
gactggccgccacccctact

SEQ ID NO: 12471 - DNA, 20 bp, human
gttccgggcagagaggcggg

SEQ ID NO: 12472 - DNA, 20 bp, human
gctacaccgatagacagaga

SEQ ID NO: 12473 - DNA, 20 bp, human
gctgggcggggcaggcacta

SEQ ID NO: 12474 - DNA, 20 bp, human
gtcagattgcatccgagtag

SEQ ID NO: 12475 - DNA, 20 bp, human
gcgactacagacctcgggag

SEQ ID NO: 12476 - DNA, 20 bp, human
gcgtcgccgatagacaccta

SEQ ID NO: 12477 - DNA, 20 bp, human
gtctctcagcgcccccgggt

SEQ ID NO: 12478 - DNA, 20 bp, human
gcccccggccattaccgaag

SEQ ID NO: 12479 - DNA, 20 bp, human
gaaacaaacactaacgatgg

SEQ ID NO: 12480 - DNA, 20 bp, human
gggcccaggggattgaaccg

SEQ ID NO: 12481 - DNA, 20 bp, human
gctgcttcgtggaagtagaa

SEQ ID NO: 12482 - DNA, 20 bp, human
gcttcccacagaaaactcag

SEQ ID NO: 12483 - DNA, 20 bp, human
ggttagtacctgcgaagctg

SEQ ID NO: 12484 - DNA, 20 bp, human
ggatgaaccgcaggtagccg

SEQ ID NO: 12485 - DNA, 20 bp, human
ggaagagcgccagtcgacgt

SEQ ID NO: 12486 - DNA, 20 bp, human
gcagcgtaggggccagatga

SEQ ID NO: 12487 - DNA, 20 bp, human
gcatcatggcgtctcccagt

SEQ ID NO: 12488 - DNA, 20 bp, human
ggccgcgaccgggagaggta

SEQ ID NO: 12489 - DNA, 20 bp, human
gtggcccctacgctgtcctc

SEQ ID NO: 12490 - DNA, 20 bp, human
gctaccagaggacagcgtag

SEQ ID NO: 12491 - DNA, 20 bp, human
gagaggagagccagtcacgt

SEQ ID NO: 12492 - DNA, 20 bp, human
gccaggagcctccagcgccc

SEQ ID NO: 12493 - DNA, 20 bp, human
gacggagtccaccaggtccc

SEQ ID NO: 12494 - DNA, 20 bp, human
ggtagctagctgctctgcac

SEQ ID NO: 12495 - DNA, 20 bp, human
ggtggactccgtggacgatg

SEQ ID NO: 12496 - DNA, 20 bp, human
gggagctcacctccacacac

SEQ ID NO: 12497 - DNA, 20 bp, human
gcccaagcgcgggttacccg

SEQ ID NO: 12498 - DNA, 20 bp, human
gggcagtccccgaggccatc

SEQ ID NO: 12499 - DNA, 20 bp, human
ggcgggaatgccggcaatcc

SEQ ID NO: 12500 - DNA, 20 bp, human
gaggtgagctccgggattgc

SEQ ID NO: 12501 - DNA, 20 bp, human
gcgggaccggctgcagagac

SEQ ID NO: 12502 - DNA, 20 bp, human
ggccggaagaccgtcccgga

SEQ ID NO: 12503 - DNA, 20 bp, human
gaccgtcccggatggcctcg

SEQ ID NO: 12504 - DNA, 20 bp, human
gccacatctcggagcaactg

SEQ ID NO: 12505 - DNA, 20 bp, human
ggcaactgaggcgccgggac

SEQ ID NO: 12506 - DNA, 20 bp, human
ggccgcgctctcccgcctag

SEQ ID NO: 12507 - DNA, 20 bp, human
gggaggaacgcgccgctagg

SEQ ID NO: 12508 - DNA, 20 bp, human
gccgtcctgaggggcgacga

SEQ ID NO: 12509 - DNA, 20 bp, human
gcccggcctggcgccgtcct

SEQ ID NO: 12510 - DNA, 20 bp, human
gaggcgggagagcgcggcca

SEQ ID NO: 12511 - DNA, 20 bp, human
gggcctggcgccgtcctggg

SEQ ID NO: 12512 - DNA, 20 bp, human
gctggaaacgccacatcgtg

SEQ ID NO: 12513 - DNA, 20 bp, human
ggccgctaggcgggagagcg

SEQ ID NO: 12514 - DNA, 20 bp, human
gcctgcaaaaccaacacccg

SEQ ID NO: 12515 - DNA, 20 bp, human
ggcactcgggtcacaggcgg

SEQ ID NO: 12516 - DNA, 20 bp, human
ggtagtggtgcagcaagtag

SEQ ID NO: 12517 - DNA, 20 bp, human
gcgggggctctagtgaacag

SEQ ID NO: 12518 - DNA, 20 bp, human
gtgccctctccaggcgtcag

SEQ ID NO: 12519 - DNA, 20 bp, human
ggaagaagtgacctaagtag

SEQ ID NO: 12520 - DNA, 20 bp, human
ggaactgaagaggccagccg

SEQ ID NO: 12521 - DNA, 20 bp, human
gtcagcctcgatctgtacaa

SEQ ID NO: 12522 - DNA, 20 bp, human
gtgcctctgacgcctggaga

SEQ ID NO: 12523 - DNA, 20 bp, human
gcccgccggcgatccccgtc

SEQ ID NO: 12524 - DNA, 20 bp, human
gggagccggacggggatcgc

SEQ ID NO: 12525 - DNA, 20 bp, human
gggctccctgcggcaggatc

SEQ ID NO: 12526 - DNA, 20 bp, human
gaggcgcgttcccggctgta

SEQ ID NO: 12527 - DNA, 20 bp, human
gggcggcgcgccgggagtct

SEQ ID NO: 12528 - DNA, 20 bp, human
gcaggagcgtccctacagcc

SEQ ID NO: 12529 - DNA, 20 bp, human
ggccaaggcatagtgactgc

SEQ ID NO: 12530 - DNA, 20 bp, human
gtcagcctggacctgtacca

SEQ ID NO: 12531 - DNA, 20 bp, human
gagccggagtcgctaccccg

SEQ ID NO: 12532 - DNA, 20 bp, human
gcggaagtgacgccacactg

SEQ ID NO: 12533 - DNA, 20 bp, human
gggactcccggcaccaaata

SEQ ID NO: 12534 - DNA, 20 bp, human
gcggcaggccctcttcttga

SEQ ID NO: 12535 - DNA, 20 bp, human
gtggactccgaaaacggcca

SEQ ID NO: 12536 - DNA, 20 bp, human
ggactccctggcccctgaca

SEQ ID NO: 12537 - DNA, 20 bp, human
gtcacgtgaggccccggtgg

SEQ ID NO: 12538 - DNA, 20 bp, human
gcccggctggcagcacccga

SEQ ID NO: 12539 - DNA, 20 bp, human
ggaaagtgcagccgtgtcag

SEQ ID NO: 12540 - DNA, 20 bp, human
gggggccgaagggagacctg

SEQ ID NO: 12541 - DNA, 20 bp, human
gggagacctgaggtgagaag

SEQ ID NO: 12542 - DNA, 20 bp, human
ggccgggtgctgatgcgagt

SEQ ID NO: 12543 - DNA, 20 bp, human
ggaccgcgcagagttatgac

SEQ ID NO: 12544 - DNA, 20 bp, human
ggaacagccggttaagacta

SEQ ID NO: 12545 - DNA, 20 bp, human
ggcgcgagtgaagcaaagcg

SEQ ID NO: 12546 - DNA, 20 bp, human
gggagaatggagtcaggtac

SEQ ID NO: 12547 - DNA, 20 bp, human
gtgtgccagggtgatgccaa

SEQ ID NO: 12548 - DNA, 20 bp, human
gtggcaggcggaagggacaa

SEQ ID NO: 12549 - DNA, 20 bp, human
gtccaccggcaacttgacta

SEQ ID NO: 12550 - DNA, 20 bp, human
gccggcaacttgactacgga

SEQ ID NO: 12551 - DNA, 20 bp, human
ggcggtgtggcatcaggaca

SEQ ID NO: 12552 - DNA, 20 bp, human
gggagggtagccacagtcac

SEQ ID NO: 12553 - DNA, 20 bp, human
gaggcagggtgtgatgccgt

SEQ ID NO: 12554 - DNA, 20 bp, human
gtgcaggtcaggaaccccgg

SEQ ID NO: 12555 - DNA, 20 bp, human
gtggagtcaggtacggggag

SEQ ID NO: 12556 - DNA, 20 bp, human
gctgcggaaagaccgacccc

SEQ ID NO: 12557 - DNA, 20 bp, human
ggcaggggaggccaatgata

SEQ ID NO: 12558 - DNA, 20 bp, human
gggcagcccgacccgagcag

SEQ ID NO: 12559 - DNA, 20 bp, human
gggccgccgactgacccgag

SEQ ID NO: 12560 - DNA, 20 bp, human
gggactgggaagatggacgc

SEQ ID NO: 12561 - DNA, 20 bp, human
gcgccgctcgggtcagtcgg

SEQ ID NO: 12562 - DNA, 20 bp, human
gcgacgccgctcgggtcagt

SEQ ID NO: 12563 - DNA, 20 bp, human
gcgcaggtgaggagttgccg

SEQ ID NO: 12564 - DNA, 20 bp, human
ggaagctccagcgcaaccga

SEQ ID NO: 12565 - DNA, 20 bp, human
gggtcagtcggcggccggac

SEQ ID NO: 12566 - DNA, 20 bp, human
ggtagctgcggcgctgaggt

SEQ ID NO: 12567 - DNA, 20 bp, human
gagagcactggcatgaggag

SEQ ID NO: 12568 - DNA, 20 bp, human
gaacagggccgacagagcac

SEQ ID NO: 12569 - DNA, 20 bp, human
gaatggatgcgatagatcag

SEQ ID NO: 12570 - DNA, 20 bp, human
gaaaccgtaagcctaactgt

SEQ ID NO: 12571 - DNA, 20 bp, human
gggcatgaggaggggtcaaa

SEQ ID NO: 12572 - DNA, 20 bp, human
ggtgcgggctggttttgtgg

SEQ ID NO: 12573 - DNA, 20 bp, human
gaccctgtggccaaccatct

SEQ ID NO: 12574 - DNA, 20 bp, human
gctcaaagtacctgtagctg

SEQ ID NO: 12575 - DNA, 20 bp, human
gtgtgcaggagccaccaacc

SEQ ID NO: 12576 - DNA, 20 bp, human
gtgcctggcccggtaccctg

SEQ ID NO: 12577 - DNA, 20 bp, human
gtactcggcccccgtcccca

SEQ ID NO: 12578 - DNA, 20 bp, human
gcaggaccccggatgacggt

SEQ ID NO: 12579 - DNA, 20 bp, human
gtggcccgctaagatggcga

SEQ ID NO: 12580 - DNA, 20 bp, human
gaacaacgtcaagtacggtg

SEQ ID NO: 12581 - DNA, 20 bp, human
gtgcggccgctgccccccaa

SEQ ID NO: 12582 - DNA, 20 bp, human
ggagggggcccggagatcgt

SEQ ID NO: 12583 - DNA, 20 bp, human
gcgtcaagtacggtgaggag

SEQ ID NO: 12584 - DNA, 20 bp, human
gcctggaacaacgtcaagta

SEQ ID NO: 12585 - DNA, 20 bp, human
gcccttcaggcccttatcgg

SEQ ID NO: 12586 - DNA, 20 bp, human
gtaggtgtggtaggaaggag

SEQ ID NO: 12587 - DNA, 20 bp, human
gccccgcaggacagtgtgtc

SEQ ID NO: 12588 - DNA, 20 bp, human
gcgcaggacagtgtgtcagg

SEQ ID NO: 12589 - DNA, 20 bp, human
gccaccggagcgcggaatct

SEQ ID NO: 12590 - DNA, 20 bp, human
gccggctccccgcactggtg

SEQ ID NO: 12591 - DNA, 20 bp, human
ggcgcagccgcaaaaagcac

SEQ ID NO: 12592 - DNA, 20 bp, human
gacactgtcctgcggggacg

SEQ ID NO: 12593 - DNA, 20 bp, human
gattccgcgctccggtgggg

SEQ ID NO: 12594 - DNA, 20 bp, human
gtgtgtgaggaaattcctag

SEQ ID NO: 12595 - DNA, 20 bp, human
gggagccatagcttggagta

SEQ ID NO: 12596 - DNA, 20 bp, human
gcgcgcctcagagagagctg

SEQ ID NO: 12597 - DNA, 20 bp, human
gagcggcggtaagtgagccg

SEQ ID NO: 12598 - DNA, 20 bp, human
ggttgccggaagttgagcgg

SEQ ID NO: 12599 - DNA, 20 bp, human
gggacgcggctacagacgaa

SEQ ID NO: 12600 - DNA, 20 bp, human
ggcggcgggcgagggtgtag

SEQ ID NO: 12601 - DNA, 20 bp, human
gggaccgcgttgcgtcatcg

SEQ ID NO: 12602 - DNA, 20 bp, human
gggaatcagtgagtccctgg

SEQ ID NO: 12603 - DNA, 20 bp, human
gggcggtaagtgagccgcgg

SEQ ID NO: 12604 - DNA, 20 bp, human
gaaagcagcttagatgggga

SEQ ID NO: 12605 - DNA, 20 bp, human
gcctaccaagaggacaggag

SEQ ID NO: 12606 - DNA, 20 bp, human
gaccagggcccgtggagccc

SEQ ID NO: 12607 - DNA, 20 bp, human
ggaatcccaggccccgtgtc

SEQ ID NO: 12608 - DNA, 20 bp, human
ggcgacccgggtgattccag

SEQ ID NO: 12609 - DNA, 20 bp, human
gtacagctgatagcccgggt

SEQ ID NO: 12610 - DNA, 20 bp, human
ggtgattccagaggctccgc

SEQ ID NO: 12611 - DNA, 20 bp, human
gacctcaggaacagcgaccc

SEQ ID NO: 12612 - DNA, 20 bp, human
gggttcctgcggatgttgca

SEQ ID NO: 12613 - DNA, 20 bp, human
ggagtggtgacttccctgag

SEQ ID NO: 12614 - DNA, 20 bp, human
gggcctgggattccaataac

SEQ ID NO: 12615 - DNA, 20 bp, human
gcaagatccacggcccccag

SEQ ID NO: 12616 - DNA, 20 bp, human
gggccacggcttctccagaa

SEQ ID NO: 12617 - DNA, 20 bp, human
gtggagtgggatccccagga

SEQ ID NO: 12618 - DNA, 20 bp, human
gtcggctcaccatcaggcca

SEQ ID NO: 12619 - DNA, 20 bp, human
gcttctccagaaaggttgga

SEQ ID NO: 12620 - DNA, 20 bp, human
gacggcttctccagaaaggt

SEQ ID NO: 12621 - DNA, 20 bp, human
gccgcagcccaggagagtcc

SEQ ID NO: 12622 - DNA, 20 bp, human
ggcctgatggtgagccgaat

SEQ ID NO: 12623 - DNA, 20 bp, human
ggcactgctgtgagggagtg

SEQ ID NO: 12624 - DNA, 20 bp, human
ggcccattcggctcaccatc

SEQ ID NO: 12625 - DNA, 20 bp, human
gcaggtccccggcatgaagg

SEQ ID NO: 12626 - DNA, 20 bp, human
gggaccgcggaccttcctgg

SEQ ID NO: 12627 - DNA, 20 bp, human
gggtcgccgggcgccagcgt

SEQ ID NO: 12628 - DNA, 20 bp, human
gaggagctcgactctcagag

SEQ ID NO: 12629 - DNA, 20 bp, human
gggttaggactggaattcta

SEQ ID NO: 12630 - DNA, 20 bp, human
gggagggagagacacactca

SEQ ID NO: 12631 - DNA, 20 bp, human
gggtcccgaccacagagggt

SEQ ID NO: 12632 - DNA, 20 bp, human
gggcaagaccggggttgtgg

SEQ ID NO: 12633 - DNA, 20 bp, human
gcgcaggtcccgaccacaga

SEQ ID NO: 12634 - DNA, 20 bp, human
ggaattctaaggtagcagga

SEQ ID NO: 12635 - DNA, 20 bp, human
ggcgccaccaggaaggtccg

SEQ ID NO: 12636 - DNA, 20 bp, human
gggcaaatgcctgttattct

SEQ ID NO: 12637 - DNA, 20 bp, human
ggctcccacgcctggacttc

SEQ ID NO: 12638 - DNA, 20 bp, human
gaccacgtgcgcaggtagga

SEQ ID NO: 12639 - DNA, 20 bp, human
gcagctcggtgaggccctag

SEQ ID NO: 12640 - DNA, 20 bp, human
gtgggttcagggcgagcggg

SEQ ID NO: 12641 - DNA, 20 bp, human
gctggtctggcagtcaggta

SEQ ID NO: 12642 - DNA, 20 bp, human
gacacccgcgagctgctcta

SEQ ID NO: 12643 - DNA, 20 bp, human
gcggcaccacgtgcgcaggt

SEQ ID NO: 12644 - DNA, 20 bp, human
gcactgggttcagggcgagc

SEQ ID NO: 12645 - DNA, 20 bp, human
gtaggagggctgccgggatg

SEQ ID NO: 12646 - DNA, 20 bp, human
gcaacctgcggccccggaga

SEQ ID NO: 12647 - DNA, 20 bp, human
ggcgctcgctgccttctccg

SEQ ID NO: 12648 - DNA, 20 bp, human
gggaacccacaagtccccgg

SEQ ID NO: 12649 - DNA, 20 bp, human
gcggggccgcaggttgctgg

SEQ ID NO: 12650 - DNA, 20 bp, human
gtcctcccaaccgatcgcta

SEQ ID NO: 12651 - DNA, 20 bp, human
gctgtccaaatgctgggagg

SEQ ID NO: 12652 - DNA, 20 bp, human
ggtccccggaggcgcctggt

SEQ ID NO: 12653 - DNA, 20 bp, human
gagcgaactgcgcccagcgc

SEQ ID NO: 12654 - DNA, 20 bp, human
ggccgcaggttgctggcggt

SEQ ID NO: 12655 - DNA, 20 bp, human
ggcagttcgctcagactctg

SEQ ID NO: 12656 - DNA, 20 bp, human
gagggcagcaaccgcaccag

SEQ ID NO: 12657 - DNA, 20 bp, human
gtagctgctgggagaaccag

SEQ ID NO: 12658 - DNA, 20 bp, human
gtcggtacaagatggcggag

SEQ ID NO: 12659 - DNA, 20 bp, human
gaaggtcggggcggacacgg

SEQ ID NO: 12660 - DNA, 20 bp, human
gaggccgccccctaaggtcg

SEQ ID NO: 12661 - DNA, 20 bp, human
gggctcaaggccgcccccta

SEQ ID NO: 12662 - DNA, 20 bp, human
gtgtccgccccgaccttagg

SEQ ID NO: 12663 - DNA, 20 bp, human
gcggagctcgccggacggag

SEQ ID NO: 12664 - DNA, 20 bp, human
gccgccccctaaggtcgggg

SEQ ID NO: 12665 - DNA, 20 bp, human
gcgcagcgcgcggcctgaaa

SEQ ID NO: 12666 - DNA, 20 bp, human
gtggcccaacggacagcccg

SEQ ID NO: 12667 - DNA, 20 bp, human
gagcaggggtgcagaggaga

SEQ ID NO: 12668 - DNA, 20 bp, human
gcggcccttgggccgcccag

SEQ ID NO: 12669 - DNA, 20 bp, human
gcagaggagagggacgggtg

SEQ ID NO: 12670 - DNA, 20 bp, human
ggtgcgggcgggaacgaacc

SEQ ID NO: 12671 - DNA, 20 bp, human
gccagccccgggacgaggaa

SEQ ID NO: 12672 - DNA, 20 bp, human
ggccccgggacgaggaaggg

SEQ ID NO: 12673 - DNA, 20 bp, human
gaagggccggtggtccccgt

SEQ ID NO: 12674 - DNA, 20 bp, human
gcgcccccggccgaaaagta

SEQ ID NO: 12675 - DNA, 20 bp, human
gcgggccctggtgccgccgg

SEQ ID NO: 12676 - DNA, 20 bp, human
gttgaaccggaagcgggagt

SEQ ID NO: 12677 - DNA, 20 bp, human
gtaggtagctgcgtggctaa

SEQ ID NO: 12678 - DNA, 20 bp, human
ggaggagtcaagggccactc

SEQ ID NO: 12679 - DNA, 20 bp, human
gtaacggagaaaagaagccg

SEQ ID NO: 12680 - DNA, 20 bp, human
gaagaagccgtggccgcggg

SEQ ID NO: 12681 - DNA, 20 bp, human
gtcgcctcctcccgcggcca

SEQ ID NO: 12682 - DNA, 20 bp, human
gagtcaagggccactctgga

SEQ ID NO: 12683 - DNA, 20 bp, human
ggcctcgcggttaagagctt

SEQ ID NO: 12684 - DNA, 20 bp, human
ggcgggagtaggtagctgcg

SEQ ID NO: 12685 - DNA, 20 bp, human
gggcgctgggcagtcacgca

SEQ ID NO: 12686 - DNA, 20 bp, human
ggggacagctcgctcaccga

SEQ ID NO: 12687 - DNA, 20 bp, human
gcagggcgctcgtccccccg

SEQ ID NO: 12688 - DNA, 20 bp, human
gggatcagctcccccgccgg

SEQ ID NO: 12689 - DNA, 20 bp, human
ggccgcccggcccagttcgt

SEQ ID NO: 12690 - DNA, 20 bp, human
gcgagagccgcctccggccg

SEQ ID NO: 12691 - DNA, 20 bp, human
gctggctccaacaaagcgcc

SEQ ID NO: 12692 - DNA, 20 bp, human
ggcgtccggcacgacactcg

SEQ ID NO: 12693 - DNA, 20 bp, human
gcggcgcgcgaagccggcct

SEQ ID NO: 12694 - DNA, 20 bp, human
gcaggcggtggctcttgact

SEQ ID NO: 12695 - DNA, 20 bp, human
gagggttcgagagccgcctc

SEQ ID NO: 12696 - DNA, 20 bp, human
gcggccccgacccccccgga

SEQ ID NO: 12697 - DNA, 20 bp, human
gactcgcacaggaaagcgga

SEQ ID NO: 12698 - DNA, 20 bp, human
gtgcgtccggcgactcgcac

SEQ ID NO: 12699 - DNA, 20 bp, human
ggcggcggccccgacccccc

SEQ ID NO: 12700 - DNA, 20 bp, human
gagccgcggtccctccgaaa

SEQ ID NO: 12701 - DNA, 20 bp, human
ggtcgccgccgcgacgacgg

SEQ ID NO: 12702 - DNA, 20 bp, human
gccccgacccccccggaggg

SEQ ID NO: 12703 - DNA, 20 bp, human
ggaaagcggacggcgaaggg

SEQ ID NO: 12704 - DNA, 20 bp, human
gcaggaaagcggacggcgaa

SEQ ID NO: 12705 - DNA, 20 bp, human
gcggtccctccgaaatggcc

SEQ ID NO: 12706 - DNA, 20 bp, human
gctcggaggctcaggatcgg

SEQ ID NO: 12707 - DNA, 20 bp, human
gtctgaggcacccagctccg

SEQ ID NO: 12708 - DNA, 20 bp, human
gtggtgtgtgatctccgagt

SEQ ID NO: 12709 - DNA, 20 bp, human
ggtgatctccgagtgggtgg

SEQ ID NO: 12710 - DNA, 20 bp, human
ggcggttgcgggagatgatg

SEQ ID NO: 12711 - DNA, 20 bp, human
gggggaatgtagcaaatact

SEQ ID NO: 12712 - DNA, 20 bp, human
gcccgggccggtgaaagtgc

SEQ ID NO: 12713 - DNA, 20 bp, human
gacagctcaggcgggtagac

SEQ ID NO: 12714 - DNA, 20 bp, human
gacctcgtcccggggcgcag

SEQ ID NO: 12715 - DNA, 20 bp, human
gtgggctgaagtgaaggagt

SEQ ID NO: 12716 - DNA, 20 bp, human
gccgctcaggacctgcgcgt

SEQ ID NO: 12717 - DNA, 20 bp, human
ggcttgcaggacttcatccc

SEQ ID NO: 12718 - DNA, 20 bp, human
gtccccggccccaagcagcg

SEQ ID NO: 12719 - DNA, 20 bp, human
gaagcccagcggcccgccgg

SEQ ID NO: 12720 - DNA, 20 bp, human
gcttcctgcaaaggagtctc

SEQ ID NO: 12721 - DNA, 20 bp, human
ggcgcaggtcctgagcgggc

SEQ ID NO: 12722 - DNA, 20 bp, human
gtgctcagaagaggcacgtt

SEQ ID NO: 12723 - DNA, 20 bp, human
gctcccgccggcgggccgct

SEQ ID NO: 12724 - DNA, 20 bp, human
gggtcggcgcctcgctgctt

SEQ ID NO: 12725 - DNA, 20 bp, human
gggtgtggctggttcgagga

SEQ ID NO: 12726 - DNA, 20 bp, human
ggctgcgggacaggacccat

SEQ ID NO: 12727 - DNA, 20 bp, human
gtgtgcgtgaaggagctgaa

SEQ ID NO: 12728 - DNA, 20 bp, human
gtccgcgcgtcggagacctc

SEQ ID NO: 12729 - DNA, 20 bp, human
gcggccgttcccccaagagg

SEQ ID NO: 12730 - DNA, 20 bp, human
ggggagagccagagactcct

SEQ ID NO: 12731 - DNA, 20 bp, human
gtcacgcacacggtcttcca

SEQ ID NO: 12732 - DNA, 20 bp, human
gcgcagcccgttggtggcta

SEQ ID NO: 12733 - DNA, 20 bp, human
gcggccttaagaagctcaag

SEQ ID NO: 12734 - DNA, 20 bp, human
gttaagaagctcaagcggaa

SEQ ID NO: 12735 - DNA, 20 bp, human
gccgcgccgtagccaccaac

SEQ ID NO: 12736 - DNA, 20 bp, human
gggacggcgcaaccactcac

SEQ ID NO: 12737 - DNA, 20 bp, human
gccactcaccggcatgactg

SEQ ID NO: 12738 - DNA, 20 bp, human
gaccggcatgactgaggcag

SEQ ID NO: 12739 - DNA, 20 bp, human
gggaggaaggctcagggact

SEQ ID NO: 12740 - DNA, 20 bp, human
gtgaggcagcggcggtgtgg

SEQ ID NO: 12741 - DNA, 20 bp, human
ggcagccaggaggaaggctc

SEQ ID NO: 12742 - DNA, 20 bp, human
ggccgctgcctcagtcatgc

SEQ ID NO: 12743 - DNA, 20 bp, human
gggcctgaaggagggcggtg

SEQ ID NO: 12744 - DNA, 20 bp, human
gtccttcaggccagctccgc

SEQ ID NO: 12745 - DNA, 20 bp, human
gcggtgtggcggcggtgtgg

SEQ ID NO: 12746 - DNA, 20 bp, human
gggctggacgggagtggacg

SEQ ID NO: 12747 - DNA, 20 bp, human
ggcgggcggcgaggacaagg

SEQ ID NO: 12748 - DNA, 20 bp, human
gccagcacctggccgacaac

SEQ ID NO: 12749 - DNA, 20 bp, human
gcagggtcctcggcgcccgg

SEQ ID NO: 12750 - DNA, 20 bp, human
gactgctcgaacaggttctt

SEQ ID NO: 12751 - DNA, 20 bp, human
gcggcgcgggcgggcgtgag

SEQ ID NO: 12752 - DNA, 20 bp, human
ggtagtcttgagccggttgt

SEQ ID NO: 12753 - DNA, 20 bp, human
gctgcggctggcgcggccaa

SEQ ID NO: 12754 - DNA, 20 bp, human
gagtccccagggcgcaagct

SEQ ID NO: 12755 - DNA, 20 bp, human
gcctggggactgcggccggg

SEQ ID NO: 12756 - DNA, 20 bp, human
gttcactcttgggcctagcg

SEQ ID NO: 12757 - DNA, 20 bp, human
gtactggagtctgctcaata

SEQ ID NO: 12758 - DNA, 20 bp, human
gagggacgtcagctttgctg

SEQ ID NO: 12759 - DNA, 20 bp, human
gccgagtcccagaacagtga

SEQ ID NO: 12760 - DNA, 20 bp, human
gaaacagtgcttgaaagtgg

SEQ ID NO: 12761 - DNA, 20 bp, human
gagaaaagtagtcatatcct

SEQ ID NO: 12762 - DNA, 20 bp, human
ggctacttcctcactcaaca

SEQ ID NO: 12763 - DNA, 20 bp, human
gattcttctctttcactctt

SEQ ID NO: 12764 - DNA, 20 bp, human
ggccttaacctatataatgg

SEQ ID NO: 12765 - DNA, 20 bp, human
gtagcaagtctgtgaatgtg

SEQ ID NO: 12766 - DNA, 20 bp, human
gcaaattcgaagagtgaaag

SEQ ID NO: 12767 - DNA, 20 bp, human
gcatctcccaaactcagctg

SEQ ID NO: 12768 - DNA, 20 bp, human
gagaaggctgggacagtcag

SEQ ID NO: 12769 - DNA, 20 bp, human
gtgtacacgcgggcatacac

SEQ ID NO: 12770 - DNA, 20 bp, human
gtggctcccgcagctgagtt

SEQ ID NO: 12771 - DNA, 20 bp, human
gcacgactagggaagtggag

SEQ ID NO: 12772 - DNA, 20 bp, human
gtgcacacgcgggcgcacac

SEQ ID NO: 12773 - DNA, 20 bp, human
ggggtgggcggtgaagcaga

SEQ ID NO: 12774 - DNA, 20 bp, human
gtctgcagcctggcggagac

SEQ ID NO: 12775 - DNA, 20 bp, human
gttcccggaaggcaaatggc

SEQ ID NO: 12776 - DNA, 20 bp, human
ggtgcccacctagaccccgt

SEQ ID NO: 12777 - DNA, 20 bp, human
gtcggcagctgctccactgg

SEQ ID NO: 12778 - DNA, 20 bp, human
gcttccgacggggtctaggt

SEQ ID NO: 12779 - DNA, 20 bp, human
gacgtgcgcgcccggagcag

SEQ ID NO: 12780 - DNA, 20 bp, human
ggaccccgtcggaagcccca

SEQ ID NO: 12781 - DNA, 20 bp, human
gcggtccgagtcccagacat

SEQ ID NO: 12782 - DNA, 20 bp, human
gcctcggagttgacaccctg

SEQ ID NO: 12783 - DNA, 20 bp, human
gccgagcgggcggaccgacg

SEQ ID NO: 12784 - DNA, 20 bp, human
gctagtaccccggagcccat

SEQ ID NO: 12785 - DNA, 20 bp, human
gctccgggcgcgcacgtcac

SEQ ID NO: 12786 - DNA, 20 bp, human
ggccgcgcctgtaggactcg

SEQ ID NO: 12787 - DNA, 20 bp, human
gcgtcggccccgagtcctac

SEQ ID NO: 12788 - DNA, 20 bp, human
ggagccggagaagccccgtg

SEQ ID NO: 12789 - DNA, 20 bp, human
ggcgccgcgtccccatcccg

SEQ ID NO: 12790 - DNA, 20 bp, human
gtgacaacggtcaataatga

SEQ ID NO: 12791 - DNA, 20 bp, human
ggcgcccggctaggccgcag

SEQ ID NO: 12792 - DNA, 20 bp, human
ggcgcggagccgggaggcca

SEQ ID NO: 12793 - DNA, 20 bp, human
gaatgaaggtggctgcggcg

SEQ ID NO: 12794 - DNA, 20 bp, human
gcaacggtcaataatgaagg

SEQ ID NO: 12795 - DNA, 20 bp, human
ggcgccccgcgggacccgga

SEQ ID NO: 12796 - DNA, 20 bp, human
gcagaaatttggcaacacaa

SEQ ID NO: 12797 - DNA, 20 bp, human
gtgagttgctgagaccccaa

SEQ ID NO: 12798 - DNA, 20 bp, human
gtatagattacaaacctcag

SEQ ID NO: 12799 - DNA, 20 bp, human
gatactgacatgcagaaatt

SEQ ID NO: 12800 - DNA, 20 bp, human
gcttaaagataggagcagtg

SEQ ID NO: 12801 - DNA, 20 bp, human
ggattacaaacctcagaggc

SEQ ID NO: 12802 - DNA, 20 bp, human
gaaggaacactgagagtcgc

SEQ ID NO: 12803 - DNA, 20 bp, human
ggcaggttacttcctataaa

SEQ ID NO: 12804 - DNA, 20 bp, human
gtcctgagggtaatcgtaaa

SEQ ID NO: 12805 - DNA, 20 bp, human
ggaaaggctgtgtgtagaga

SEQ ID NO: 12806 - DNA, 20 bp, human
gggccagcggacgcctcgga

SEQ ID NO: 12807 - DNA, 20 bp, human
gggagaaacgccccgtcccg

SEQ ID NO: 12808 - DNA, 20 bp, human
gcggagggtaggaaacccgc

SEQ ID NO: 12809 - DNA, 20 bp, human
ggggaccgacagctaggggt

SEQ ID NO: 12810 - DNA, 20 bp, human
gcccgtcccggggcaagggg

SEQ ID NO: 12811 - DNA, 20 bp, human
gcctcgtgtggctgtggcag

SEQ ID NO: 12812 - DNA, 20 bp, human
ggggaaagaagccagtccag

SEQ ID NO: 12813 - DNA, 20 bp, human
gggagggggaccgacagcta

SEQ ID NO: 12814 - DNA, 20 bp, human
gaagcgaggaaaaggcgaag

SEQ ID NO: 12815 - DNA, 20 bp, human
gctgacgggaagcgaggaaa

SEQ ID NO: 12816 - DNA, 20 bp, human
gggtaaagcagcccggcgaa

SEQ ID NO: 12817 - DNA, 20 bp, human
gcttgggctgcccgtcaggc

SEQ ID NO: 12818 - DNA, 20 bp, human
ggcggcgctaggaaagatgg

SEQ ID NO: 12819 - DNA, 20 bp, human
gagcgcggcgctaggaaaga

SEQ ID NO: 12820 - DNA, 20 bp, human
ggcgtgcgcgaggcagatgg

SEQ ID NO: 12821 - DNA, 20 bp, human
gtagcgccgcgctcacttcc

SEQ ID NO: 12822 - DNA, 20 bp, human
gggcgaatggcagcaccgtg

SEQ ID NO: 12823 - DNA, 20 bp, human
ggcagctgggacccacggcg

SEQ ID NO: 12824 - DNA, 20 bp, human
ggcgagcccgacccccagca

SEQ ID NO: 12825 - DNA, 20 bp, human
gcgtcaggccggaccccgca

SEQ ID NO: 12826 - DNA, 20 bp, human
gggctggagcagggctgacg

SEQ ID NO: 12827 - DNA, 20 bp, human
gggagggactgcggcagtgt

SEQ ID NO: 12828 - DNA, 20 bp, human
gtgggccaccaggctcggcg

SEQ ID NO: 12829 - DNA, 20 bp, human
gagtccccgtcaaaagggag

SEQ ID NO: 12830 - DNA, 20 bp, human
gcgtctctgggaagaaaccg

SEQ ID NO: 12831 - DNA, 20 bp, human
gggcttgcggcgcgcacgga

SEQ ID NO: 12832 - DNA, 20 bp, human
gcgcccggcttccaatcccg

SEQ ID NO: 12833 - DNA, 20 bp, human
gccccagccccggcgtctct

SEQ ID NO: 12834 - DNA, 20 bp, human
ggggagggaccggctgcgag

SEQ ID NO: 12835 - DNA, 20 bp, human
ggtgagtgcggagtccgggt

SEQ ID NO: 12836 - DNA, 20 bp, human
ggccggcagggcgagaacaa

SEQ ID NO: 12837 - DNA, 20 bp, human
gtcctccgcggcctccctcg

SEQ ID NO: 12838 - DNA, 20 bp, human
gcggatgtgaggtcacgtgg

SEQ ID NO: 12839 - DNA, 20 bp, human
gatcacgctgcggggagagc

SEQ ID NO: 12840 - DNA, 20 bp, human
ggactcccgcgccggatgtg

SEQ ID NO: 12841 - DNA, 20 bp, human
ggcggcgcccgatcacgctg

SEQ ID NO: 12842 - DNA, 20 bp, human
gggcagggcgagaacaaggg

SEQ ID NO: 12843 - DNA, 20 bp, human
ggcgccggccgagggcgatg

SEQ ID NO: 12844 - DNA, 20 bp, human
ggcgctgcggctcagggtga

SEQ ID NO: 12845 - DNA, 20 bp, human
gaggtcgaggaggcgaatgg

SEQ ID NO: 12846 - DNA, 20 bp, human
gcgtctgcacgacaaggtca

SEQ ID NO: 12847 - DNA, 20 bp, human
gtggaagcgtctgcacgaca

SEQ ID NO: 12848 - DNA, 20 bp, human
gctgcggtggctcggcgagt

SEQ ID NO: 12849 - DNA, 20 bp, human
gagaactggctataccaatg

SEQ ID NO: 12850 - DNA, 20 bp, human
gtaggtgttttgaacagaac

SEQ ID NO: 12851 - DNA, 20 bp, human
gacaagaatcataaagtgca

SEQ ID NO: 12852 - DNA, 20 bp, human
gattcttgtttgagcctcat

SEQ ID NO: 12853 - DNA, 20 bp, human
gagcaaatttctgctgtcag

SEQ ID NO: 12854 - DNA, 20 bp, human
gtcaaggaggagttttaacc

SEQ ID NO: 12855 - DNA, 20 bp, human
gaaagagttaatgatcctcc

SEQ ID NO: 12856 - DNA, 20 bp, human
gagcccaaggcggtgagtat

SEQ ID NO: 12857 - DNA, 20 bp, human
gctggttgagcaaagcccga

SEQ ID NO: 12858 - DNA, 20 bp, human
gaacagtaagaaggaccatc

SEQ ID NO: 12859 - DNA, 20 bp, human
gagcaatccagataataagg

SEQ ID NO: 12860 - DNA, 20 bp, human
gctcgccggttgagttcaga

SEQ ID NO: 12861 - DNA, 20 bp, human
ggctttgctcaaccagggag

SEQ ID NO: 12862 - DNA, 20 bp, human
gagccccgcatggtgctcag

SEQ ID NO: 12863 - DNA, 20 bp, human
gtgcataacctaggcttagg

SEQ ID NO: 12864 - DNA, 20 bp, human
gagccagaagagatcctcgc

SEQ ID NO: 12865 - DNA, 20 bp, human
gcaagttcacagaagcccaa

SEQ ID NO: 12866 - DNA, 20 bp, human
gaccaggggagccaagtgga

SEQ ID NO: 12867 - DNA, 20 bp, human
ggaaggagccccgaacccgg

SEQ ID NO: 12868 - DNA, 20 bp, human
gggcggacacgtggcaacag

SEQ ID NO: 12869 - DNA, 20 bp, human
ggagggagcgcagtaacggg

SEQ ID NO: 12870 - DNA, 20 bp, human
gacagcggtagcagcccggg

SEQ ID NO: 12871 - DNA, 20 bp, human
ggcgggaggaggcggacacg

SEQ ID NO: 12872 - DNA, 20 bp, human
gaagcggcgccgcgtggagt

SEQ ID NO: 12873 - DNA, 20 bp, human
gagcgcggcattgcttaggg

SEQ ID NO: 12874 - DNA, 20 bp, human
gggccgagcgagcgggacca

SEQ ID NO: 12875 - DNA, 20 bp, human
gcgacgcagtttggaaatgg

SEQ ID NO: 12876 - DNA, 20 bp, human
gccagcccgtctgggacagt

SEQ ID NO: 12877 - DNA, 20 bp, human
ggggctgtgggtctaactgt

SEQ ID NO: 12878 - DNA, 20 bp, human
gagggaaggactagagatgt

SEQ ID NO: 12879 - DNA, 20 bp, human
gagcccacaccagcccgtct

SEQ ID NO: 12880 - DNA, 20 bp, human
gggtctccgactgtcccaga

SEQ ID NO: 12881 - DNA, 20 bp, human
ggtcccagacgggctggtgt

SEQ ID NO: 12882 - DNA, 20 bp, human
gtcccagctgaaaggatgtt

SEQ ID NO: 12883 - DNA, 20 bp, human
ggtgggatctgtacacacat

SEQ ID NO: 12884 - DNA, 20 bp, human
gaggagctgagtgggatact

SEQ ID NO: 12885 - DNA, 20 bp, human
gtgagggaccttagcgggag

SEQ ID NO: 12886 - DNA, 20 bp, human
gagatgaaatgcccattagg

SEQ ID NO: 12887 - DNA, 20 bp, human
ggttagtggagtagaatcag

SEQ ID NO: 12888 - DNA, 20 bp, human
gtcaccagactgatcttcgg

SEQ ID NO: 12889 - DNA, 20 bp, human
ggcacacctggtagagaaag

SEQ ID NO: 12890 - DNA, 20 bp, human
ggtgattgggtgctccagag

SEQ ID NO: 12891 - DNA, 20 bp, human
gcaatcaccagactgatctt

SEQ ID NO: 12892 - DNA, 20 bp, human
gggagccacggtctagggta

SEQ ID NO: 12893 - DNA, 20 bp, human
gacgtcttaaaccccctaat

SEQ ID NO: 12894 - DNA, 20 bp, human
gtgtcagggtcaggcacacc

SEQ ID NO: 12895 - DNA, 20 bp, human
gacaccaccgaagatcagtc

SEQ ID NO: 12896 - DNA, 20 bp, human
gctctgtgcggtgggaccaa

SEQ ID NO: 12897 - DNA, 20 bp, human
gggccgccgcagcctctgtg

SEQ ID NO: 12898 - DNA, 20 bp, human
ggtgcggtgggaccaacgga

SEQ ID NO: 12899 - DNA, 20 bp, human
gcggacgcgcgcacctaccg

SEQ ID NO: 12900 - DNA, 20 bp, human
ggcagcgcccgcgcctcggt

SEQ ID NO: 12901 - DNA, 20 bp, human
gcgaggcgcgggcgctgcag

SEQ ID NO: 12902 - DNA, 20 bp, human
gggtgggaccaacggacgga

SEQ ID NO: 12903 - DNA, 20 bp, human
gggtcaggcggagatgctga

SEQ ID NO: 12904 - DNA, 20 bp, human
ggccctggcagcgagtgtgt

SEQ ID NO: 12905 - DNA, 20 bp, human
gcaccgcacagaggctgcgg

SEQ ID NO: 12906 - DNA, 20 bp, human
ggagaagggccccaaaaggt

SEQ ID NO: 12907 - DNA, 20 bp, human
ggcagggccagacaacagac

SEQ ID NO: 12908 - DNA, 20 bp, human
gggccccaaaaggtaggcca

SEQ ID NO: 12909 - DNA, 20 bp, human
gtcatacaggactgaagaaa

SEQ ID NO: 12910 - DNA, 20 bp, human
gagtgtgagaaggctcatac

SEQ ID NO: 12911 - DNA, 20 bp, human
ggtgtgtctgaagagtaatg

SEQ ID NO: 12912 - DNA, 20 bp, human
gcagcagtgggtgagtagaa

SEQ ID NO: 12913 - DNA, 20 bp, human
gggggagcctggttcagaga

SEQ ID NO: 12914 - DNA, 20 bp, human
gagcataggctcattctggt

SEQ ID NO: 12915 - DNA, 20 bp, human
gagcctatgctaaacagaag

SEQ ID NO: 12916 - DNA, 20 bp, human
ggcaaggcccacaggaaggt

SEQ ID NO: 12917 - DNA, 20 bp, human
ggctgcccgagctcaactgt

SEQ ID NO: 12918 - DNA, 20 bp, human
gaagatgccgcaaggcccac

SEQ ID NO: 12919 - DNA, 20 bp, human
gagtgagggcaggaaacaag

SEQ ID NO: 12920 - DNA, 20 bp, human
gaaatgcagtgagagtgagg

SEQ ID NO: 12921 - DNA, 20 bp, human
ggagggaggagagaagccta

SEQ ID NO: 12922 - DNA, 20 bp, human
gcaagaggtgaagcgtaacc

SEQ ID NO: 12923 - DNA, 20 bp, human
gaggtgagggaatgcagtga

SEQ ID NO: 12924 - DNA, 20 bp, human
gtgcggcatcttcatcactg

SEQ ID NO: 12925 - DNA, 20 bp, human
gggaggagagaagcctaggg

SEQ ID NO: 12926 - DNA, 20 bp, human
ggaccctgcgccccactctg

SEQ ID NO: 12927 - DNA, 20 bp, human
gccaggccggagaagccgag

SEQ ID NO: 12928 - DNA, 20 bp, human
gcgcactccgagagccgcag

SEQ ID NO: 12929 - DNA, 20 bp, human
gccgagagccgcagcggcag

SEQ ID NO: 12930 - DNA, 20 bp, human
gggagcccccgaccccccaa

SEQ ID NO: 12931 - DNA, 20 bp, human
gctgccgcggtccggagggt

SEQ ID NO: 12932 - DNA, 20 bp, human
ggcccgggaaagatcagacg

SEQ ID NO: 12933 - DNA, 20 bp, human
ggagaagccgagcggcgcag

SEQ ID NO: 12934 - DNA, 20 bp, human
gacgcgcggcggaggagcca

SEQ ID NO: 12935 - DNA, 20 bp, human
gctctgcagagacaggcccg

SEQ ID NO: 12936 - DNA, 20 bp, human
ggcagctgcatatctgaggg

SEQ ID NO: 12937 - DNA, 20 bp, human
gaggagcggagcctccgcct

SEQ ID NO: 12938 - DNA, 20 bp, human
ggcagctgctgcagattccg

SEQ ID NO: 12939 - DNA, 20 bp, human
gcgcgggcctcgcactgctg

SEQ ID NO: 12940 - DNA, 20 bp, human
gctggggggccccccatccc

SEQ ID NO: 12941 - DNA, 20 bp, human
gaaagcacggggagcgaagg

SEQ ID NO: 12942 - DNA, 20 bp, human
ggcggagaccactgcaccgg

SEQ ID NO: 12943 - DNA, 20 bp, human
gcggaagatgcaccgatcct

SEQ ID NO: 12944 - DNA, 20 bp, human
ggcagcagctgcatatctga

SEQ ID NO: 12945 - DNA, 20 bp, human
ggagaccactgcaccggtgg

SEQ ID NO: 12946 - DNA, 20 bp, human
gagcccggagacggcagtga

SEQ ID NO: 12947 - DNA, 20 bp, human
gcaggctcccgcggcccaag

SEQ ID NO: 12948 - DNA, 20 bp, human
ggaccgcccgaccctaaccc

SEQ ID NO: 12949 - DNA, 20 bp, human
gcggacggcgagaggagctg

SEQ ID NO: 12950 - DNA, 20 bp, human
gcggcccggggagcaatgaa

SEQ ID NO: 12951 - DNA, 20 bp, human
ggaacgcctggggacggtcg

SEQ ID NO: 12952 - DNA, 20 bp, human
gcgcctggggacggtcgggg

SEQ ID NO: 12953 - DNA, 20 bp, human
ggagcgagctgcggccagtc

SEQ ID NO: 12954 - DNA, 20 bp, human
gcagagcccagagaacgcct

SEQ ID NO: 12955 - DNA, 20 bp, human
ggctgagaagatgctacccg

SEQ ID NO: 12956 - DNA, 20 bp, human
gctgctggtacaggagacac

SEQ ID NO: 12957 - DNA, 20 bp, human
ggcaaagacgcagcagaggc

SEQ ID NO: 12958 - DNA, 20 bp, human
ggaccggagttgccttctca

SEQ ID NO: 12959 - DNA, 20 bp, human
gccactgaacagccatgaga

SEQ ID NO: 12960 - DNA, 20 bp, human
gaggcaactccggtccagaa

SEQ ID NO: 12961 - DNA, 20 bp, human
gggcaatcgggtgagagttc

SEQ ID NO: 12962 - DNA, 20 bp, human
gagagttctggagcttctgc

SEQ ID NO: 12963 - DNA, 20 bp, human
gcgcagcagaggcaggcaat

SEQ ID NO: 12964 - DNA, 20 bp, human
gagccatgagaaggcaactc

SEQ ID NO: 12965 - DNA, 20 bp, human
ggagaggcagccgtaaacca

SEQ ID NO: 12966 - DNA, 20 bp, human
gggtggccggctgctcaagt

SEQ ID NO: 12967 - DNA, 20 bp, human
gtgtggagggaagaaaaacc

SEQ ID NO: 12968 - DNA, 20 bp, human
gggctgctcaagtgggacgg

SEQ ID NO: 12969 - DNA, 20 bp, human
gccctgcgagcattggacaa

SEQ ID NO: 12970 - DNA, 20 bp, human
gtgagcagccggccaccccc

SEQ ID NO: 12971 - DNA, 20 bp, human
ggagggaagaaaaacctgga

SEQ ID NO: 12972 - DNA, 20 bp, human
gccccagctggtccttatga

SEQ ID NO: 12973 - DNA, 20 bp, human
gcctccaccagatcagggat

SEQ ID NO: 12974 - DNA, 20 bp, human
ggccggctgctcaagtggga

SEQ ID NO: 12975 - DNA, 20 bp, human
gtggctgagactccagcagg

SEQ ID NO: 12976 - DNA, 20 bp, human
ggccgcacgcccgacagcgg

SEQ ID NO: 12977 - DNA, 20 bp, human
ggtgcgcggcgcgctcgccc

SEQ ID NO: 12978 - DNA, 20 bp, human
gagcgccgcacgcccgacag

SEQ ID NO: 12979 - DNA, 20 bp, human
gactgcggcgaaggaaaagg

SEQ ID NO: 12980 - DNA, 20 bp, human
gccgcggccggagtgcgagg

SEQ ID NO: 12981 - DNA, 20 bp, human
ggaaactgcggcgaaggaaa

SEQ ID NO: 12982 - DNA, 20 bp, human
ggcacgcccgacagcggcgg

SEQ ID NO: 12983 - DNA, 20 bp, human
gcggaagcggccgcaagagg

SEQ ID NO: 12984 - DNA, 20 bp, human
gaagcggccgcaagaggagg

SEQ ID NO: 12985 - DNA, 20 bp, human
gaggaggccgcggggacggg

SEQ ID NO: 12986 - DNA, 20 bp, human
ggtgctgggaccttacccga

SEQ ID NO: 12987 - DNA, 20 bp, human
gtaaggtcccagcacggaca

SEQ ID NO: 12988 - DNA, 20 bp, human
gccgccactgccgtcgggta

SEQ ID NO: 12989 - DNA, 20 bp, human
gggaccttacccgacggcag

SEQ ID NO: 12990 - DNA, 20 bp, human
ggccccggcgccggcgaagg

SEQ ID NO: 12991 - DNA, 20 bp, human
gagggctccggaaacctctt

SEQ ID NO: 12992 - DNA, 20 bp, human
gctcggctgtcaccgagaag

SEQ ID NO: 12993 - DNA, 20 bp, human
gacctcttcggatgctcctg

SEQ ID NO: 12994 - DNA, 20 bp, human
gcggcccgcgcgctcaccgt

SEQ ID NO: 12995 - DNA, 20 bp, human
gccgccggggggctacaaag

SEQ ID NO: 12996 - DNA, 20 bp, human
gcagcgtgagtagggagccc

SEQ ID NO: 12997 - DNA, 20 bp, human
gctcacgctgcactgcgagg

SEQ ID NO: 12998 - DNA, 20 bp, human
gtcgcagtgcagcgtgagta

SEQ ID NO: 12999 - DNA, 20 bp, human
gcgtggagcgggaggcgtgt

SEQ ID NO: 13000 - DNA, 20 bp, human
gtggtggacgccgagcctct

SEQ ID NO: 13001 - DNA, 20 bp, human
ggctcggcgtccaccagccg

SEQ ID NO: 13002 - DNA, 20 bp, human
gattcgggagaagctgacgg

SEQ ID NO: 13003 - DNA, 20 bp, human
gctgcacctcggggatgggg

SEQ ID NO: 13004 - DNA, 20 bp, human
ggcggcggcgcgagcttcgg

SEQ ID NO: 13005 - DNA, 20 bp, human
gcggacggccgagcacgagg

SEQ ID NO: 13006 - DNA, 20 bp, human
gcagccccgtaatcgcggtg

SEQ ID NO: 13007 - DNA, 20 bp, human
gcagggtctcaggtagattc

SEQ ID NO: 13008 - DNA, 20 bp, human
ggcgggcagccccgtaatcg

SEQ ID NO: 13009 - DNA, 20 bp, human
gtcctgcacggtttcccggc

SEQ ID NO: 13010 - DNA, 20 bp, human
gggaaaccgtgcaggattgg

SEQ ID NO: 13011 - DNA, 20 bp, human
gctgccgcaccgcgattacg

SEQ ID NO: 13012 - DNA, 20 bp, human
gggactgcaaatgcccccta

SEQ ID NO: 13013 - DNA, 20 bp, human
gccctaaggatgttatgcaa

SEQ ID NO: 13014 - DNA, 20 bp, human
gtctctctgagccggtccca

SEQ ID NO: 13015 - DNA, 20 bp, human
gaggatggtacagtctgcag

SEQ ID NO: 13016 - DNA, 20 bp, human
gagtgcagcggtggcagagg

SEQ ID NO: 13017 - DNA, 20 bp, human
gcgggcagagcgcagtgcag

SEQ ID NO: 13018 - DNA, 20 bp, human
ggcagagcgcagtgcagcgg

SEQ ID NO: 13019 - DNA, 20 bp, human
gaccttgagcgggcaccagg

SEQ ID NO: 13020 - DNA, 20 bp, human
gtggtcccttcgccccgcgg

SEQ ID NO: 13021 - DNA, 20 bp, human
gcgggccgggcgcgcaccag

SEQ ID NO: 13022 - DNA, 20 bp, human
ggaccgagcgagaggggaag

SEQ ID NO: 13023 - DNA, 20 bp, human
ggccgcctggtgcccgctca

SEQ ID NO: 13024 - DNA, 20 bp, human
gacaagagaccgagcgagag

SEQ ID NO: 13025 - DNA, 20 bp, human
gctcaaggtcactgctgaca

SEQ ID NO: 13026 - DNA, 20 bp, human
gcgcgggacgcgaccctctg

SEQ ID NO: 13027 - DNA, 20 bp, human
gtgctccccacgctctgcac

SEQ ID NO: 13028 - DNA, 20 bp, human
gtccccacgctctgcaccgg

SEQ ID NO: 13029 - DNA, 20 bp, human
gcgccgccggtgcagagcgt

SEQ ID NO: 13030 - DNA, 20 bp, human
gcccagagcaccacttaccc

SEQ ID NO: 13031 - DNA, 20 bp, human
ggggacgcgaccctctgcgg

SEQ ID NO: 13032 - DNA, 20 bp, human
ggcagagcgtggggagcact

SEQ ID NO: 13033 - DNA, 20 bp, human
ggaccctctgcggcgggcga

SEQ ID NO: 13034 - DNA, 20 bp, human
ggggccttgttcctcagaca

SEQ ID NO: 13035 - DNA, 20 bp, human
ggatgacccggcaggtggtg

SEQ ID NO: 13036 - DNA, 20 bp, human
ggagctggtgagcaagagtc

SEQ ID NO: 13037 - DNA, 20 bp, human
gcaacagctctagctaactc

SEQ ID NO: 13038 - DNA, 20 bp, human
gggagacccagcccactccc

SEQ ID NO: 13039 - DNA, 20 bp, human
gtgagatcgtccaaagctgg

SEQ ID NO: 13040 - DNA, 20 bp, human
gctttgctagaaagagaggt

SEQ ID NO: 13041 - DNA, 20 bp, human
gtctagaaagaggaaaatcg

SEQ ID NO: 13042 - DNA, 20 bp, human
gcttaagaaaatgcttgtca

SEQ ID NO: 13043 - DNA, 20 bp, human
gtccccggccttagccagaa

SEQ ID NO: 13044 - DNA, 20 bp, human
gggatctttgctagaaagag

SEQ ID NO: 13045 - DNA, 20 bp, human
gcctgagaggtccttcccat

SEQ ID NO: 13046 - DNA, 20 bp, human
ggagaagcggcgctgacgag

SEQ ID NO: 13047 - DNA, 20 bp, human
gccgcgcgcctcgggagaag

SEQ ID NO: 13048 - DNA, 20 bp, human
gcagatgctgctgctagggg

SEQ ID NO: 13049 - DNA, 20 bp, human
gcggcgtgagaagaagcgag

SEQ ID NO: 13050 - DNA, 20 bp, human
gtgacagcctgggattccgg

SEQ ID NO: 13051 - DNA, 20 bp, human
gctcccggccacgcgtccca

SEQ ID NO: 13052 - DNA, 20 bp, human
gggccacactgggaatagag

SEQ ID NO: 13053 - DNA, 20 bp, human
gagaagaggagctgctcgcg

SEQ ID NO: 13054 - DNA, 20 bp, human
gcggcgctgacgagaggctg

SEQ ID NO: 13055 - DNA, 20 bp, human
gggcggagcgcaggagtcgg

SEQ ID NO: 13056 - DNA, 20 bp, human
gggtccggcccaggaggctt

SEQ ID NO: 13057 - DNA, 20 bp, human
ggggcctcgccggggaccta

SEQ ID NO: 13058 - DNA, 20 bp, human
gtaaccgggtccggcccagg

SEQ ID NO: 13059 - DNA, 20 bp, human
ggggcgcgcgcagccatccc

SEQ ID NO: 13060 - DNA, 20 bp, human
ggcgcgcgcccaagcctcct

SEQ ID NO: 13061 - DNA, 20 bp, human
gagacagctacctggtaacc

SEQ ID NO: 13062 - DNA, 20 bp, human
ggggcaggtagacagctacc

SEQ ID NO: 13063 - DNA, 20 bp, human
gtgggccggacccggttacc

SEQ ID NO: 13064 - DNA, 20 bp, human
ggagtcgcggggactcacca

SEQ ID NO: 13065 - DNA, 20 bp, human
gaggcgttgcctgcgtccct

SEQ ID NO: 13066 - DNA, 20 bp, human
gacaggcaccgggcaccatg

SEQ ID NO: 13067 - DNA, 20 bp, human
gctctgttgggtgggagcac

SEQ ID NO: 13068 - DNA, 20 bp, human
gactgggagcgtacagaaag

SEQ ID NO: 13069 - DNA, 20 bp, human
ggaccaccagctgtcagtgg

SEQ ID NO: 13070 - DNA, 20 bp, human
gtccgggcccaggctctgtt

SEQ ID NO: 13071 - DNA, 20 bp, human
gagtctccagctcaccttgg

SEQ ID NO: 13072 - DNA, 20 bp, human
ggggagcgtacagaaagggg

SEQ ID NO: 13073 - DNA, 20 bp, human
gcatggggaaggccgtgagt

SEQ ID NO: 13074 - DNA, 20 bp, human
gcagctgtcagtggcggagc

SEQ ID NO: 13075 - DNA, 20 bp, human
ggggcccaggctctgttggg

SEQ ID NO: 13076 - DNA, 20 bp, human
gccatacgctggaggacccg

SEQ ID NO: 13077 - DNA, 20 bp, human
ggatctgctttctagggtag

SEQ ID NO: 13078 - DNA, 20 bp, human
gcgctccagcacgcgctcgg

SEQ ID NO: 13079 - DNA, 20 bp, human
gcgtgctcggtgagacccct

SEQ ID NO: 13080 - DNA, 20 bp, human
gggagactccaggtgcgagg

SEQ ID NO: 13081 - DNA, 20 bp, human
gaggcgtcaggacaaaaatt

SEQ ID NO: 13082 - DNA, 20 bp, human
ggcagctccatccttatcaa

SEQ ID NO: 13083 - DNA, 20 bp, human
ggaggttagaggtcaggata

SEQ ID NO: 13084 - DNA, 20 bp, human
gccagggatgaggacggtca

SEQ ID NO: 13085 - DNA, 20 bp, human
ggcaagtgtcgcgggtcccg

SEQ ID NO: 13086 - DNA, 20 bp, human
gctcaggccagggacgatgg

SEQ ID NO: 13087 - DNA, 20 bp, human
ggagcagacgggaggatctc

SEQ ID NO: 13088 - DNA, 20 bp, human
gggtgcagggagcagacggg

SEQ ID NO: 13089 - DNA, 20 bp, human
ggatctcaggccagggacga

SEQ ID NO: 13090 - DNA, 20 bp, human
gtcctcctgagctcacctgg

SEQ ID NO: 13091 - DNA, 20 bp, human
ggcctcagtctgggcgtaga

SEQ ID NO: 13092 - DNA, 20 bp, human
ggtctgtggacgccctccac

SEQ ID NO: 13093 - DNA, 20 bp, human
ggcagagccgccatcgtccc

SEQ ID NO: 13094 - DNA, 20 bp, human
gggaggctgcgtcctcagag

SEQ ID NO: 13095 - DNA, 20 bp, human
gcccagctgcagaacgccgg

SEQ ID NO: 13096 - DNA, 20 bp, human
ggctgcagaagtaccgcctg

SEQ ID NO: 13097 - DNA, 20 bp, human
gcgtggtccgcgcccttcct

SEQ ID NO: 13098 - DNA, 20 bp, human
gagccacgggtgcaagatgg

SEQ ID NO: 13099 - DNA, 20 bp, human
gagtccggcccgccgaggaa

SEQ ID NO: 13100 - DNA, 20 bp, human
gtttgtcccagtcagtccgg

SEQ ID NO: 13101 - DNA, 20 bp, human
gctgacagcggccctagaag

SEQ ID NO: 13102 - DNA, 20 bp, human
gggcctgttctgaatcggtg

SEQ ID NO: 13103 - DNA, 20 bp, human
gtggacagagcaggcgacac

SEQ ID NO: 13104 - DNA, 20 bp, human
gtgtccagccggagaagcca

SEQ ID NO: 13105 - DNA, 20 bp, human
ggcgcaggtgacgagcaaaa

SEQ ID NO: 13106 - DNA, 20 bp, human
gattcgaggaatgataccgg

SEQ ID NO: 13107 - DNA, 20 bp, human
gccaagacgcgtaggcgagt

SEQ ID NO: 13108 - DNA, 20 bp, human
ggaaattcgaggaatgatac

SEQ ID NO: 13109 - DNA, 20 bp, human
gaattggttccaagacgcgt

SEQ ID NO: 13110 - DNA, 20 bp, human
ggtgggtttgagccccatgt

SEQ ID NO: 13111 - DNA, 20 bp, human
ggacattagaatctaatacg

SEQ ID NO: 13112 - DNA, 20 bp, human
gtgggacgagctagctcagt

SEQ ID NO: 13113 - DNA, 20 bp, human
gtattggtgaccgacagact

SEQ ID NO: 13114 - DNA, 20 bp, human
ggagtctttacccagtctgt

SEQ ID NO: 13115 - DNA, 20 bp, human
gttagtcttggaatggtaaa

SEQ ID NO: 13116 - DNA, 20 bp, human
gggtcgggtggccgctgctc

SEQ ID NO: 13117 - DNA, 20 bp, human
gctgggggcagcgacgctga

SEQ ID NO: 13118 - DNA, 20 bp, human
gcaacatggcgtagtccggg

SEQ ID NO: 13119 - DNA, 20 bp, human
gagtctccgcaaggccccgg

SEQ ID NO: 13120 - DNA, 20 bp, human
gtgaccttccggttgaatag

SEQ ID NO: 13121 - DNA, 20 bp, human
gcgacccacaaaccccaaca

SEQ ID NO: 13122 - DNA, 20 bp, human
ggccccggaggccggagcag

SEQ ID NO: 13123 - DNA, 20 bp, human
gccccaacatggcgtagtcc

SEQ ID NO: 13124 - DNA, 20 bp, human
ggccattagagagcaagacg

SEQ ID NO: 13125 - DNA, 20 bp, human
ggccaccgggcgcatcgtgg

SEQ ID NO: 13126 - DNA, 20 bp, human
gcggaggcgccgggtagcgg

SEQ ID NO: 13127 - DNA, 20 bp, human
gacacccgcgcgagagaaca

SEQ ID NO: 13128 - DNA, 20 bp, human
ggccctgctgaaggtcggtc

SEQ ID NO: 13129 - DNA, 20 bp, human
ggcctgaccgaccttcagca

SEQ ID NO: 13130 - DNA, 20 bp, human
ggcagtggaagtggaagctc

SEQ ID NO: 13131 - DNA, 20 bp, human
gctctcgcgcgggtgtcgct

SEQ ID NO: 13132 - DNA, 20 bp, human
gccttgcagccgcaatggta

SEQ ID NO: 13133 - DNA, 20 bp, human
gagccaggcccccagtctca

SEQ ID NO: 13134 - DNA, 20 bp, human
gtggcagcttgcgggaagat

SEQ ID NO: 13135 - DNA, 20 bp, human
gggaagtgctgattagctga

SEQ ID NO: 13136 - DNA, 20 bp, human
ggtgggagaggcgaaggtga

SEQ ID NO: 13137 - DNA, 20 bp, human
ggcggcctcggcataggcac

SEQ ID NO: 13138 - DNA, 20 bp, human
gtggccagggagatcgggga

SEQ ID NO: 13139 - DNA, 20 bp, human
gccgggacgagggcagcgca

SEQ ID NO: 13140 - DNA, 20 bp, human
gccaggagacgcttatctcg

SEQ ID NO: 13141 - DNA, 20 bp, human
gacgacgcgcagggacgtct

SEQ ID NO: 13142 - DNA, 20 bp, human
ggaggcggccaagtcccggg

SEQ ID NO: 13143 - DNA, 20 bp, human
gaaatgggaatgcaacgatc

SEQ ID NO: 13144 - DNA, 20 bp, human
ggctggcggacagcggactc

SEQ ID NO: 13145 - DNA, 20 bp, human
gttatctcggggaggtgccc

SEQ ID NO: 13146 - DNA, 20 bp, human
ggccaagacgccggcaatgt

SEQ ID NO: 13147 - DNA, 20 bp, human
gggccgaatcgccaagacgc

SEQ ID NO: 13148 - DNA, 20 bp, human
gttcctgcggctgaaccgcc

SEQ ID NO: 13149 - DNA, 20 bp, human
ggaagatcagaccacagaag

SEQ ID NO: 13150 - DNA, 20 bp, human
gccgaggcttggcccaaccc

SEQ ID NO: 13151 - DNA, 20 bp, human
ggtgtccaggggcactctgt

SEQ ID NO: 13152 - DNA, 20 bp, human
gccctggacacctttgtgaa

SEQ ID NO: 13153 - DNA, 20 bp, human
gggcaggtttctcgagagag

SEQ ID NO: 13154 - DNA, 20 bp, human
ggcaccattctagaagaaaa

SEQ ID NO: 13155 - DNA, 20 bp, human
ggcggccccacgcgtgaccg

SEQ ID NO: 13156 - DNA, 20 bp, human
gcagctcggtgacgcgaccc

SEQ ID NO: 13157 - DNA, 20 bp, human
gatctgagctcaggaacgcg

SEQ ID NO: 13158 - DNA, 20 bp, human
ggcatggtcaacgaaagtcc

SEQ ID NO: 13159 - DNA, 20 bp, human
ggcgtccctgtgaccccgat

SEQ ID NO: 13160 - DNA, 20 bp, human
gggcggcggaaagtaccacc

SEQ ID NO: 13161 - DNA, 20 bp, human
ggcaggaatcgggaaataaa

SEQ ID NO: 13162 - DNA, 20 bp, human
gagggggctgcagatagaca

SEQ ID NO: 13163 - DNA, 20 bp, human
ggcagttcggaagggagcgt

SEQ ID NO: 13164 - DNA, 20 bp, human
gcctaaagctaagggggtgg

SEQ ID NO: 13165 - DNA, 20 bp, human
gttctcctatcggggtcaca

SEQ ID NO: 13166 - DNA, 20 bp, human
ggagaaggtccaggacacgt

SEQ ID NO: 13167 - DNA, 20 bp, human
gagcgctgtgggccaagcag

SEQ ID NO: 13168 - DNA, 20 bp, human
gaccgtgccccagctgagga

SEQ ID NO: 13169 - DNA, 20 bp, human
ggtcagagggacagagcagt

SEQ ID NO: 13170 - DNA, 20 bp, human
gggagggcattagaggtcag

SEQ ID NO: 13171 - DNA, 20 bp, human
gacagcgctcgcccggctca

SEQ ID NO: 13172 - DNA, 20 bp, human
gaagactggaggcggatact

SEQ ID NO: 13173 - DNA, 20 bp, human
gctaatgccctcctcagctg

SEQ ID NO: 13174 - DNA, 20 bp, human
gggtcttcaaagcaaagtca

SEQ ID NO: 13175 - DNA, 20 bp, human
ggagtctgtcaccttgagcc

SEQ ID NO: 13176 - DNA, 20 bp, human
ggcgcgtgcgcagcgcacag

SEQ ID NO: 13177 - DNA, 20 bp, human
gcgcggaagagccaactcta

SEQ ID NO: 13178 - DNA, 20 bp, human
gctccgagcaatggagatag

SEQ ID NO: 13179 - DNA, 20 bp, human
gggttctggggcctaaagtc

SEQ ID NO: 13180 - DNA, 20 bp, human
gagcgggaagagcgaaagga

SEQ ID NO: 13181 - DNA, 20 bp, human
gccattgctcggagcacctg

SEQ ID NO: 13182 - DNA, 20 bp, human
gaataaagaaggcacaagtc

SEQ ID NO: 13183 - DNA, 20 bp, human
gggatagcggaagcaagaaa

SEQ ID NO: 13184 - DNA, 20 bp, human
gctctaaggctaagggatag

SEQ ID NO: 13185 - DNA, 20 bp, human
gctttaggccccagaacctc

SEQ ID NO: 13186 - DNA, 20 bp, human
gcacttaccttcccaggagg

SEQ ID NO: 13187 - DNA, 20 bp, human
gctccacttaccttcccagg

SEQ ID NO: 13188 - DNA, 20 bp, human
gggaagaacaggcccctgga

SEQ ID NO: 13189 - DNA, 20 bp, human
gtgggctacgcaccagagag

SEQ ID NO: 13190 - DNA, 20 bp, human
gcggcagaggtcgaaggagt

SEQ ID NO: 13191 - DNA, 20 bp, human
gtagcccaggcagggtcggg

SEQ ID NO: 13192 - DNA, 20 bp, human
gcagggtcggggggattgag

SEQ ID NO: 13193 - DNA, 20 bp, human
gcctctctgcggaggaaaag

SEQ ID NO: 13194 - DNA, 20 bp, human
gctgcgcggctggagatatt

SEQ ID NO: 13195 - DNA, 20 bp, human
ggctgagatgccctaagatt

SEQ ID NO: 13196 - DNA, 20 bp, human
ggggcattggatccgatccc

SEQ ID NO: 13197 - DNA, 20 bp, human
gtcggcgtgaggtttggaga

SEQ ID NO: 13198 - DNA, 20 bp, human
gacttgctgcggaggaccgt

SEQ ID NO: 13199 - DNA, 20 bp, human
gagaggagccctccagggat

SEQ ID NO: 13200 - DNA, 20 bp, human
gggtcctccgcagcaagtaa

SEQ ID NO: 13201 - DNA, 20 bp, human
gaggagcggcagctacacaa

SEQ ID NO: 13202 - DNA, 20 bp, human
ggtggcagcgcctacatcag

SEQ ID NO: 13203 - DNA, 20 bp, human
gtgaccccgcgcgccaagga

SEQ ID NO: 13204 - DNA, 20 bp, human
gggtcccggaccacccgagc

SEQ ID NO: 13205 - DNA, 20 bp, human
ggctcctcgggtgcagagtt

SEQ ID NO: 13206 - DNA, 20 bp, human
ggcggagagacctgcaccgg

SEQ ID NO: 13207 - DNA, 20 bp, human
gtgagcggagagacctgcac

SEQ ID NO: 13208 - DNA, 20 bp, human
gagggacaagatggtgccac

SEQ ID NO: 13209 - DNA, 20 bp, human
ggcggaggtcagggacaaga

SEQ ID NO: 13210 - DNA, 20 bp, human
gcctggatcaccttgatgag

SEQ ID NO: 13211 - DNA, 20 bp, human
gcacggggcgaggatcatgg

SEQ ID NO: 13212 - DNA, 20 bp, human
ggccacaccgaggaacaggg

SEQ ID NO: 13213 - DNA, 20 bp, human
gtgggcagaggtcgcaggag

SEQ ID NO: 13214 - DNA, 20 bp, human
gtcacgctcggtggaggaca

SEQ ID NO: 13215 - DNA, 20 bp, human
gggagttctccaaatagcac

SEQ ID NO: 13216 - DNA, 20 bp, human
gcggccgcactcacccactc

SEQ ID NO: 13217 - DNA, 20 bp, human
ggggaaaaggccccggaacg

SEQ ID NO: 13218 - DNA, 20 bp, human
ggccagggccggaagtagag

SEQ ID NO: 13219 - DNA, 20 bp, human
gcgaccgcccaaggcaacgg

SEQ ID NO: 13220 - DNA, 20 bp, human
gagggccggaagtagagcgg

SEQ ID NO: 13221 - DNA, 20 bp, human
ggggagcgtctaggctactt

SEQ ID NO: 13222 - DNA, 20 bp, human
gggactgagtgcaaggtgac

SEQ ID NO: 13223 - DNA, 20 bp, human
gaaacgaccgcccaaggcaa

SEQ ID NO: 13224 - DNA, 20 bp, human
gcggaggctcacgaggtaca

SEQ ID NO: 13225 - DNA, 20 bp, human
gcgggcgcacgggagcgtct

SEQ ID NO: 13226 - DNA, 20 bp, human
ggagtccaaacagccttacc

SEQ ID NO: 13227 - DNA, 20 bp, human
ggtctggcgcgcctcaagtg

SEQ ID NO: 13228 - DNA, 20 bp, human
ggagtgtccggccccaggta

SEQ ID NO: 13229 - DNA, 20 bp, human
gcaaccgggttaggcgtgga

SEQ ID NO: 13230 - DNA, 20 bp, human
gtggagggtgaaggcatctg

SEQ ID NO: 13231 - DNA, 20 bp, human
gctcgcgcggtccggcacag

SEQ ID NO: 13232 - DNA, 20 bp, human
gggctgtttggactccgtgg

SEQ ID NO: 13233 - DNA, 20 bp, human
gactccaaaatggcgtcagt

SEQ ID NO: 13234 - DNA, 20 bp, human
gtaaggctgtttggactccg

SEQ ID NO: 13235 - DNA, 20 bp, human
ggctcagatgaagctccagg

SEQ ID NO: 13236 - DNA, 20 bp, human
ggtctggcgcgcctcaagtg

SEQ ID NO: 13237 - DNA, 20 bp, human
gagtccaaacagccttacct

SEQ ID NO: 13238 - DNA, 20 bp, human
ggagtgtccggccccaggta

SEQ ID NO: 13239 - DNA, 20 bp, human
gcaaccgggttaggcgtgga

SEQ ID NO: 13240 - DNA, 20 bp, human
gtggagggtgaaggcatctg

SEQ ID NO: 13241 - DNA, 20 bp, human
gctcgcgcggtccggcacag

SEQ ID NO: 13242 - DNA, 20 bp, human
gggctgtttggactccgtgg

SEQ ID NO: 13243 - DNA, 20 bp, human
gactccaaaatggcgtcagt

SEQ ID NO: 13244 - DNA, 20 bp, human
gtaaggctgtttggactccg

SEQ ID NO: 13245 - DNA, 20 bp, human
ggctcagatgaagctccagg

SEQ ID NO: 13246 - DNA, 20 bp, human
gaccgggcagggctccccgt

SEQ ID NO: 13247 - DNA, 20 bp, human
gggcgcagtgcactccgacg

SEQ ID NO: 13248 - DNA, 20 bp, human
ggctcctgcgaggatcacac

SEQ ID NO: 13249 - DNA, 20 bp, human
gcgggtgggcctctgaggag

SEQ ID NO: 13250 - DNA, 20 bp, human
gggcgaaccagtctcttcct

SEQ ID NO: 13251 - DNA, 20 bp, human
gttggggagagggggacccg

SEQ ID NO: 13252 - DNA, 20 bp, human
ggagacccgcccctcctcag

SEQ ID NO: 13253 - DNA, 20 bp, human
ggaggctgcagaagtccgtg

SEQ ID NO: 13254 - DNA, 20 bp, human
ggaagagactggttcgccgc

SEQ ID NO: 13255 - DNA, 20 bp, human
gttggcctgagggtccgggt

SEQ ID NO: 13256 - DNA, 20 bp, human
gtaagagcagggatctagag

SEQ ID NO: 13257 - DNA, 20 bp, human
gctgcagcgggtccttccgg

SEQ ID NO: 13258 - DNA, 20 bp, human
ggcgggtgacattcagccgg

SEQ ID NO: 13259 - DNA, 20 bp, human
ggcgatctcagggggcgtaa

SEQ ID NO: 13260 - DNA, 20 bp, human
gtgcaggtcagacgagtgga

SEQ ID NO: 13261 - DNA, 20 bp, human
gccggcgggtgacattcagc

SEQ ID NO: 13262 - DNA, 20 bp, human
ggccgaggcgggcacacggg

SEQ ID NO: 13263 - DNA, 20 bp, human
gtgctcttagcgatctcagg

SEQ ID NO: 13264 - DNA, 20 bp, human
ggtccgtcgccccgaaccgc

SEQ ID NO: 13265 - DNA, 20 bp, human
ggtcctgcagcgggtccttc

SEQ ID NO: 13266 - DNA, 20 bp, human
gcacgcagggtccttccggg

SEQ ID NO: 13267 - DNA, 20 bp, human
ggcattttggtactacacca

SEQ ID NO: 13268 - DNA, 20 bp, human
gccagctgaaggtcaccccc

SEQ ID NO: 13269 - DNA, 20 bp, human
gctgaaggtcaccccccgga

SEQ ID NO: 13270 - DNA, 20 bp, human
gaaccacgcagggtccttcc

SEQ ID NO: 13271 - DNA, 20 bp, human
ggaaagtccatcatcccgaa

SEQ ID NO: 13272 - DNA, 20 bp, human
gagctggccattcgggatga

SEQ ID NO: 13273 - DNA, 20 bp, human
gtaaataagtgaaccacgca

SEQ ID NO: 13274 - DNA, 20 bp, human
ggaccttcagctggccattc

SEQ ID NO: 13275 - DNA, 20 bp, human
ggcctcgattggccgcattt

SEQ ID NO: 13276 - DNA, 20 bp, human
ggcagccatcttctcccggg

SEQ ID NO: 13277 - DNA, 20 bp, human
gctgtaggtcaaacccgagt

SEQ ID NO: 13278 - DNA, 20 bp, human
ggtgtccgggctctcccggc

SEQ ID NO: 13279 - DNA, 20 bp, human
gtgccccgtaggcatcccgg

SEQ ID NO: 13280 - DNA, 20 bp, human
ggtcccccgggatgcctacg

SEQ ID NO: 13281 - DNA, 20 bp, human
gtcggaagacgccaaggtta

SEQ ID NO: 13282 - DNA, 20 bp, human
gcccgcgcctactgccccgt

SEQ ID NO: 13283 - DNA, 20 bp, human
gtggcgagtgggagcgactc

SEQ ID NO: 13284 - DNA, 20 bp, human
ggtttgacctacagccgccc

SEQ ID NO: 13285 - DNA, 20 bp, human
gctagtaagtgatctctgac

SEQ ID NO: 13286 - DNA, 20 bp, human
gactcacagcgtcggaggga

SEQ ID NO: 13287 - DNA, 20 bp, human
gctctactcacagcgtcgga

SEQ ID NO: 13288 - DNA, 20 bp, human
gacagggagcgcccttctag

SEQ ID NO: 13289 - DNA, 20 bp, human
gcgaggattagggccggaca

SEQ ID NO: 13290 - DNA, 20 bp, human
ggcttctctactcacagcgt

SEQ ID NO: 13291 - DNA, 20 bp, human
gcagtcgagcgtccactaga

SEQ ID NO: 13292 - DNA, 20 bp, human
ggtgacaaagagcctccgtg

SEQ ID NO: 13293 - DNA, 20 bp, human
ggccagcgtccccgcgtctg

SEQ ID NO: 13294 - DNA, 20 bp, human
gccagggtgccgcagacgcg

SEQ ID NO: 13295 - DNA, 20 bp, human
ggagccgggcgggactaggg

SEQ ID NO: 13296 - DNA, 20 bp, human
gtccctgggcggtaagtgac

SEQ ID NO: 13297 - DNA, 20 bp, human
ggaatgcggaggctgtagag

SEQ ID NO: 13298 - DNA, 20 bp, human
gggagctaatggacaggcaa

SEQ ID NO: 13299 - DNA, 20 bp, human
ggggagccgccatcttgcta

SEQ ID NO: 13300 - DNA, 20 bp, human
ggacgcgactaaccaatcag

SEQ ID NO: 13301 - DNA, 20 bp, human
gtagcgagcgagaggaggca

SEQ ID NO: 13302 - DNA, 20 bp, human
gacacaaggagctaatggac

SEQ ID NO: 13303 - DNA, 20 bp, human
ggactaaccaatcagaggga

SEQ ID NO: 13304 - DNA, 20 bp, human
gcgctttagcgagcgagagg

SEQ ID NO: 13305 - DNA, 20 bp, human
gctgtgagggtcgcaggcgg

SEQ ID NO: 13306 - DNA, 20 bp, human
gaggcgccctcgcccgactc

SEQ ID NO: 13307 - DNA, 20 bp, human
gcatggcgacggctcgagtg

SEQ ID NO: 13308 - DNA, 20 bp, human
gtccagggcgggatctaagt

SEQ ID NO: 13309 - DNA, 20 bp, human
ggcaacggtcacctgatctg

SEQ ID NO: 13310 - DNA, 20 bp, human
gcgacggctcgagtgcggat

SEQ ID NO: 13311 - DNA, 20 bp, human
ggaggctgaggctatgatgg

SEQ ID NO: 13312 - DNA, 20 bp, human
gttcctgggacccagctcca

SEQ ID NO: 13313 - DNA, 20 bp, human
ggcctcgacagccgcagatc

SEQ ID NO: 13314 - DNA, 20 bp, human
gagcccacaagtccctggca

SEQ ID NO: 13315 - DNA, 20 bp, human
gggcatgcgccagagcgcct

SEQ ID NO: 13316 - DNA, 20 bp, human
gtctgggaggccacttggga

SEQ ID NO: 13317 - DNA, 20 bp, human
gaacatccagggatgtgaag

SEQ ID NO: 13318 - DNA, 20 bp, human
gtgatagcttggaccctcag

SEQ ID NO: 13319 - DNA, 20 bp, human
gaagttttgagcttgggagt

SEQ ID NO: 13320 - DNA, 20 bp, human
ggctctagttgagatagctt

SEQ ID NO: 13321 - DNA, 20 bp, human
gaagtgggaaatacgaggag

SEQ ID NO: 13322 - DNA, 20 bp, human
gcagtggagacagtaaaaag

SEQ ID NO: 13323 - DNA, 20 bp, human
gttccaaagtgggaaatacg

SEQ ID NO: 13324 - DNA, 20 bp, human
gactgtccacttcacatccc

SEQ ID NO: 13325 - DNA, 20 bp, human
gagaatttgctcaggactgt

SEQ ID NO: 13326 - DNA, 20 bp, human
gcgacagccgcagcgtgagg

SEQ ID NO: 13327 - DNA, 20 bp, human
ggacgcgctcggactcgtcc

SEQ ID NO: 13328 - DNA, 20 bp, human
ggaacgggccggcgggacac

SEQ ID NO: 13329 - DNA, 20 bp, human
gggacgcgccgccctcaaag

SEQ ID NO: 13330 - DNA, 20 bp, human
ggcagcactgcggggcgaca

SEQ ID NO: 13331 - DNA, 20 bp, human
gcgcgccgccctcaaagtgg

SEQ ID NO: 13332 - DNA, 20 bp, human
ggcccgctgcgaagaagaga

SEQ ID NO: 13333 - DNA, 20 bp, human
gccgctgacggaccgcactg

SEQ ID NO: 13334 - DNA, 20 bp, human
ggcgtcacctcctcacgctg

SEQ ID NO: 13335 - DNA, 20 bp, human
gcgcggcgcaggacctcccc

SEQ ID NO: 13336 - DNA, 20 bp, human
ggccaaacccgcaccctccg

SEQ ID NO: 13337 - DNA, 20 bp, human
gggtgcgggtttggctgcgg

SEQ ID NO: 13338 - DNA, 20 bp, human
gctgctcctggagccgcgga

SEQ ID NO: 13339 - DNA, 20 bp, human
ggtgagcctccggttcctca

SEQ ID NO: 13340 - DNA, 20 bp, human
gtaccttgagatgggaaaaa

SEQ ID NO: 13341 - DNA, 20 bp, human
gcggtcctcgcctcctccca

SEQ ID NO: 13342 - DNA, 20 bp, human
ggaaccggaggttattggat

SEQ ID NO: 13343 - DNA, 20 bp, human
gtgaagcaggtgaataccgt

SEQ ID NO: 13344 - DNA, 20 bp, human
gccaatgagcaggaattctc

SEQ ID NO: 13345 - DNA, 20 bp, human
gagcaggtgaataccgtggg

SEQ ID NO: 13346 - DNA, 20 bp, human
ggccgcggtggcagaaccgg

SEQ ID NO: 13347 - DNA, 20 bp, human
ggccgcggccccgcactatg

SEQ ID NO: 13348 - DNA, 20 bp, human
gcgcggggagcaccgaggaa

SEQ ID NO: 13349 - DNA, 20 bp, human
gacctcgcggactgctgtgg

SEQ ID NO: 13350 - DNA, 20 bp, human
gcctcccgcggggagcaccg

SEQ ID NO: 13351 - DNA, 20 bp, human
gcagcgatgcgcgggattgg

SEQ ID NO: 13352 - DNA, 20 bp, human
gagggcgctgaggcactcgt

SEQ ID NO: 13353 - DNA, 20 bp, human
gctccgggcaccgagctcag

SEQ ID NO: 13354 - DNA, 20 bp, human
gcggaacagggaccccatgg

SEQ ID NO: 13355 - DNA, 20 bp, human
ggggcgatcctaactaactg

SEQ ID NO: 13356 - DNA, 20 bp, human
gggactgctagcaagcacgg

SEQ ID NO: 13357 - DNA, 20 bp, human
gccaggactgctagcaagca

SEQ ID NO: 13358 - DNA, 20 bp, human
gcagggtctggggcagacgg

SEQ ID NO: 13359 - DNA, 20 bp, human
gtggctgtagttactagaca

SEQ ID NO: 13360 - DNA, 20 bp, human
gaagccacctgcggattcac

SEQ ID NO: 13361 - DNA, 20 bp, human
gcaacctgacgcacggagca

SEQ ID NO: 13362 - DNA, 20 bp, human
gaacatagaccagagaccca

SEQ ID NO: 13363 - DNA, 20 bp, human
gctagcctcgtggacttcac

SEQ ID NO: 13364 - DNA, 20 bp, human
gtctgggggcatgtaggagg

SEQ ID NO: 13365 - DNA, 20 bp, human
gctgttgacctagaccggtg

SEQ ID NO: 13366 - DNA, 20 bp, human
gctacacctgcagatgggag

SEQ ID NO: 13367 - DNA, 20 bp, human
gtgccgagcaagccgagtgg

SEQ ID NO: 13368 - DNA, 20 bp, human
gacctgccgagcaagccgag

SEQ ID NO: 13369 - DNA, 20 bp, human
gaaggccaggctgaggatca

SEQ ID NO: 13370 - DNA, 20 bp, human
gggcagcaaactcatgtccc

SEQ ID NO: 13371 - DNA, 20 bp, human
gagaagggaagccaaaccgt

SEQ ID NO: 13372 - DNA, 20 bp, human
gtgggggaaacaccatgggg

SEQ ID NO: 13373 - DNA, 20 bp, human
gtggaaagcaactctgccag

SEQ ID NO: 13374 - DNA, 20 bp, human
gccatgctacacctgcagat

SEQ ID NO: 13375 - DNA, 20 bp, human
ggtttgggggaaacaccatg

SEQ ID NO: 13376 - DNA, 20 bp, human
gcggtcaggagcaagaaagg

SEQ ID NO: 13377 - DNA, 20 bp, human
gcgaggggagacagcgatag

SEQ ID NO: 13378 - DNA, 20 bp, human
gagtgagacgtgggagcgag

SEQ ID NO: 13379 - DNA, 20 bp, human
gtggtaccggcgcatcacgt

SEQ ID NO: 13380 - DNA, 20 bp, human
gagcagtgctagccccgtca

SEQ ID NO: 13381 - DNA, 20 bp, human
gacggcggcgggggtcggaa

SEQ ID NO: 13382 - DNA, 20 bp, human
ggggcgggcggacagactgc

SEQ ID NO: 13383 - DNA, 20 bp, human
gcagcttgttgggtaaacag

SEQ ID NO: 13384 - DNA, 20 bp, human
gagcgatagtggcaggacgg

SEQ ID NO: 13385 - DNA, 20 bp, human
ggggcctctgactccgacaa

SEQ ID NO: 13386 - DNA, 20 bp, human
gggcggcgggagggactcgg

SEQ ID NO: 13387 - DNA, 20 bp, human
gagcgcagcggctgacgggc

SEQ ID NO: 13388 - DNA, 20 bp, human
gttagagcgcagcggctgac

SEQ ID NO: 13389 - DNA, 20 bp, human
gcgctcaccgctgaagacca

SEQ ID NO: 13390 - DNA, 20 bp, human
gtcaccgctgaagaccatgg

SEQ ID NO: 13391 - DNA, 20 bp, human
gcccggggctaatatggcag

SEQ ID NO: 13392 - DNA, 20 bp, human
ggccggggtgtgagtctcgg

SEQ ID NO: 13393 - DNA, 20 bp, human
gtcttcagcggtgagcgcgg

SEQ ID NO: 13394 - DNA, 20 bp, human
gggcacgaaggtttgcgggc

SEQ ID NO: 13395 - DNA, 20 bp, human
gcgcaaccgcacgacccggc

SEQ ID NO: 13396 - DNA, 20 bp, human
ggggaccggagaaccaggac

SEQ ID NO: 13397 - DNA, 20 bp, human
ggcacgaatcgcgactcccc

SEQ ID NO: 13398 - DNA, 20 bp, human
ggcgggcccaaactcaaaca

SEQ ID NO: 13399 - DNA, 20 bp, human
gcgcagcgtcagctgacctg

SEQ ID NO: 13400 - DNA, 20 bp, human
gaagcagaggcgaacaactg

SEQ ID NO: 13401 - DNA, 20 bp, human
gagctccgggaagaacgaca

SEQ ID NO: 13402 - DNA, 20 bp, human
gcgcgccgagccacagctag

SEQ ID NO: 13403 - DNA, 20 bp, human
ggctgacgctgcgtcctcag

SEQ ID NO: 13404 - DNA, 20 bp, human
ggattcgtgccggccggtcc

SEQ ID NO: 13405 - DNA, 20 bp, human
ggcctcacgtgaccataagg

SEQ ID NO: 13406 - DNA, 20 bp, human
gggctagtgcaaatcttcag

SEQ ID NO: 13407 - DNA, 20 bp, human
gtccgcaccttcgagcatgg

SEQ ID NO: 13408 - DNA, 20 bp, human
gggggaagagattgaagcca

SEQ ID NO: 13409 - DNA, 20 bp, human
gcatctttcattactaatgt

SEQ ID NO: 13410 - DNA, 20 bp, human
ggagctgtttcaccctacct

SEQ ID NO: 13411 - DNA, 20 bp, human
gcaggccctccaggtagcca

SEQ ID NO: 13412 - DNA, 20 bp, human
gtcccccatgctcgaaggtg

SEQ ID NO: 13413 - DNA, 20 bp, human
ggcagcacaagcaatctatc

SEQ ID NO: 13414 - DNA, 20 bp, human
ggagctacacttaccttcta

SEQ ID NO: 13415 - DNA, 20 bp, human
ggggtccataaacttgaatg

SEQ ID NO: 13416 - DNA, 20 bp, human
gggcccgccttgggaggaac

SEQ ID NO: 13417 - DNA, 20 bp, human
ggtaggggttggcgctcagg

SEQ ID NO: 13418 - DNA, 20 bp, human
gggatccgagtgaggcgacg

SEQ ID NO: 13419 - DNA, 20 bp, human
ggtgaggccgtgatacgcca

SEQ ID NO: 13420 - DNA, 20 bp, human
gtcctggtgggatccgagtg

SEQ ID NO: 13421 - DNA, 20 bp, human
gggcaaacgaggcctcatgt

SEQ ID NO: 13422 - DNA, 20 bp, human
gccgccttgggaggaacggg

SEQ ID NO: 13423 - DNA, 20 bp, human
ggcaaccgcgacagcatggg

SEQ ID NO: 13424 - DNA, 20 bp, human
gccttggaaacgagtttcag

SEQ ID NO: 13425 - DNA, 20 bp, human
gtccggcctgagcgagtgga

SEQ ID NO: 13426 - DNA, 20 bp, human
ggccagtaaagggcacaagt

SEQ ID NO: 13427 - DNA, 20 bp, human
gggtgcgcgggtccccagcc

SEQ ID NO: 13428 - DNA, 20 bp, human
gatcctgcgcccggccatga

SEQ ID NO: 13429 - DNA, 20 bp, human
ggcgagagggcatatccaga

SEQ ID NO: 13430 - DNA, 20 bp, human
gtcagcgcgctgcccggctg

SEQ ID NO: 13431 - DNA, 20 bp, human
gtgagtgcgccgtcatggcc

SEQ ID NO: 13432 - DNA, 20 bp, human
ggtgaagatgatgaccggga

SEQ ID NO: 13433 - DNA, 20 bp, human
ggcatatccagaaggtaaag

SEQ ID NO: 13434 - DNA, 20 bp, human
gccgacgaggccccagaacg

SEQ ID NO: 13435 - DNA, 20 bp, human
gggatgcagggccgagcagc

SEQ ID NO: 13436 - DNA, 20 bp, human
ggcagagactgtaccgaccg

SEQ ID NO: 13437 - DNA, 20 bp, human
gcagcctctgggtcctcggt

SEQ ID NO: 13438 - DNA, 20 bp, human
gagaggctgtcaccacggag

SEQ ID NO: 13439 - DNA, 20 bp, human
ggaggtagcaaaaaccctgg

SEQ ID NO: 13440 - DNA, 20 bp, human
ggctgaggacttcccctccg

SEQ ID NO: 13441 - DNA, 20 bp, human
gcggtgagacaggcttggga

SEQ ID NO: 13442 - DNA, 20 bp, human
gcgggaacgaccacacttgg

SEQ ID NO: 13443 - DNA, 20 bp, human
gccccgctgtcaccctgcac

SEQ ID NO: 13444 - DNA, 20 bp, human
gcggtcgccgctcacctgct

SEQ ID NO: 13445 - DNA, 20 bp, human
gcccaccactcgccagttac

SEQ ID NO: 13446 - DNA, 20 bp, human
gagcagcaggctcagacact

SEQ ID NO: 13447 - DNA, 20 bp, human
gggcaactggaagctatctc

SEQ ID NO: 13448 - DNA, 20 bp, human
gccaccccagaagagagggc

SEQ ID NO: 13449 - DNA, 20 bp, human
ggtggggccacctggaccag

SEQ ID NO: 13450 - DNA, 20 bp, human
gaccgtgacgggtgaggtca

SEQ ID NO: 13451 - DNA, 20 bp, human
gtgacgggtgaggtcagggt

SEQ ID NO: 13452 - DNA, 20 bp, human
gtaggttgcagctactgccg

SEQ ID NO: 13453 - DNA, 20 bp, human
gtccagttgcccctgagagt

SEQ ID NO: 13454 - DNA, 20 bp, human
gagatagacagcaggcctgg

SEQ ID NO: 13455 - DNA, 20 bp, human
gctcacccgtcacggtggag

SEQ ID NO: 13456 - DNA, 20 bp, human
gggagcaaagggctaggcta

SEQ ID NO: 13457 - DNA, 20 bp, human
ggctacccgtgcccaccggt

SEQ ID NO: 13458 - DNA, 20 bp, human
gccaccgccggcccaccggt

SEQ ID NO: 13459 - DNA, 20 bp, human
gcggtgggcacgggtagctc

SEQ ID NO: 13460 - DNA, 20 bp, human
gggcacgggtagctcgggtg

SEQ ID NO: 13461 - DNA, 20 bp, human
gcctaggctggagccttctt

SEQ ID NO: 13462 - DNA, 20 bp, human
gctgagggcaagagcaccag

SEQ ID NO: 13463 - DNA, 20 bp, human
gtggcaagaagtggccctcg

SEQ ID NO: 13464 - DNA, 20 bp, human
gggcgctgcgggcgatgcgg

SEQ ID NO: 13465 - DNA, 20 bp, human
ggatggcgctgcgggcgatg

SEQ ID NO: 13466 - DNA, 20 bp, human
ggccggagcttaggtcggga

SEQ ID NO: 13467 - DNA, 20 bp, human
gaccgaggcagacagcctag

SEQ ID NO: 13468 - DNA, 20 bp, human
gtgaggccggagcttaggtc

SEQ ID NO: 13469 - DNA, 20 bp, human
gacagcctagcggacgctat

SEQ ID NO: 13470 - DNA, 20 bp, human
gttgggtagaggaagccgtg

SEQ ID NO: 13471 - DNA, 20 bp, human
gagccgtgaggccggagctt

SEQ ID NO: 13472 - DNA, 20 bp, human
ggcagcagtaacaggtaccg

SEQ ID NO: 13473 - DNA, 20 bp, human
gcccttcccgacctaagctc

SEQ ID NO: 13474 - DNA, 20 bp, human
gacttgttctgtgttcgctt

SEQ ID NO: 13475 - DNA, 20 bp, human
gggaatgaagtgataggtcc

SEQ ID NO: 13476 - DNA, 20 bp, human
ggcgggaccgggagtccgaa

SEQ ID NO: 13477 - DNA, 20 bp, human
ggcgcgggccgcgcggtagg

SEQ ID NO: 13478 - DNA, 20 bp, human
gcggtcccgctccaatccga

SEQ ID NO: 13479 - DNA, 20 bp, human
gccgggagtccgaaaggaag

SEQ ID NO: 13480 - DNA, 20 bp, human
gtccccgcggcgtctccgga

SEQ ID NO: 13481 - DNA, 20 bp, human
gtggcccgccgcagcacctg

SEQ ID NO: 13482 - DNA, 20 bp, human
gcagttcgtccccaggccat

SEQ ID NO: 13483 - DNA, 20 bp, human
gcccaggccatgggcagtca

SEQ ID NO: 13484 - DNA, 20 bp, human
gaggccatgggcagtcaagg

SEQ ID NO: 13485 - DNA, 20 bp, human
ggctttcccattggaaacgt

SEQ ID NO: 13486 - DNA, 20 bp, human
gcccgtagaggaagacactg

SEQ ID NO: 13487 - DNA, 20 bp, human
gccagtgcccggctcaataa

SEQ ID NO: 13488 - DNA, 20 bp, human
ggtagaggaagacactgtgg

SEQ ID NO: 13489 - DNA, 20 bp, human
gaaccagctgactcccgtag

SEQ ID NO: 13490 - DNA, 20 bp, human
gtgtagggcagaggtggcga

SEQ ID NO: 13491 - DNA, 20 bp, human
ggctgcaatagctccagaac

SEQ ID NO: 13492 - DNA, 20 bp, human
gtcaataagggtatgtggaa

SEQ ID NO: 13493 - DNA, 20 bp, human
ggatcccagccggtaggaaa

SEQ ID NO: 13494 - DNA, 20 bp, human
gctgtggcccagggtctgaa

SEQ ID NO: 13495 - DNA, 20 bp, human
ggaaacaaggaccctcactg

SEQ ID NO: 13496 - DNA, 20 bp, human
gggaacccgagatctgcgca

SEQ ID NO: 13497 - DNA, 20 bp, human
ggggtcttacgaagccgcgg

SEQ ID NO: 13498 - DNA, 20 bp, human
ggaacccctgcgcagatctc

SEQ ID NO: 13499 - DNA, 20 bp, human
gacccgcggttataaagtaa

SEQ ID NO: 13500 - DNA, 20 bp, human
gtggcaggaaccggaacccg

SEQ ID NO: 13501 - DNA, 20 bp, human
gtggaaaacagggaatgctg

SEQ ID NO: 13502 - DNA, 20 bp, human
gagagccagggcgttcaaga

SEQ ID NO: 13503 - DNA, 20 bp, human
gcacagatctctgtccgact

SEQ ID NO: 13504 - DNA, 20 bp, human
gaaacagggaatgctgaggt

SEQ ID NO: 13505 - DNA, 20 bp, human
gaggtgagagaaatcggcaa

SEQ ID NO: 13506 - DNA, 20 bp, human
ggcggccctcgcagggagtg

SEQ ID NO: 13507 - DNA, 20 bp, human
gcctccgcgcggccctcgca

SEQ ID NO: 13508 - DNA, 20 bp, human
gccgatgctgggagaagacg

SEQ ID NO: 13509 - DNA, 20 bp, human
ggggaccacgcaataagcca

SEQ ID NO: 13510 - DNA, 20 bp, human
gatgctgggagaagacgtgg

SEQ ID NO: 13511 - DNA, 20 bp, human
ggtcatcgtggaggtcgtcg

SEQ ID NO: 13512 - DNA, 20 bp, human
gcgagccccactccctgcga

SEQ ID NO: 13513 - DNA, 20 bp, human
gacggaactagaaatcaagg

SEQ ID NO: 13514 - DNA, 20 bp, human
ggaagacgtggaggcctctc

SEQ ID NO: 13515 - DNA, 20 bp, human
gctcgtgctacggaaggcgt

SEQ ID NO: 13516 - DNA, 20 bp, human
gaggccgacggggcgccgta

SEQ ID NO: 13517 - DNA, 20 bp, human
gctcgtgacagcctagacag

SEQ ID NO: 13518 - DNA, 20 bp, human
ggtgatcggagacgaggaca

SEQ ID NO: 13519 - DNA, 20 bp, human
gggaggcctccgctccggaa

SEQ ID NO: 13520 - DNA, 20 bp, human
ggacgatggtgagcctctaa

SEQ ID NO: 13521 - DNA, 20 bp, human
gtcgtgtgtcatgaaagaag

SEQ ID NO: 13522 - DNA, 20 bp, human
gtaccgcgcgaggcctgaac

SEQ ID NO: 13523 - DNA, 20 bp, human
gggctcaccatcgtcccgta

SEQ ID NO: 13524 - DNA, 20 bp, human
gcatgacacacgatcatgtg

SEQ ID NO: 13525 - DNA, 20 bp, human
gggcctccgctccggaaggg

SEQ ID NO: 13526 - DNA, 20 bp, human
ggagcaaggcaagcggccta

SEQ ID NO: 13527 - DNA, 20 bp, human
gtgagactgactagccatgg

SEQ ID NO: 13528 - DNA, 20 bp, human
ggcggcctaaggcacctcga

SEQ ID NO: 13529 - DNA, 20 bp, human
gaggagcaagcgcagattgt

SEQ ID NO: 13530 - DNA, 20 bp, human
gcaccccagagcggttaagt

SEQ ID NO: 13531 - DNA, 20 bp, human
gggcacctcgaaggcccctt

SEQ ID NO: 13532 - DNA, 20 bp, human
ggcctggaggcatgtgaaat

SEQ ID NO: 13533 - DNA, 20 bp, human
gggcagcgattctgagagca

SEQ ID NO: 13534 - DNA, 20 bp, human
gagcaagcgcagattgtggg

SEQ ID NO: 13535 - DNA, 20 bp, human
gctgtgtcagctgacccaag

SEQ ID NO: 13536 - DNA, 20 bp, human
gcgactgaagcaggcaaagg

SEQ ID NO: 13537 - DNA, 20 bp, human
gtcagtcgccgggccttccc

SEQ ID NO: 13538 - DNA, 20 bp, human
gagaagctgctggatacctt

SEQ ID NO: 13539 - DNA, 20 bp, human
gacagacagctagggtctgg

SEQ ID NO: 13540 - DNA, 20 bp, human
gtggataccttgggactgac

SEQ ID NO: 13541 - DNA, 20 bp, human
ggtctggaggctggttagga

SEQ ID NO: 13542 - DNA, 20 bp, human
gagcagcaggcggtgagttg

SEQ ID NO: 13543 - DNA, 20 bp, human
gaggaccagtcatcaatagg

SEQ ID NO: 13544 - DNA, 20 bp, human
gaaggcccggcgactgaagc

SEQ ID NO: 13545 - DNA, 20 bp, human
gtgagattgggagagacact

SEQ ID NO: 13546 - DNA, 20 bp, human
gccctgagactggcttgtca

SEQ ID NO: 13547 - DNA, 20 bp, human
ggtagtctgctccaagcaag

SEQ ID NO: 13548 - DNA, 20 bp, human
gcgggccaaggacaagctag

SEQ ID NO: 13549 - DNA, 20 bp, human
ggggatccaccagcttcttc

SEQ ID NO: 13550 - DNA, 20 bp, human
gaccatgacaagccagtctc

SEQ ID NO: 13551 - DNA, 20 bp, human
ggaatgggtgaaggtctcac

SEQ ID NO: 13552 - DNA, 20 bp, human
gataagtagattcaatccag

SEQ ID NO: 13553 - DNA, 20 bp, human
gttagggggtagaaaacctc

SEQ ID NO: 13554 - DNA, 20 bp, human
gaacaggcatggcatagcca

SEQ ID NO: 13555 - DNA, 20 bp, human
gttcgtgacagacccctcac

SEQ ID NO: 13556 - DNA, 20 bp, human
ggagacgttgagggccgcac

SEQ ID NO: 13557 - DNA, 20 bp, human
gtgagggccgcacaggtaga

SEQ ID NO: 13558 - DNA, 20 bp, human
gtgaagcgggtcccgcacca

SEQ ID NO: 13559 - DNA, 20 bp, human
gagaacaggagaggaccaag

SEQ ID NO: 13560 - DNA, 20 bp, human
gaaagcaatctggcaaccgg

SEQ ID NO: 13561 - DNA, 20 bp, human
gcgcaccaaggagacgttga

SEQ ID NO: 13562 - DNA, 20 bp, human
gccgggagccgaaagtgaag

SEQ ID NO: 13563 - DNA, 20 bp, human
ggtgcctccgatcacgtgac

SEQ ID NO: 13564 - DNA, 20 bp, human
gcagaggtctgagcagtgga

SEQ ID NO: 13565 - DNA, 20 bp, human
gctgggcagcgcgaacgaca

SEQ ID NO: 13566 - DNA, 20 bp, human
gggagaagtcacagtagctg

SEQ ID NO: 13567 - DNA, 20 bp, human
gtctggagctacgcagaccg

SEQ ID NO: 13568 - DNA, 20 bp, human
ggtcacagtagctgcggctg

SEQ ID NO: 13569 - DNA, 20 bp, human
gcaggacattctctccaaga

SEQ ID NO: 13570 - DNA, 20 bp, human
gacgttacccaattaattga

SEQ ID NO: 13571 - DNA, 20 bp, human
ggacgacgggaagccaatgt

SEQ ID NO: 13572 - DNA, 20 bp, human
gagaaggtcatgttagtctg

SEQ ID NO: 13573 - DNA, 20 bp, human
gtagcttccaaagtataaag

SEQ ID NO: 13574 - DNA, 20 bp, human
ggctccagaggtttaaccat

SEQ ID NO: 13575 - DNA, 20 bp, human
gctaacaggggatagaggag

SEQ ID NO: 13576 - DNA, 20 bp, human
gggcgcagagtccgaggagg

SEQ ID NO: 13577 - DNA, 20 bp, human
gcagccaggcgcagagtccg

SEQ ID NO: 13578 - DNA, 20 bp, human
gcgccgtcctcccgacctgg

SEQ ID NO: 13579 - DNA, 20 bp, human
gttgcttcctttgggaccca

SEQ ID NO: 13580 - DNA, 20 bp, human
ggtcccaaaggaagcaaccg

SEQ ID NO: 13581 - DNA, 20 bp, human
ggggccggcagttccagggt

SEQ ID NO: 13582 - DNA, 20 bp, human
gtgcccccaggtcgggagga

SEQ ID NO: 13583 - DNA, 20 bp, human
gcctggctgccggacgccgt

SEQ ID NO: 13584 - DNA, 20 bp, human
gggcacggcagaggacattg

SEQ ID NO: 13585 - DNA, 20 bp, human
gcgagaccgcggaggaggac

SEQ ID NO: 13586 - DNA, 20 bp, human
gcccgcacgccgacaggagg

SEQ ID NO: 13587 - DNA, 20 bp, human
gctgccgccggggaagaggt

SEQ ID NO: 13588 - DNA, 20 bp, human
ggcccccgcacgccgacagg

SEQ ID NO: 13589 - DNA, 20 bp, human
ggggtctgcgagtacactgg

SEQ ID NO: 13590 - DNA, 20 bp, human
gtggcggcgcccgcagagct

SEQ ID NO: 13591 - DNA, 20 bp, human
gccgcgccgccgcccaccta

SEQ ID NO: 13592 - DNA, 20 bp, human
gtgtcgcgcccggcccctag

SEQ ID NO: 13593 - DNA, 20 bp, human
gagggtactggagcctggaa

SEQ ID NO: 13594 - DNA, 20 bp, human
gtcttgctgcagccgcggag

SEQ ID NO: 13595 - DNA, 20 bp, human
gaccatgcggaggaccgtgt

SEQ ID NO: 13596 - DNA, 20 bp, human
ggccgccgcccgaggaccat

SEQ ID NO: 13597 - DNA, 20 bp, human
gccgcccgaggaccatgggt

SEQ ID NO: 13598 - DNA, 20 bp, human
ggcatccgcgaacgccaccg

SEQ ID NO: 13599 - DNA, 20 bp, human
gacacgggcgagatgctgaa

SEQ ID NO: 13600 - DNA, 20 bp, human
ggccgccgagcccccgacac

SEQ ID NO: 13601 - DNA, 20 bp, human
gttggccgctgcggcacgga

SEQ ID NO: 13602 - DNA, 20 bp, human
gagcggatcctcgacctccg

SEQ ID NO: 13603 - DNA, 20 bp, human
ggggcgcggcgagggagggt

SEQ ID NO: 13604 - DNA, 20 bp, human
gggccagcgcgccgcgtcgg

SEQ ID NO: 13605 - DNA, 20 bp, human
gggcggccccgggcgagaga

SEQ ID NO: 13606 - DNA, 20 bp, human
gccagaggcacctccccgag

SEQ ID NO: 13607 - DNA, 20 bp, human
gcggccgccgagcctcgctg

SEQ ID NO: 13608 - DNA, 20 bp, human
gttggagatccgggatgcgg

SEQ ID NO: 13609 - DNA, 20 bp, human
ggagcggccagggaacctgc

SEQ ID NO: 13610 - DNA, 20 bp, human
gtagcgacacacatgtccgg

SEQ ID NO: 13611 - DNA, 20 bp, human
gcagccccagcgaggctcgg

SEQ ID NO: 13612 - DNA, 20 bp, human
gctccaaagtgcggcgggag

SEQ ID NO: 13613 - DNA, 20 bp, human
gagcgctgcatggcgcacgg

SEQ ID NO: 13614 - DNA, 20 bp, human
gaggacaccgccgggccaag

SEQ ID NO: 13615 - DNA, 20 bp, human
ggagccagcggcatccccca

SEQ ID NO: 13616 - DNA, 20 bp, human
gtagcgggccgaggccccgg

SEQ ID NO: 13617 - DNA, 20 bp, human
ggctcggctcggctccccac

SEQ ID NO: 13618 - DNA, 20 bp, human
gggtctgcgtacaggatggg

SEQ ID NO: 13619 - DNA, 20 bp, human
ggcggccgactggagacgag

SEQ ID NO: 13620 - DNA, 20 bp, human
gacccgcccagagagttgtt

SEQ ID NO: 13621 - DNA, 20 bp, human
ggagagcggcgcgagtgcca

SEQ ID NO: 13622 - DNA, 20 bp, human
gagagcgggggtctgcgtac

SEQ ID NO: 13623 - DNA, 20 bp, human
gtgggagctgcggccagacg

SEQ ID NO: 13624 - DNA, 20 bp, human
ggggagcggggccgcagctg

SEQ ID NO: 13625 - DNA, 20 bp, human
ggtcagtttcggccacggcg

SEQ ID NO: 13626 - DNA, 20 bp, human
ggcccaagagagcccctcta

SEQ ID NO: 13627 - DNA, 20 bp, human
ggagccgcagccgctcagag

SEQ ID NO: 13628 - DNA, 20 bp, human
ggcagcccaggccatcctcc

SEQ ID NO: 13629 - DNA, 20 bp, human
ggcggccgggaggatggcct

SEQ ID NO: 13630 - DNA, 20 bp, human
ggaggggagccccagccgtc

SEQ ID NO: 13631 - DNA, 20 bp, human
gatggcctgggctgcgggtg

SEQ ID NO: 13632 - DNA, 20 bp, human
gccatgcaaacgaagaaggt

SEQ ID NO: 13633 - DNA, 20 bp, human
gtcgcggtgtccccgagcgc

SEQ ID NO: 13634 - DNA, 20 bp, human
gccttcggagccaggatctc

SEQ ID NO: 13635 - DNA, 20 bp, human
ggatcaaggcaggtaggggg

SEQ ID NO: 13636 - DNA, 20 bp, human
gaggccgcgggcgtccaggg

SEQ ID NO: 13637 - DNA, 20 bp, human
gggcaggccgcgggcgtcca

SEQ ID NO: 13638 - DNA, 20 bp, human
gccactcgaagtgtatctgg

SEQ ID NO: 13639 - DNA, 20 bp, human
gccgctcaccggcgcaggag

SEQ ID NO: 13640 - DNA, 20 bp, human
gccccccgtttcaggaccgt

SEQ ID NO: 13641 - DNA, 20 bp, human
gcacaggaccgccctggaca

SEQ ID NO: 13642 - DNA, 20 bp, human
gcgaccgcgcgaacctctag

SEQ ID NO: 13643 - DNA, 20 bp, human
ggggagcacccgccgctcac

SEQ ID NO: 13644 - DNA, 20 bp, human
gggcatcccagttagtgagg

SEQ ID NO: 13645 - DNA, 20 bp, human
ggtgccaacggtcctgaaac

SEQ ID NO: 13646 - DNA, 20 bp, human
gcagtgcaggaagatcaaac

SEQ ID NO: 13647 - DNA, 20 bp, human
gcatgccaaggagaaaagca

SEQ ID NO: 13648 - DNA, 20 bp, human
gtaaaaccaactactaccaa

SEQ ID NO: 13649 - DNA, 20 bp, human
gccttggcatggtcacggaa

SEQ ID NO: 13650 - DNA, 20 bp, human
gaacaaactgggtctctagg

SEQ ID NO: 13651 - DNA, 20 bp, human
gaggtctttgtcacttcctt

SEQ ID NO: 13652 - DNA, 20 bp, human
gcacttcctttggtagtagt

SEQ ID NO: 13653 - DNA, 20 bp, human
gaccaatgatagtagcataa

SEQ ID NO: 13654 - DNA, 20 bp, human
gtttctccttggcatggtca

SEQ ID NO: 13655 - DNA, 20 bp, human
ggtagatgggtagcattcaa

SEQ ID NO: 13656 - DNA, 20 bp, human
ggccggtgcgccagaagaag

SEQ ID NO: 13657 - DNA, 20 bp, human
ggtgcgccagaagaagcgga

SEQ ID NO: 13658 - DNA, 20 bp, human
ggagtgtgtaaacagcactg

SEQ ID NO: 13659 - DNA, 20 bp, human
gtcaggctaggtgccgcccg

SEQ ID NO: 13660 - DNA, 20 bp, human
gtaattacggaacaataaaa

SEQ ID NO: 13661 - DNA, 20 bp, human
gccgggcgctcgaaccccaa

SEQ ID NO: 13662 - DNA, 20 bp, human
ggcgccgcgcctgccacggg

SEQ ID NO: 13663 - DNA, 20 bp, human
gtacggacagatattaatta

SEQ ID NO: 13664 - DNA, 20 bp, human
ggggcgggcccggcttctcg

SEQ ID NO: 13665 - DNA, 20 bp, human
gcgctcgaaccccaaagggc

SEQ ID NO: 13666 - DNA, 20 bp, human
gtacccggtgcgtagcgcag

SEQ ID NO: 13667 - DNA, 20 bp, human
gggccccgcggcgctgtagt

SEQ ID NO: 13668 - DNA, 20 bp, human
gcgagcgtaggagccagaac

SEQ ID NO: 13669 - DNA, 20 bp, human
ggaacgggagcagagaaccg

SEQ ID NO: 13670 - DNA, 20 bp, human
gcgctacgcaccgggtaaag

SEQ ID NO: 13671 - DNA, 20 bp, human
gaggggcggtcggaacatgg

SEQ ID NO: 13672 - DNA, 20 bp, human
gccgccgctgcgctacgcac

SEQ ID NO: 13673 - DNA, 20 bp, human
gaccgcggtccagtgttgag

SEQ ID NO: 13674 - DNA, 20 bp, human
ggcggtccagtgttgagggg

SEQ ID NO: 13675 - DNA, 20 bp, human
ggcacagcaggtaaccgagg

SEQ ID NO: 13676 - DNA, 20 bp, human
gaggtggccggtctctaccg

SEQ ID NO: 13677 - DNA, 20 bp, human
gttccgcgcgcccaaggttc

SEQ ID NO: 13678 - DNA, 20 bp, human
gtagcggtcgtagaaagggt

SEQ ID NO: 13679 - DNA, 20 bp, human
gggccgtggcatacacaggg

SEQ ID NO: 13680 - DNA, 20 bp, human
gcagcagctggatcttgtcg

SEQ ID NO: 13681 - DNA, 20 bp, human
gcacaggccccggtagagac

SEQ ID NO: 13682 - DNA, 20 bp, human
ggcgggccgtggcatacaca

SEQ ID NO: 13683 - DNA, 20 bp, human
ggcggtagcggtcgtagaaa

SEQ ID NO: 13684 - DNA, 20 bp, human
gtgctgtcggcgcccccctc

SEQ ID NO: 13685 - DNA, 20 bp, human
gggcaagtgacctagcctcg

SEQ ID NO: 13686 - DNA, 20 bp, human
gagatggcggcgtccaaggg

SEQ ID NO: 13687 - DNA, 20 bp, human
gggtgtcatgcggaagatgg

SEQ ID NO: 13688 - DNA, 20 bp, human
gggaagatggcggcgtccaa

SEQ ID NO: 13689 - DNA, 20 bp, human
gggcgtccaagggaggttga

SEQ ID NO: 13690 - DNA, 20 bp, human
ggcgcgccgtaggtgtcatg

SEQ ID NO: 13691 - DNA, 20 bp, human
ggtaggtgtcatgcggaaga

SEQ ID NO: 13692 - DNA, 20 bp, human
ggtgcaaagcgaagtaactg

SEQ ID NO: 13693 - DNA, 20 bp, human
ggccgcacggtcgggctgta

SEQ ID NO: 13694 - DNA, 20 bp, human
gcgccggccgattcaggaga

SEQ ID NO: 13695 - DNA, 20 bp, human
gtccccaaagccgcacggtc

SEQ ID NO: 13696 - DNA, 20 bp, human
gagtccgagaatgtcgaccg

SEQ ID NO: 13697 - DNA, 20 bp, human
gcaagcccgaggcttcggct

SEQ ID NO: 13698 - DNA, 20 bp, human
ggctgcggcagagacgccag

SEQ ID NO: 13699 - DNA, 20 bp, human
gaacgagagactgcttgctg

SEQ ID NO: 13700 - DNA, 20 bp, human
ggcaacggtcgggacatcaa

SEQ ID NO: 13701 - DNA, 20 bp, human
ggcaccaggtaggaacgggt

SEQ ID NO: 13702 - DNA, 20 bp, human
gaaggccattgggagatcca

SEQ ID NO: 13703 - DNA, 20 bp, human
gccagccctggatctcccaa

SEQ ID NO: 13704 - DNA, 20 bp, human
gagggacactggtaaaggta

SEQ ID NO: 13705 - DNA, 20 bp, human
gactgggagtgccctatacg

SEQ ID NO: 13706 - DNA, 20 bp, human
gccgggaacccgcgttggcg

SEQ ID NO: 13707 - DNA, 20 bp, human
ggcccgacggagccgtgtgg

SEQ ID NO: 13708 - DNA, 20 bp, human
gagacgccgggaacccgcgt

SEQ ID NO: 13709 - DNA, 20 bp, human
gccacggagcatctccacaa

SEQ ID NO: 13710 - DNA, 20 bp, human
gggaagcaaactctcgatcg

SEQ ID NO: 13711 - DNA, 20 bp, human
ggtgagtggtaaaccagggc

SEQ ID NO: 13712 - DNA, 20 bp, human
gcggggtgagtggtaaacca

SEQ ID NO: 13713 - DNA, 20 bp, human
ggcctccacacggctccgtc

SEQ ID NO: 13714 - DNA, 20 bp, human
ggcgggaagccggtccgtgg

SEQ ID NO: 13715 - DNA, 20 bp, human
ggccatgttcccccatgctg

SEQ ID NO: 13716 - DNA, 20 bp, human
gcgcgagcagcggagcacca

SEQ ID NO: 13717 - DNA, 20 bp, human
gcagcggagcaccaagggaa

SEQ ID NO: 13718 - DNA, 20 bp, human
gcagggtcgtaagactaccc

SEQ ID NO: 13719 - DNA, 20 bp, human
gtaagactacccgggtcgtg

SEQ ID NO: 13720 - DNA, 20 bp, human
gccgccctcagtaaacatgg

SEQ ID NO: 13721 - DNA, 20 bp, human
ggcagggtcgggaagcgtca

SEQ ID NO: 13722 - DNA, 20 bp, human
gcatatatcgtgcggtggta

SEQ ID NO: 13723 - DNA, 20 bp, human
gaaatggcgcctcacgaccc

SEQ ID NO: 13724 - DNA, 20 bp, human
gacgcccagagcgaggagca

SEQ ID NO: 13725 - DNA, 20 bp, human
gcgtagagagattacacaag

SEQ ID NO: 13726 - DNA, 20 bp, human
gcactcgcggcggaggcaag

SEQ ID NO: 13727 - DNA, 20 bp, human
gtcggcgctgtcggatactt

SEQ ID NO: 13728 - DNA, 20 bp, human
ggtccagttctccggcctgg

SEQ ID NO: 13729 - DNA, 20 bp, human
ggcggcaggcaagtctagct

SEQ ID NO: 13730 - DNA, 20 bp, human
gtcaagctcctccaggtcgt

SEQ ID NO: 13731 - DNA, 20 bp, human
gtgccgccaggccggagaac

SEQ ID NO: 13732 - DNA, 20 bp, human
gccgaagccacagccatcaa

SEQ ID NO: 13733 - DNA, 20 bp, human
gcgcgccgaacgggtcgtca

SEQ ID NO: 13734 - DNA, 20 bp, human
gaacgggtcgtcagggtccg

SEQ ID NO: 13735 - DNA, 20 bp, human
gggccgcgaggagcactcac

SEQ ID NO: 13736 - DNA, 20 bp, human
ggagggtcgggtccaaccag

SEQ ID NO: 13737 - DNA, 20 bp, human
gaccggccctgtgtcaacgg

SEQ ID NO: 13738 - DNA, 20 bp, human
gcccgcacggccaggcgaag

SEQ ID NO: 13739 - DNA, 20 bp, human
ggtcgctgcaaccctggcac

SEQ ID NO: 13740 - DNA, 20 bp, human
gtctgccccgccggctgggt

SEQ ID NO: 13741 - DNA, 20 bp, human
gtgcagccaccatcttcccg

SEQ ID NO: 13742 - DNA, 20 bp, human
gaccagaggctggggctgag

SEQ ID NO: 13743 - DNA, 20 bp, human
gagcgaccgccgttgacaca

SEQ ID NO: 13744 - DNA, 20 bp, human
ggtgaccggccctgtgtcaa

SEQ ID NO: 13745 - DNA, 20 bp, human
gtgggactgggacgtgacca

SEQ ID NO: 13746 - DNA, 20 bp, human
gctcctgaggggacctgacc

SEQ ID NO: 13747 - DNA, 20 bp, human
ggatgcccgagtgcgactgg

SEQ ID NO: 13748 - DNA, 20 bp, human
gcggggaagatggagactgg

SEQ ID NO: 13749 - DNA, 20 bp, human
gctgaggggacctgaccggg

SEQ ID NO: 13750 - DNA, 20 bp, human
gtgcgcccggcgctcctgag

SEQ ID NO: 13751 - DNA, 20 bp, human
gactggaggcagccgagcgg

SEQ ID NO: 13752 - DNA, 20 bp, human
gtggctgcggggtaccagtg

SEQ ID NO: 13753 - DNA, 20 bp, human
gggtcggcccgctaaggaca

SEQ ID NO: 13754 - DNA, 20 bp, human
gcggcccgcgccaactgcct

SEQ ID NO: 13755 - DNA, 20 bp, human
gcggggagcgggactcggac

SEQ ID NO: 13756 - DNA, 20 bp, human
gtgcctgggcccagaccgct

SEQ ID NO: 13757 - DNA, 20 bp, human
gggcgcgggggagcgcagat

SEQ ID NO: 13758 - DNA, 20 bp, human
ggagcctcggcccaacaaaa

SEQ ID NO: 13759 - DNA, 20 bp, human
gcgctggggcccatgagacg

SEQ ID NO: 13760 - DNA, 20 bp, human
gcggcgcaaggctccgacgg

SEQ ID NO: 13761 - DNA, 20 bp, human
ggggcgcggcctagggtatg

SEQ ID NO: 13762 - DNA, 20 bp, human
gtatcggcgcaaggctccga

SEQ ID NO: 13763 - DNA, 20 bp, human
gcccaggcaccgtctgagtc

SEQ ID NO: 13764 - DNA, 20 bp, human
gtttgtttccgcggctcctg

SEQ ID NO: 13765 - DNA, 20 bp, human
gtagcggcctttgagctgtg

SEQ ID NO: 13766 - DNA, 20 bp, human
gcagtgaaacaggtcctgta

SEQ ID NO: 13767 - DNA, 20 bp, human
gtacagtggcggagccgtac

SEQ ID NO: 13768 - DNA, 20 bp, human
ggcccctctcgggagatcgg

SEQ ID NO: 13769 - DNA, 20 bp, human
gctctggctgctgctccacg

SEQ ID NO: 13770 - DNA, 20 bp, human
ggatccccctgcagtgaaac

SEQ ID NO: 13771 - DNA, 20 bp, human
ggacatcatttctactacag

SEQ ID NO: 13772 - DNA, 20 bp, human
gaggacctgtttcactgcag

SEQ ID NO: 13773 - DNA, 20 bp, human
gggaggggggaaagaatcgg

SEQ ID NO: 13774 - DNA, 20 bp, human
gacccccactctgggcgcag

SEQ ID NO: 13775 - DNA, 20 bp, human
ggtgtacatacaaccgtccc

SEQ ID NO: 13776 - DNA, 20 bp, human
gtgggtcgagcctgacgagg

SEQ ID NO: 13777 - DNA, 20 bp, human
gtcagcctagagctctccgg

SEQ ID NO: 13778 - DNA, 20 bp, human
gtcccgcctgaggcgagtct

SEQ ID NO: 13779 - DNA, 20 bp, human
ggcctcgctggagacgcgga

SEQ ID NO: 13780 - DNA, 20 bp, human
gggctcgacccagctgtgag

SEQ ID NO: 13781 - DNA, 20 bp, human
gcagccctcgcacatgacag

SEQ ID NO: 13782 - DNA, 20 bp, human
gccccgcctcgctggagacg

SEQ ID NO: 13783 - DNA, 20 bp, human
gcggcggttagggctgtgta

SEQ ID NO: 13784 - DNA, 20 bp, human
ggccctccgcgtctccagcg

SEQ ID NO: 13785 - DNA, 20 bp, human
ggggcctccaggtcttggat

SEQ ID NO: 13786 - DNA, 20 bp, human
gggtccacccttcaccaagg

SEQ ID NO: 13787 - DNA, 20 bp, human
gccttgatccaacaagggta

SEQ ID NO: 13788 - DNA, 20 bp, human
gctacggttatggctcccag

SEQ ID NO: 13789 - DNA, 20 bp, human
ggaaccgtggacagacggag

SEQ ID NO: 13790 - DNA, 20 bp, human
gcgagcttgacgccatctcc

SEQ ID NO: 13791 - DNA, 20 bp, human
gggacgagtgagtggatcct

SEQ ID NO: 13792 - DNA, 20 bp, human
gcgggaagggcccccaaaca

SEQ ID NO: 13793 - DNA, 20 bp, human
gctgcccccttggtgaaggg

SEQ ID NO: 13794 - DNA, 20 bp, human
gtccgggcgcccggctgtgg

SEQ ID NO: 13795 - DNA, 20 bp, human
gcaaggtgtccgagtctgtg

SEQ ID NO: 13796 - DNA, 20 bp, human
gttggtagcaacggcaacgg

SEQ ID NO: 13797 - DNA, 20 bp, human
ggccgaggacgaggagaccg

SEQ ID NO: 13798 - DNA, 20 bp, human
gaacagtctgaggcggaggg

SEQ ID NO: 13799 - DNA, 20 bp, human
gccaatgtccgcaagcccgg

SEQ ID NO: 13800 - DNA, 20 bp, human
gctaccaaaacagtctgagg

SEQ ID NO: 13801 - DNA, 20 bp, human
gttgctaccaaaacagtctg

SEQ ID NO: 13802 - DNA, 20 bp, human
ggggaggcccgccgagacca

SEQ ID NO: 13803 - DNA, 20 bp, human
gtggtgaggggcccatacac

SEQ ID NO: 13804 - DNA, 20 bp, human
gccgagaccaaggagccgcc

SEQ ID NO: 13805 - DNA, 20 bp, human
gtcgccgcgaccaccgagga

SEQ ID NO: 13806 - DNA, 20 bp, human
gagcgccaggtgagaagggt

SEQ ID NO: 13807 - DNA, 20 bp, human
gcggctggaggaaagcgaga

SEQ ID NO: 13808 - DNA, 20 bp, human
ggccgcagcaacaccaggag

SEQ ID NO: 13809 - DNA, 20 bp, human
ggaagcgccgcgaggcggaa

SEQ ID NO: 13810 - DNA, 20 bp, human
ggagagcgcgggaagcgagg

SEQ ID NO: 13811 - DNA, 20 bp, human
gtggcccgtcggccccccgg

SEQ ID NO: 13812 - DNA, 20 bp, human
ggggagccgcggccacccag

SEQ ID NO: 13813 - DNA, 20 bp, human
gcggagcccgctcccggcag

SEQ ID NO: 13814 - DNA, 20 bp, human
gggggcaccagccctcccaa

SEQ ID NO: 13815 - DNA, 20 bp, human
gggtggccagcggccccggg

SEQ ID NO: 13816 - DNA, 20 bp, human
gggttcggcgtgggggccgt

SEQ ID NO: 13817 - DNA, 20 bp, human
gccccacccagccctccgag

SEQ ID NO: 13818 - DNA, 20 bp, human
ggacagctccccaccgaacg

SEQ ID NO: 13819 - DNA, 20 bp, human
ggccaggattagggtaggag

SEQ ID NO: 13820 - DNA, 20 bp, human
gtgactctagctagacccta

SEQ ID NO: 13821 - DNA, 20 bp, human
gctagctagaccctagggag

SEQ ID NO: 13822 - DNA, 20 bp, human
gggctccagacaaataaaca

SEQ ID NO: 13823 - DNA, 20 bp, human
gattctgccaggattagggt

SEQ ID NO: 13824 - DNA, 20 bp, human
gctagggagagggaaggatt

SEQ ID NO: 13825 - DNA, 20 bp, human
ggaaagtgagtgtccgcgtt

SEQ ID NO: 13826 - DNA, 20 bp, human
ggatgttgtatgcccagcta

SEQ ID NO: 13827 - DNA, 20 bp, human
gccaggtaactgccatagct

SEQ ID NO: 13828 - DNA, 20 bp, human
ggcatacctacagaaactca

SEQ ID NO: 13829 - DNA, 20 bp, human
gacctgaatggagaagaaac

SEQ ID NO: 13830 - DNA, 20 bp, human
gctgggcatacaacatcttc

SEQ ID NO: 13831 - DNA, 20 bp, human
gtctaaaccccagaacttca

SEQ ID NO: 13832 - DNA, 20 bp, human
gcaaaccttatgaagaccat

SEQ ID NO: 13833 - DNA, 20 bp, human
gatcctgaatatcagaagct

SEQ ID NO: 13834 - DNA, 20 bp, human
gatattcaggattattgaaa

SEQ ID NO: 13835 - DNA, 20 bp, human
gtgtatccgtgagtttctgt

SEQ ID NO: 13836 - DNA, 20 bp, human
gccaggagaggcgggactag

SEQ ID NO: 13837 - DNA, 20 bp, human
gggactaggggtaccgaggg

SEQ ID NO: 13838 - DNA, 20 bp, human
gtcggcgggtgcgggaaaaa

SEQ ID NO: 13839 - DNA, 20 bp, human
ggcgggactaggggtaccga

SEQ ID NO: 13840 - DNA, 20 bp, human
gcccagcgacgcgcccccct

SEQ ID NO: 13841 - DNA, 20 bp, human
gtgacggggacgcccggatc

SEQ ID NO: 13842 - DNA, 20 bp, human
ggcacccgccgagcccagga

SEQ ID NO: 13843 - DNA, 20 bp, human
gaaacttggcgacctcccgg

SEQ ID NO: 13844 - DNA, 20 bp, human
ggacccgccccagcgcgcgt

SEQ ID NO: 13845 - DNA, 20 bp, human
gtgactgtccctatcttaag

SEQ ID NO: 13846 - DNA, 20 bp, human
gggacagtcgtggaatctgt

SEQ ID NO: 13847 - DNA, 20 bp, human
gaggcgccagggagttccgg

SEQ ID NO: 13848 - DNA, 20 bp, human
ggtcgcgagggggtgaaggg

SEQ ID NO: 13849 - DNA, 20 bp, human
ggcacgcacggggtaggtgt

SEQ ID NO: 13850 - DNA, 20 bp, human
gtgtgacccgccccctcgag

SEQ ID NO: 13851 - DNA, 20 bp, human
gcgcggcccgcggaccgggt

SEQ ID NO: 13852 - DNA, 20 bp, human
gagtgatgctgggacagtcg

SEQ ID NO: 13853 - DNA, 20 bp, human
gtgaggcttccaaacttcct

SEQ ID NO: 13854 - DNA, 20 bp, human
gcgccgcaatggcgacggtc

SEQ ID NO: 13855 - DNA, 20 bp, human
gtccacctcggccgccgcaa

SEQ ID NO: 13856 - DNA, 20 bp, human
gggaagagcaatggcgacac

SEQ ID NO: 13857 - DNA, 20 bp, human
gccagaaacgcctccggact

SEQ ID NO: 13858 - DNA, 20 bp, human
gcgcaaagtgcccagtccgg

SEQ ID NO: 13859 - DNA, 20 bp, human
gcagggaaaaagcaacaaga

SEQ ID NO: 13860 - DNA, 20 bp, human
ggatcgcaaagtgcccagtc

SEQ ID NO: 13861 - DNA, 20 bp, human
gtgctgctgccgaaggaaca

SEQ ID NO: 13862 - DNA, 20 bp, human
ggaagcatggaggacaccgg

SEQ ID NO: 13863 - DNA, 20 bp, human
gcgtcgatccaggaggacca

SEQ ID NO: 13864 - DNA, 20 bp, human
gagcagcagccgagagacac

SEQ ID NO: 13865 - DNA, 20 bp, human
gtggctctaggtgaatggaa

SEQ ID NO: 13866 - DNA, 20 bp, human
gagcaatggccgctctggag

SEQ ID NO: 13867 - DNA, 20 bp, human
gaggagggtcgcgagctgag

SEQ ID NO: 13868 - DNA, 20 bp, human
gtgcggacagggaaagctgg

SEQ ID NO: 13869 - DNA, 20 bp, human
gtaaaggcaagcctatatgg

SEQ ID NO: 13870 - DNA, 20 bp, human
gggcacccgccgctccagag

SEQ ID NO: 13871 - DNA, 20 bp, human
ggaacgcgcggcggcagcaa

SEQ ID NO: 13872 - DNA, 20 bp, human
gggacagagctggagctcgt

SEQ ID NO: 13873 - DNA, 20 bp, human
gccgcgaagtcatcgagact

SEQ ID NO: 13874 - DNA, 20 bp, human
gggacggcggctccagtcgg

SEQ ID NO: 13875 - DNA, 20 bp, human
ggtgcgtgggaaacacgtgg

SEQ ID NO: 13876 - DNA, 20 bp, human
gagcgcgtgcatctgccccg

SEQ ID NO: 13877 - DNA, 20 bp, human
gaggcggcgacgggacaaga

SEQ ID NO: 13878 - DNA, 20 bp, human
gctgctcgcgcctgctagaa

SEQ ID NO: 13879 - DNA, 20 bp, human
ggcaggcgcgagcagtcgct

SEQ ID NO: 13880 - DNA, 20 bp, human
ggcgctcgggcccttctagc

SEQ ID NO: 13881 - DNA, 20 bp, human
gagcaaatgctgccgagctg

SEQ ID NO: 13882 - DNA, 20 bp, human
gggcgcgcgaaagcgaaaga

SEQ ID NO: 13883 - DNA, 20 bp, human
gtcgcgcccgcgcagaggga

SEQ ID NO: 13884 - DNA, 20 bp, human
gcggcagcatttgctccagg

SEQ ID NO: 13885 - DNA, 20 bp, human
ggccgcgaccggaggatgga

SEQ ID NO: 13886 - DNA, 20 bp, human
ggtgaggcgctgagacggtt

SEQ ID NO: 13887 - DNA, 20 bp, human
gtgggccaggcgcagctgaa

SEQ ID NO: 13888 - DNA, 20 bp, human
ggcggggctaggcccgacag

SEQ ID NO: 13889 - DNA, 20 bp, human
gacctggagttcgcagagac

SEQ ID NO: 13890 - DNA, 20 bp, human
gcggtttggcggtgagtcct

SEQ ID NO: 13891 - DNA, 20 bp, human
gaccccgccgccggaggact

SEQ ID NO: 13892 - DNA, 20 bp, human
ggcagagactggtagcgtga

SEQ ID NO: 13893 - DNA, 20 bp, human
gaccagtctctgcgaactcc

SEQ ID NO: 13894 - DNA, 20 bp, human
ggctgaaaggcccgcaaccc

SEQ ID NO: 13895 - DNA, 20 bp, human
gtcagtgcccagtcctccgg

SEQ ID NO: 13896 - DNA, 20 bp, human
gggccgctcgctctcaggac

SEQ ID NO: 13897 - DNA, 20 bp, human
gccgtaaacagacaacatgg

SEQ ID NO: 13898 - DNA, 20 bp, human
gaggcaggcgcaccgaacct

SEQ ID NO: 13899 - DNA, 20 bp, human
gagctctgagatgaagacgg

SEQ ID NO: 13900 - DNA, 20 bp, human
gacgccgtaaacagacaaca

SEQ ID NO: 13901 - DNA, 20 bp, human
gaggacgcggggtcgaggtc

SEQ ID NO: 13902 - DNA, 20 bp, human
gttacaggtaagctgctcgg

SEQ ID NO: 13903 - DNA, 20 bp, human
ggaggaggagaaccgaggtg

SEQ ID NO: 13904 - DNA, 20 bp, human
gcgaccccgcgtcctgccgg

SEQ ID NO: 13905 - DNA, 20 bp, human
gcgggcgccgccagcatgca

SEQ ID NO: 13906 - DNA, 20 bp, human
ggccgctgaggagacgaagc

SEQ ID NO: 13907 - DNA, 20 bp, human
gcagggactgtggcctccta

SEQ ID NO: 13908 - DNA, 20 bp, human
ggacgaagccggcaggacgc

SEQ ID NO: 13909 - DNA, 20 bp, human
ggcggttctggcgttccctg

SEQ ID NO: 13910 - DNA, 20 bp, human
gtggcgcgagatccgaacgt

SEQ ID NO: 13911 - DNA, 20 bp, human
gctgcgagacgtcctagtag

SEQ ID NO: 13912 - DNA, 20 bp, human
ggcggcgaaggttcaggtgt

SEQ ID NO: 13913 - DNA, 20 bp, human
ggcaggctcccggcgcctca

SEQ ID NO: 13914 - DNA, 20 bp, human
ggtccgcctcatggccgctg

SEQ ID NO: 13915 - DNA, 20 bp, human
gcgaagtcggggacagagaa

SEQ ID NO: 13916 - DNA, 20 bp, human
gccgggcgcgaaaatggcgg

SEQ ID NO: 13917 - DNA, 20 bp, human
gcccaagagcccctgcggcc

SEQ ID NO: 13918 - DNA, 20 bp, human
gcgaggaggcagaacccgac

SEQ ID NO: 13919 - DNA, 20 bp, human
ggagcagcagcacgagcagt

SEQ ID NO: 13920 - DNA, 20 bp, human
gggtccgcactacgaatctg

SEQ ID NO: 13921 - DNA, 20 bp, human
gcagtcacccggaagcctgg

SEQ ID NO: 13922 - DNA, 20 bp, human
ggaccatgtgtgcggtgcta

SEQ ID NO: 13923 - DNA, 20 bp, human
gtggcccggcaggaggactc

SEQ ID NO: 13924 - DNA, 20 bp, human
gggcgagaggcgaagtggtc

SEQ ID NO: 13925 - DNA, 20 bp, human
gactacgaatctggggacac

SEQ ID NO: 13926 - DNA, 20 bp, human
gaccgtgggggatatctcag

SEQ ID NO: 13927 - DNA, 20 bp, human
gccacggtctacccacccgt

SEQ ID NO: 13928 - DNA, 20 bp, human
gcaggtgggagccgacgggt

SEQ ID NO: 13929 - DNA, 20 bp, human
gtaacaagcagtatcctaca

SEQ ID NO: 13930 - DNA, 20 bp, human
gccaggacaagggccttctt

SEQ ID NO: 13931 - DNA, 20 bp, human
gtgcccaggagcggatgcaa

SEQ ID NO: 13932 - DNA, 20 bp, human
gtacggagaacttgcagctg

SEQ ID NO: 13933 - DNA, 20 bp, human
gcgccaaggacactcaggga

SEQ ID NO: 13934 - DNA, 20 bp, human
ggccactgagatatccccca

SEQ ID NO: 13935 - DNA, 20 bp, human
ggagacagacggtaagcgta

SEQ ID NO: 13936 - DNA, 20 bp, human
gcccaagcccgacctcgacg

SEQ ID NO: 13937 - DNA, 20 bp, human
ggaccggaagtgcccgaggg

SEQ ID NO: 13938 - DNA, 20 bp, human
ggctgccgcctgacctgaac

SEQ ID NO: 13939 - DNA, 20 bp, human
gtcgaggtcgggcttgggaa

SEQ ID NO: 13940 - DNA, 20 bp, human
gagtgcccgttcaggtcagg

SEQ ID NO: 13941 - DNA, 20 bp, human
gaagtgcgggctcaagacta

SEQ ID NO: 13942 - DNA, 20 bp, human
gtttgagccgcgtcgaggtc

SEQ ID NO: 13943 - DNA, 20 bp, human
ggcccgcccgcgactactga

SEQ ID NO: 13944 - DNA, 20 bp, human
ggcccacagaccatgctcct

SEQ ID NO: 13945 - DNA, 20 bp, human
gaccgaaaggtcccagaacg

SEQ ID NO: 13946 - DNA, 20 bp, human
gtagcagtgccttggacccc

SEQ ID NO: 13947 - DNA, 20 bp, human
ggtagggacgatagcagggc

SEQ ID NO: 13948 - DNA, 20 bp, human
gctacggccgacagacggta

SEQ ID NO: 13949 - DNA, 20 bp, human
ggcgcaaggcctgcgacagg

SEQ ID NO: 13950 - DNA, 20 bp, human
gctgtcggccgtagggccag

SEQ ID NO: 13951 - DNA, 20 bp, human
gcgggagagtagcagtgcct

SEQ ID NO: 13952 - DNA, 20 bp, human
gatgggggcgcagggacgga

SEQ ID NO: 13953 - DNA, 20 bp, human
gggccatccttagagagaaa

SEQ ID NO: 13954 - DNA, 20 bp, human
gcgggagtgggcagatgatc

SEQ ID NO: 13955 - DNA, 20 bp, human
ggacaggaggccagctcacc

SEQ ID NO: 13956 - DNA, 20 bp, human
gagtaaggtaaggtagggag

SEQ ID NO: 13957 - DNA, 20 bp, human
gtagcagtgagacatcagtg

SEQ ID NO: 13958 - DNA, 20 bp, human
gacacaggcttcgggatccg

SEQ ID NO: 13959 - DNA, 20 bp, human
gaagaagaaagagtaaggta

SEQ ID NO: 13960 - DNA, 20 bp, human
gaaagaaggccgcgcagcca

SEQ ID NO: 13961 - DNA, 20 bp, human
ggagaggtgaaagaaagaat

SEQ ID NO: 13962 - DNA, 20 bp, human
gacggctgctcacgacgccg

SEQ ID NO: 13963 - DNA, 20 bp, human
gaacgggaacagccatccag

SEQ ID NO: 13964 - DNA, 20 bp, human
gtggtgccgggtataaaaga

SEQ ID NO: 13965 - DNA, 20 bp, human
gcggcaccaaccgctcagag

SEQ ID NO: 13966 - DNA, 20 bp, human
gtgcacggcgtgtccccggg

SEQ ID NO: 13967 - DNA, 20 bp, human
gtgctgctggagcagttgtg

SEQ ID NO: 13968 - DNA, 20 bp, human
gggacacgccgtgcaccctc

SEQ ID NO: 13969 - DNA, 20 bp, human
gtctccagcgggagagacac

SEQ ID NO: 13970 - DNA, 20 bp, human
ggagagggcgaaactgcgag

SEQ ID NO: 13971 - DNA, 20 bp, human
ggagaaagccccgagccgga

SEQ ID NO: 13972 - DNA, 20 bp, human
ggggtgcacggcgtgtcccc

SEQ ID NO: 13973 - DNA, 20 bp, human
gagggcgaaactgcgagcgg

SEQ ID NO: 13974 - DNA, 20 bp, human
ggtgagtcagtcagtcgatg

SEQ ID NO: 13975 - DNA, 20 bp, human
gcgccgagaaagccccgagc

SEQ ID NO: 13976 - DNA, 20 bp, human
gggctccgggccgctcgctg

SEQ ID NO: 13977 - DNA, 20 bp, human
gcccgcttccggtggggcca

SEQ ID NO: 13978 - DNA, 20 bp, human
gtaagaggcgacggctggtg

SEQ ID NO: 13979 - DNA, 20 bp, human
gctgggaccgcgtgtaactg

SEQ ID NO: 13980 - DNA, 20 bp, human
gaggagctcggggaggccgt

SEQ ID NO: 13981 - DNA, 20 bp, human
gggctggcgcgagacagtgg

SEQ ID NO: 13982 - DNA, 20 bp, human
gcagcggcggtagccagagg

SEQ ID NO: 13983 - DNA, 20 bp, human
ggcgcgcgggagccgagctg

SEQ ID NO: 13984 - DNA, 20 bp, human
ggcgcgccggtaagaggcga

SEQ ID NO: 13985 - DNA, 20 bp, human
ggggccagcgcgccggtaag

SEQ ID NO: 13986 - DNA, 20 bp, human
gtgcggccattactaagcta

SEQ ID NO: 13987 - DNA, 20 bp, human
gacgcgccgggaaactggga

SEQ ID NO: 13988 - DNA, 20 bp, human
gagaggcagctgaacatata

SEQ ID NO: 13989 - DNA, 20 bp, human
gtgagcgagaaggcaaggta

SEQ ID NO: 13990 - DNA, 20 bp, human
gtaatggccgcagagatact

SEQ ID NO: 13991 - DNA, 20 bp, human
gtcacaagttacaaactcct

SEQ ID NO: 13992 - DNA, 20 bp, human
gctctagggataggtgaaag

SEQ ID NO: 13993 - DNA, 20 bp, human
ggttcagaagaaccccttag

SEQ ID NO: 13994 - DNA, 20 bp, human
ggcttacgcgccgggaaact

SEQ ID NO: 13995 - DNA, 20 bp, human
gtgctgccttagcttagtaa

SEQ ID NO: 13996 - DNA, 20 bp, human
gggccgcacagggagatcgg

SEQ ID NO: 13997 - DNA, 20 bp, human
gcgcacagggagatcggtgg

SEQ ID NO: 13998 - DNA, 20 bp, human
gtccgggctgtcacctgaca

SEQ ID NO: 13999 - DNA, 20 bp, human
gaagctgcggaagcggatga

SEQ ID NO: 14000 - DNA, 20 bp, human
gcagcgagcacagcacatga

SEQ ID NO: 14001 - DNA, 20 bp, human
ggggctgtcacctgacacgg

SEQ ID NO: 14002 - DNA, 20 bp, human
gggagctggttgatacgtgt

SEQ ID NO: 14003 - DNA, 20 bp, human
ggaagggtcgcaggcgctgt

SEQ ID NO: 14004 - DNA, 20 bp, human
gcgacgacttcgaccgccaa

SEQ ID NO: 14005 - DNA, 20 bp, human
ggagggccgcacagggagat

SEQ ID NO: 14006 - DNA, 20 bp, human
gcgggcagtgctgacaccct

SEQ ID NO: 14007 - DNA, 20 bp, human
gccagatgcaagaacgccat

SEQ ID NO: 14008 - DNA, 20 bp, human
ggggctggatagggagaacg

SEQ ID NO: 14009 - DNA, 20 bp, human
ggccccaagcccagtcaccg

SEQ ID NO: 14010 - DNA, 20 bp, human
ggtgctgacaccctgggtca

SEQ ID NO: 14011 - DNA, 20 bp, human
gagtaggccgaggaagcagg

SEQ ID NO: 14012 - DNA, 20 bp, human
gcccactgtgggccatctca

SEQ ID NO: 14013 - DNA, 20 bp, human
gcgtatgcagcactgcttgg

SEQ ID NO: 14014 - DNA, 20 bp, human
gcactgtcgccatccagaca

SEQ ID NO: 14015 - DNA, 20 bp, human
gcagttctggaagtagcacg

SEQ ID NO: 14016 - DNA, 20 bp, human
gccgaggattggctgttccg

SEQ ID NO: 14017 - DNA, 20 bp, human
gagggccagtcggtgatcac

SEQ ID NO: 14018 - DNA, 20 bp, human
gcctggctagggccgaggat

SEQ ID NO: 14019 - DNA, 20 bp, human
ggggagctcatacctggcta

SEQ ID NO: 14020 - DNA, 20 bp, human
ggccacttgggtcacagccg

SEQ ID NO: 14021 - DNA, 20 bp, human
gagaaagcgctccctagccc

SEQ ID NO: 14022 - DNA, 20 bp, human
gctccgacagacctcaaatg

SEQ ID NO: 14023 - DNA, 20 bp, human
gaccgcggctgtgacccaag

SEQ ID NO: 14024 - DNA, 20 bp, human
gaaactggtccgggccactt

SEQ ID NO: 14025 - DNA, 20 bp, human
ggccgcttcgcagaacgacg

SEQ ID NO: 14026 - DNA, 20 bp, human
gcagcagtcttccggcaata

SEQ ID NO: 14027 - DNA, 20 bp, human
gaggccgaagccctcgggga

SEQ ID NO: 14028 - DNA, 20 bp, human
gcagtcttccggcaataggg

SEQ ID NO: 14029 - DNA, 20 bp, human
gccgagcttccggaagcact

SEQ ID NO: 14030 - DNA, 20 bp, human
ggctctgcgatccctccagt

SEQ ID NO: 14031 - DNA, 20 bp, human
gttccggcaatagggcggga

SEQ ID NO: 14032 - DNA, 20 bp, human
ggagggcaacggcccaccga

SEQ ID NO: 14033 - DNA, 20 bp, human
gccgggagacgcccactgga

SEQ ID NO: 14034 - DNA, 20 bp, human
ggctccgaagagggccgagt

SEQ ID NO: 14035 - DNA, 20 bp, human
gtgctccgggagacgcccac

SEQ ID NO: 14036 - DNA, 20 bp, human
ggcagtcggtgtcgcgctca

SEQ ID NO: 14037 - DNA, 20 bp, human
ggagcgagcgggcttggctg

SEQ ID NO: 14038 - DNA, 20 bp, human
gtcggtgtcgcgctcagggc

SEQ ID NO: 14039 - DNA, 20 bp, human
gatcaggacgggaagaatgg

SEQ ID NO: 14040 - DNA, 20 bp, human
ggctcaccaggcagagcgag

SEQ ID NO: 14041 - DNA, 20 bp, human
gggtgtggatgcaagtggag

SEQ ID NO: 14042 - DNA, 20 bp, human
gtgcttggaggcgcggtccg

SEQ ID NO: 14043 - DNA, 20 bp, human
gcgcctccaagcaggctgaa

SEQ ID NO: 14044 - DNA, 20 bp, human
gagcccttcagcctgcttgg

SEQ ID NO: 14045 - DNA, 20 bp, human
gtaaaatggagtggcagggg

SEQ ID NO: 14046 - DNA, 20 bp, human
ggcccaccggactcatggag

SEQ ID NO: 14047 - DNA, 20 bp, human
gagggcctggaggtgatgtg

SEQ ID NO: 14048 - DNA, 20 bp, human
gcagctgggcggtggcgtga

SEQ ID NO: 14049 - DNA, 20 bp, human
gtgagtccggtgggcagagt

SEQ ID NO: 14050 - DNA, 20 bp, human
gtggcagtatggccagtcct

SEQ ID NO: 14051 - DNA, 20 bp, human
ggagagaggccaccatccga

SEQ ID NO: 14052 - DNA, 20 bp, human
ggcccctccatgagtccggt

SEQ ID NO: 14053 - DNA, 20 bp, human
gacagaacccaggatccccc

SEQ ID NO: 14054 - DNA, 20 bp, human
gtggcccagggtctctggac

SEQ ID NO: 14055 - DNA, 20 bp, human
gcaagccttaccggaagtgg

SEQ ID NO: 14056 - DNA, 20 bp, human
ggaagccagggccagatcta

SEQ ID NO: 14057 - DNA, 20 bp, human
gtcataagggagcattccct

SEQ ID NO: 14058 - DNA, 20 bp, human
gctattaagtgaacttccag

SEQ ID NO: 14059 - DNA, 20 bp, human
gatgattctcgggagcctga

SEQ ID NO: 14060 - DNA, 20 bp, human
gatcatggggaataggacag

SEQ ID NO: 14061 - DNA, 20 bp, human
gtcagactctggaagtgact

SEQ ID NO: 14062 - DNA, 20 bp, human
gagaacagtgttccaaccaa

SEQ ID NO: 14063 - DNA, 20 bp, human
gctattccccatgatcataa

SEQ ID NO: 14064 - DNA, 20 bp, human
gacaatcttagatgatggaa

SEQ ID NO: 14065 - DNA, 20 bp, human
gcatggaactcaagactcct

SEQ ID NO: 14066 - DNA, 20 bp, human
gctggagccactgggacgct

SEQ ID NO: 14067 - DNA, 20 bp, human
gtcttgaggtccttcttaga

SEQ ID NO: 14068 - DNA, 20 bp, human
ggtgcttacctggagccact

SEQ ID NO: 14069 - DNA, 20 bp, human
ggccaggtgggtcaggccag

SEQ ID NO: 14070 - DNA, 20 bp, human
gatgaggagcagttccactg

SEQ ID NO: 14071 - DNA, 20 bp, human
gccccaatgtagaccgagaa

SEQ ID NO: 14072 - DNA, 20 bp, human
gagggttgcaggatgttcaa

SEQ ID NO: 14073 - DNA, 20 bp, human
gtgcaggtgtgagcccttct

SEQ ID NO: 14074 - DNA, 20 bp, human
gactcctgagcaatcagggc

SEQ ID NO: 14075 - DNA, 20 bp, human
gtgcccagccctgattgctc

SEQ ID NO: 14076 - DNA, 20 bp, human
ggctgcctgtggggaaggta

SEQ ID NO: 14077 - DNA, 20 bp, human
gagcgagtgtcccccaccag

SEQ ID NO: 14078 - DNA, 20 bp, human
gccctcgagctaacccccac

SEQ ID NO: 14079 - DNA, 20 bp, human
ggggaccataccttccccac

SEQ ID NO: 14080 - DNA, 20 bp, human
gaaattactaaagagatagg

SEQ ID NO: 14081 - DNA, 20 bp, human
ggcgcgagagcgctgcctgt

SEQ ID NO: 14082 - DNA, 20 bp, human
gccgacctgacggtccacta

SEQ ID NO: 14083 - DNA, 20 bp, human
gacactcgctgcaggcggct

SEQ ID NO: 14084 - DNA, 20 bp, human
gcagtgcgcaggcgccggtg

SEQ ID NO: 14085 - DNA, 20 bp, human
gaccgccggcacccctggtg

SEQ ID NO: 14086 - DNA, 20 bp, human
gtgacgcgcgtgggaccgag

SEQ ID NO: 14087 - DNA, 20 bp, human
gctggctcgggaggcgatcg

SEQ ID NO: 14088 - DNA, 20 bp, human
gctccggccggctctggcgg

SEQ ID NO: 14089 - DNA, 20 bp, human
gcgactccggccggctctgg

SEQ ID NO: 14090 - DNA, 20 bp, human
gtccgggcccatgcgctcag

SEQ ID NO: 14091 - DNA, 20 bp, human
ggctccgggccgactccggc

SEQ ID NO: 14092 - DNA, 20 bp, human
gctggggccggggtgtccct

SEQ ID NO: 14093 - DNA, 20 bp, human
gcgcggctccgggccgactc

SEQ ID NO: 14094 - DNA, 20 bp, human
gcgcgtgggaccgagggggt

SEQ ID NO: 14095 - DNA, 20 bp, human
gccccgcgcgcccaccccct

SEQ ID NO: 14096 - DNA, 20 bp, human
gggagggacgcgagggacac

SEQ ID NO: 14097 - DNA, 20 bp, human
gcaggaccggcccaagtccg

SEQ ID NO: 14098 - DNA, 20 bp, human
gccgggtagcgcggtgccaa

SEQ ID NO: 14099 - DNA, 20 bp, human
ggcgcggcccacggagaagt

SEQ ID NO: 14100 - DNA, 20 bp, human
gacacgggcgccccggactt

SEQ ID NO: 14101 - DNA, 20 bp, human
ggcggctcgaggctctggtc

SEQ ID NO: 14102 - DNA, 20 bp, human
gggagaagtggggctgccgt

SEQ ID NO: 14103 - DNA, 20 bp, human
gctcagtctgcgcgcaggac

SEQ ID NO: 14104 - DNA, 20 bp, human
gcccgttacctggaagacga

SEQ ID NO: 14105 - DNA, 20 bp, human
ggcgctgctggcgtgtcccg

SEQ ID NO: 14106 - DNA, 20 bp, human
gagccggctgcgctttgata

SEQ ID NO: 14107 - DNA, 20 bp, human
gcgaaatccatcgctctgag

SEQ ID NO: 14108 - DNA, 20 bp, human
gctgcgctttgataaggtcc

SEQ ID NO: 14109 - DNA, 20 bp, human
ggcgcacggtcctgaaaggg

SEQ ID NO: 14110 - DNA, 20 bp, human
gcagtaacagcccgagagcc

SEQ ID NO: 14111 - DNA, 20 bp, human
gcgagcgcacggtcctgaaa

SEQ ID NO: 14112 - DNA, 20 bp, human
gggcgcaccaaatgtcctcc

SEQ ID NO: 14113 - DNA, 20 bp, human
gctcgccccctgtaagaggg

SEQ ID NO: 14114 - DNA, 20 bp, human
ggaagcgcccggaggacatt

SEQ ID NO: 14115 - DNA, 20 bp, human
ggccctgctgtaaaaggtgg

SEQ ID NO: 14116 - DNA, 20 bp, human
gctgcctggcacagcggcag

SEQ ID NO: 14117 - DNA, 20 bp, human
ggactgagagaggaactgaa

SEQ ID NO: 14118 - DNA, 20 bp, human
gtgctgagaaggcggctgct

SEQ ID NO: 14119 - DNA, 20 bp, human
gcgtggcggtgccccaggat

SEQ ID NO: 14120 - DNA, 20 bp, human
ggcaggcagtgccaaatccg

SEQ ID NO: 14121 - DNA, 20 bp, human
gcaggggaggcccttgccac

SEQ ID NO: 14122 - DNA, 20 bp, human
ggaaagggttgcccaagtct

SEQ ID NO: 14123 - DNA, 20 bp, human
ggaaaagggacttcaaggga

SEQ ID NO: 14124 - DNA, 20 bp, human
gggagccaggggcggagaaa

SEQ ID NO: 14125 - DNA, 20 bp, human
gccacagaaaagggacttca

SEQ ID NO: 14126 - DNA, 20 bp, human
gtagacagtcaggacggagt

SEQ ID NO: 14127 - DNA, 20 bp, human
gttggggtagacagtcagga

SEQ ID NO: 14128 - DNA, 20 bp, human
gggagtaggaaccatatgcc

SEQ ID NO: 14129 - DNA, 20 bp, human
gcctggcatacggcaggaat

SEQ ID NO: 14130 - DNA, 20 bp, human
gttatttcgggccagcgcag

SEQ ID NO: 14131 - DNA, 20 bp, human
gctgactgtctaccccaagc

SEQ ID NO: 14132 - DNA, 20 bp, human
gggaaagtgggaaggcaggt

SEQ ID NO: 14133 - DNA, 20 bp, human
gattcagggagcctctgcgc

SEQ ID NO: 14134 - DNA, 20 bp, human
gggatgcagctgggataccc

SEQ ID NO: 14135 - DNA, 20 bp, human
gagaagcagctccaggcata

SEQ ID NO: 14136 - DNA, 20 bp, human
gcggccggggtgagcagcgg

SEQ ID NO: 14137 - DNA, 20 bp, human
gggcccgcgcaggtgaagac

SEQ ID NO: 14138 - DNA, 20 bp, human
gaggcccggtgacaatgaag

SEQ ID NO: 14139 - DNA, 20 bp, human
gtcattgtcaccgggcctcg

SEQ ID NO: 14140 - DNA, 20 bp, human
gtcgcgcccaaacctcgggt

SEQ ID NO: 14141 - DNA, 20 bp, human
gtccagggtgcgcacaggtg

SEQ ID NO: 14142 - DNA, 20 bp, human
gtgacaatgaagcggccgga

SEQ ID NO: 14143 - DNA, 20 bp, human
gcacaggtgagggaggtccg

SEQ ID NO: 14144 - DNA, 20 bp, human
ggctgctcaccccggccgtc

SEQ ID NO: 14145 - DNA, 20 bp, human
gccggtgacaatgaagcggc

SEQ ID NO: 14146 - DNA, 20 bp, human
gccagaagccaggctacgta

SEQ ID NO: 14147 - DNA, 20 bp, human
gtgagtgactcgccagggac

SEQ ID NO: 14148 - DNA, 20 bp, human
gtagggagcggcccactcct

SEQ ID NO: 14149 - DNA, 20 bp, human
ggcgccgagcccgcggacag

SEQ ID NO: 14150 - DNA, 20 bp, human
gtgggccgctccctagtcaa

SEQ ID NO: 14151 - DNA, 20 bp, human
gggagggaggggaagcactc

SEQ ID NO: 14152 - DNA, 20 bp, human
ggaaagggatgcccaggagt

SEQ ID NO: 14153 - DNA, 20 bp, human
gctacgtagggccgccccca

SEQ ID NO: 14154 - DNA, 20 bp, human
gggaccggcaacagctacgg

SEQ ID NO: 14155 - DNA, 20 bp, human
gagctgctccgggcacgtcg

SEQ ID NO: 14156 - DNA, 20 bp, human
gaccctgtgcggcctagagt

SEQ ID NO: 14157 - DNA, 20 bp, human
gggcgacggcagaagaaaaa

SEQ ID NO: 14158 - DNA, 20 bp, human
gccggccgcctcgaacatgg

SEQ ID NO: 14159 - DNA, 20 bp, human
gtgcggggacgtcttaaggg

SEQ ID NO: 14160 - DNA, 20 bp, human
ggccgccgccatgttcgagg

SEQ ID NO: 14161 - DNA, 20 bp, human
gcggccggccgcctcgaaca

SEQ ID NO: 14162 - DNA, 20 bp, human
gcgctgcggggacgtcttaa

SEQ ID NO: 14163 - DNA, 20 bp, human
gcactttcaggctctgatcg

SEQ ID NO: 14164 - DNA, 20 bp, human
gtgctgcacacagctggtgt

SEQ ID NO: 14165 - DNA, 20 bp, human
gtaggctgcgggaacgactt

SEQ ID NO: 14166 - DNA, 20 bp, human
gggcacagagaggcactcac

SEQ ID NO: 14167 - DNA, 20 bp, human
gagcacagatgggggaccac

SEQ ID NO: 14168 - DNA, 20 bp, human
gggtctgctggcgtcctcga

SEQ ID NO: 14169 - DNA, 20 bp, human
ggccaacgatgtccaaaagg

SEQ ID NO: 14170 - DNA, 20 bp, human
ggacctgccccgccatgacc

SEQ ID NO: 14171 - DNA, 20 bp, human
gtggcctccattcagaatca

SEQ ID NO: 14172 - DNA, 20 bp, human
gaggcactcaccggccctcg

SEQ ID NO: 14173 - DNA, 20 bp, human
gtgtcagccgggtcatggcg

SEQ ID NO: 14174 - DNA, 20 bp, human
ggacggtgtgcgggactcag

SEQ ID NO: 14175 - DNA, 20 bp, human
gcactccctaagaggacagg

SEQ ID NO: 14176 - DNA, 20 bp, human
gccctgtcctggccaaacgt

SEQ ID NO: 14177 - DNA, 20 bp, human
gtgggcctcagctctcccgt

SEQ ID NO: 14178 - DNA, 20 bp, human
gtcccggcagaggggaaatg

SEQ ID NO: 14179 - DNA, 20 bp, human
ggagagctgaggcccacgtt

SEQ ID NO: 14180 - DNA, 20 bp, human
gctgaggtcatgcgactggg

SEQ ID NO: 14181 - DNA, 20 bp, human
ggatggacaggtaggatccg

SEQ ID NO: 14182 - DNA, 20 bp, human
ggacaggtaggatccggggt

SEQ ID NO: 14183 - DNA, 20 bp, human
ggcctccatccaccctgtcc

SEQ ID NO: 14184 - DNA, 20 bp, human
ggcagggaagatggacaggt

SEQ ID NO: 14185 - DNA, 20 bp, human
gggagagctggcttggacgg

SEQ ID NO: 14186 - DNA, 20 bp, human
ggcgagcacagctaaggcca

SEQ ID NO: 14187 - DNA, 20 bp, human
gagtagcgcgagcacagcta

SEQ ID NO: 14188 - DNA, 20 bp, human
ggccacggagcgagacatct

SEQ ID NO: 14189 - DNA, 20 bp, human
gcagaggccccgcgaaagag

SEQ ID NO: 14190 - DNA, 20 bp, human
gccgccgtggggctagtcca

SEQ ID NO: 14191 - DNA, 20 bp, human
ggctggagtgggggacgggt

SEQ ID NO: 14192 - DNA, 20 bp, human
ggtcagagcgccgaggttgg

SEQ ID NO: 14193 - DNA, 20 bp, human
gctacggcgacgggagggtc

SEQ ID NO: 14194 - DNA, 20 bp, human
ggataagcgtcagagcgccg

SEQ ID NO: 14195 - DNA, 20 bp, human
gcccccagcgcagctggagt

SEQ ID NO: 14196 - DNA, 20 bp, human
gcaaagtcacatggttcaca

SEQ ID NO: 14197 - DNA, 20 bp, human
gaagctgccacaaaagctag

SEQ ID NO: 14198 - DNA, 20 bp, human
ggaacatctcaagaaggtat

SEQ ID NO: 14199 - DNA, 20 bp, human
gtaccccacttaactatctt

SEQ ID NO: 14200 - DNA, 20 bp, human
ggtcacatggttcacacggc

SEQ ID NO: 14201 - DNA, 20 bp, human
ggggctgtgacaaagtcaca

SEQ ID NO: 14202 - DNA, 20 bp, human
gatgggatgggactcattca

SEQ ID NO: 14203 - DNA, 20 bp, human
gcagcaggacttacaaacaa

SEQ ID NO: 14204 - DNA, 20 bp, human
ggcatactcatctttttcag

SEQ ID NO: 14205 - DNA, 20 bp, human
gtggagaagtccaggattat

SEQ ID NO: 14206 - DNA, 20 bp, human
gaggcaggtattgcaccctg

SEQ ID NO: 14207 - DNA, 20 bp, human
gagacccgagacccacggtg

SEQ ID NO: 14208 - DNA, 20 bp, human
gaggcaaggtggacaaccag

SEQ ID NO: 14209 - DNA, 20 bp, human
gacggtggctggagcggcac

SEQ ID NO: 14210 - DNA, 20 bp, human
ggatttgacggtggctggag

SEQ ID NO: 14211 - DNA, 20 bp, human
gtccgctctagaggagtggg

SEQ ID NO: 14212 - DNA, 20 bp, human
gggtggacaaccagcggatg

SEQ ID NO: 14213 - DNA, 20 bp, human
gctcggaaacgcctagaccc

SEQ ID NO: 14214 - DNA, 20 bp, human
gcttctcccgcgctcaccgg

SEQ ID NO: 14215 - DNA, 20 bp, human
gcggtgccgaggaagaggac

SEQ ID NO: 14216 - DNA, 20 bp, human
gccgcggtctgagggaccgg

SEQ ID NO: 14217 - DNA, 20 bp, human
gcgcggccccgagcacacac

SEQ ID NO: 14218 - DNA, 20 bp, human
ggcgctcggcgacgtctgga

SEQ ID NO: 14219 - DNA, 20 bp, human
gtgcaagtgcggagactgag

SEQ ID NO: 14220 - DNA, 20 bp, human
gcctcgcgctcggcgacgtc

SEQ ID NO: 14221 - DNA, 20 bp, human
gcgggaattgttggaggcgg

SEQ ID NO: 14222 - DNA, 20 bp, human
gcttcgccgggaattgttgg

SEQ ID NO: 14223 - DNA, 20 bp, human
gaattcccggcgaagccccg

SEQ ID NO: 14224 - DNA, 20 bp, human
ggggcttcgccgggaattgt

SEQ ID NO: 14225 - DNA, 20 bp, human
gggtccccagacgaaacaaa

SEQ ID NO: 14226 - DNA, 20 bp, human
ggattgtccatgggcctcag

SEQ ID NO: 14227 - DNA, 20 bp, human
gtgaggtggagattgtccat

SEQ ID NO: 14228 - DNA, 20 bp, human
ggcaatcagagagacgtggg

SEQ ID NO: 14229 - DNA, 20 bp, human
ggaaagtagaatgagcgcag

SEQ ID NO: 14230 - DNA, 20 bp, human
gaggtgacagacagccactg

SEQ ID NO: 14231 - DNA, 20 bp, human
gttgatagagaagcgtgagg

SEQ ID NO: 14232 - DNA, 20 bp, human
gagtttgatagagaagcgtg

SEQ ID NO: 14233 - DNA, 20 bp, human
gtcaggcaatcagagagacg

SEQ ID NO: 14234 - DNA, 20 bp, human
gttcttgcccaggaggaaca

SEQ ID NO: 14235 - DNA, 20 bp, human
gggatgagaacaactttaag

SEQ ID NO: 14236 - DNA, 20 bp, human
gtgcagcagctgaggaaccg

SEQ ID NO: 14237 - DNA, 20 bp, human
gggacccatatgaacaagga

SEQ ID NO: 14238 - DNA, 20 bp, human
gcaggcagcagtttaaatgt

SEQ ID NO: 14239 - DNA, 20 bp, human
ggtctataatatgaaatcca

SEQ ID NO: 14240 - DNA, 20 bp, human
gactaggacccatatgaaca

SEQ ID NO: 14241 - DNA, 20 bp, human
gagcagacagatggacactt

SEQ ID NO: 14242 - DNA, 20 bp, human
gtgtgaaaagcaatcgcagg

SEQ ID NO: 14243 - DNA, 20 bp, human
gcgcaggaggcagactgttg

SEQ ID NO: 14244 - DNA, 20 bp, human
gtactgtgaaaagcaatcgc

SEQ ID NO: 14245 - DNA, 20 bp, human
gttaccctccttgttcatat

SEQ ID NO: 14246 - DNA, 20 bp, human
gatggtgcggcgtactccga

SEQ ID NO: 14247 - DNA, 20 bp, human
ggaccacgcccgggatgcgg

SEQ ID NO: 14248 - DNA, 20 bp, human
ggatccgtaagagcgaaggg

SEQ ID NO: 14249 - DNA, 20 bp, human
ggagcagggaggctagtgag

SEQ ID NO: 14250 - DNA, 20 bp, human
gcggtcgaggcatgctgcgg

SEQ ID NO: 14251 - DNA, 20 bp, human
ggccagcaagctccgctcca

SEQ ID NO: 14252 - DNA, 20 bp, human
gcagctgcggaccgcggtcg

SEQ ID NO: 14253 - DNA, 20 bp, human
gccgcggtcgaggcatgctg

SEQ ID NO: 14254 - DNA, 20 bp, human
gtgccgcagtcggccagcca

SEQ ID NO: 14255 - DNA, 20 bp, human
gctggttggggatcaagagg

SEQ ID NO: 14256 - DNA, 20 bp, human
gcagccagtcaataacggaa

SEQ ID NO: 14257 - DNA, 20 bp, human
gctgaccagccagtcaataa

SEQ ID NO: 14258 - DNA, 20 bp, human
gctggggtggctaggatctg

SEQ ID NO: 14259 - DNA, 20 bp, human
gtccactgaaggaggaggta

SEQ ID NO: 14260 - DNA, 20 bp, human
gcctggagtgcagaatctgc

SEQ ID NO: 14261 - DNA, 20 bp, human
ggtcaggccatacagcctgg

SEQ ID NO: 14262 - DNA, 20 bp, human
gctgctctgccagttgggtt

SEQ ID NO: 14263 - DNA, 20 bp, human
gctgggacagagccatgaac

SEQ ID NO: 14264 - DNA, 20 bp, human
ggccaaacccaaatgacccg

SEQ ID NO: 14265 - DNA, 20 bp, human
ggccagccttccactgaagg

SEQ ID NO: 14266 - DNA, 20 bp, human
gggtaggtaggtaagtcggt

SEQ ID NO: 14267 - DNA, 20 bp, human
gtctatctgggcccagtcaa

SEQ ID NO: 14268 - DNA, 20 bp, human
gcagccagtcaataacggaa

SEQ ID NO: 14269 - DNA, 20 bp, human
ggattaatcaaaagatagat

SEQ ID NO: 14270 - DNA, 20 bp, human
gctgaccagccagtcaataa

SEQ ID NO: 14271 - DNA, 20 bp, human
ggagattggctgtgagtcag

SEQ ID NO: 14272 - DNA, 20 bp, human
ggtcaggccatacagcctgg

SEQ ID NO: 14273 - DNA, 20 bp, human
gttggctagcgtgattacgg

SEQ ID NO: 14274 - DNA, 20 bp, human
gcaggcaccatccattgact

SEQ ID NO: 14275 - DNA, 20 bp, human
gcgctgggatgccaggagtg

SEQ ID NO: 14276 - DNA, 20 bp, human
gtagccaccatcacaaccag

SEQ ID NO: 14277 - DNA, 20 bp, human
gaccttcagcctgaagaccc

SEQ ID NO: 14278 - DNA, 20 bp, human
gggaaagccgctggttgtga

SEQ ID NO: 14279 - DNA, 20 bp, human
gtcagcctgaagacccggga

SEQ ID NO: 14280 - DNA, 20 bp, human
gaagccgctggttgtgatgg

SEQ ID NO: 14281 - DNA, 20 bp, human
gaatgaagcgggatttaaag

SEQ ID NO: 14282 - DNA, 20 bp, human
gctgggtacaggaaagccgc

SEQ ID NO: 14283 - DNA, 20 bp, human
gcattagttgctggcttagt

SEQ ID NO: 14284 - DNA, 20 bp, human
gtctgtgttcaactgggtac

SEQ ID NO: 14285 - DNA, 20 bp, human
gaagtggcttctcgttcatg

SEQ ID NO: 14286 - DNA, 20 bp, human
ggctgctgcggcgggcgtgg

SEQ ID NO: 14287 - DNA, 20 bp, human
ggacgcctacgaaaacctca

SEQ ID NO: 14288 - DNA, 20 bp, human
gttggccgtgaggttttcgt

SEQ ID NO: 14289 - DNA, 20 bp, human
gaccagcactgccaggaagg

SEQ ID NO: 14290 - DNA, 20 bp, human
ggcactcgcgagtccggcct

SEQ ID NO: 14291 - DNA, 20 bp, human
ggccatgaagctgctgcggc

SEQ ID NO: 14292 - DNA, 20 bp, human
ggcctgcgcactcgcgagtc

SEQ ID NO: 14293 - DNA, 20 bp, human
ggcgggagcaggcgcggcac

SEQ ID NO: 14294 - DNA, 20 bp, human
gggggccccgggcgacgtgt

SEQ ID NO: 14295 - DNA, 20 bp, human
gcgtaggcgtcgcgcagcgc

SEQ ID NO: 14296 - DNA, 20 bp, human
gggcagagaagggtcagccg

SEQ ID NO: 14297 - DNA, 20 bp, human
ggtcgcccgccggttcgggg

SEQ ID NO: 14298 - DNA, 20 bp, human
ggaggggagccggcagagaa

SEQ ID NO: 14299 - DNA, 20 bp, human
ggctgggagacgcgagtctg

SEQ ID NO: 14300 - DNA, 20 bp, human
gcggggacccaagaccgaaa

SEQ ID NO: 14301 - DNA, 20 bp, human
ggccgcccgctacttaccca

SEQ ID NO: 14302 - DNA, 20 bp, human
gtcctgcgcgcttcctgtgg

SEQ ID NO: 14303 - DNA, 20 bp, human
gccacctgggcgccgcgaga

SEQ ID NO: 14304 - DNA, 20 bp, human
gggcggccgcatcctggcgg

SEQ ID NO: 14305 - DNA, 20 bp, human
gatggcgcggcggagacgga

SEQ ID NO: 14306 - DNA, 20 bp, human
gcggcgcagagtccccgagg

SEQ ID NO: 14307 - DNA, 20 bp, human
gggccggcgcagagtccccg

SEQ ID NO: 14308 - DNA, 20 bp, human
gcgcagagtccccgaggtgg

SEQ ID NO: 14309 - DNA, 20 bp, human
gtgacctgcggcgacgagtc

SEQ ID NO: 14310 - DNA, 20 bp, human
gagagtccccgaggtggcgg

SEQ ID NO: 14311 - DNA, 20 bp, human
gcgcatccgccgccacctcg

SEQ ID NO: 14312 - DNA, 20 bp, human
gtgcccgcgatggaccgcac

SEQ ID NO: 14313 - DNA, 20 bp, human
ggacgagtccggagcgtctc

SEQ ID NO: 14314 - DNA, 20 bp, human
ggaccgcaccggagacgctc

SEQ ID NO: 14315 - DNA, 20 bp, human
gcggagcccgacagtccccg

SEQ ID NO: 14316 - DNA, 20 bp, human
gcttgctgctggatccggag

SEQ ID NO: 14317 - DNA, 20 bp, human
ggcgcaagctagagcgacaa

SEQ ID NO: 14318 - DNA, 20 bp, human
gtgagagcaggcttccgctg

SEQ ID NO: 14319 - DNA, 20 bp, human
ggcccaggtagtgagccccg

SEQ ID NO: 14320 - DNA, 20 bp, human
ggcgcctcgccgctccagtc

SEQ ID NO: 14321 - DNA, 20 bp, human
ggccgcggggctcactacct

SEQ ID NO: 14322 - DNA, 20 bp, human
gctgtgttcgcgcgccgcag

SEQ ID NO: 14323 - DNA, 20 bp, human
ggccagctcacctggagtcg

SEQ ID NO: 14324 - DNA, 20 bp, human
gccaccccggcgggaatgtg

SEQ ID NO: 14325 - DNA, 20 bp, human
gggcacaactccgggaccgg

SEQ ID NO: 14326 - DNA, 20 bp, human
gtctggctgcagcagagcga

SEQ ID NO: 14327 - DNA, 20 bp, human
ggagctgtaccagcgcgtag

SEQ ID NO: 14328 - DNA, 20 bp, human
gccgcggtgcgttctataga

SEQ ID NO: 14329 - DNA, 20 bp, human
gggagggccgagcggatgaa

SEQ ID NO: 14330 - DNA, 20 bp, human
gctgtaccagcgcgtagagg

SEQ ID NO: 14331 - DNA, 20 bp, human
gagctgtccggagggccgag

SEQ ID NO: 14332 - DNA, 20 bp, human
gaggccgcagagctgtccgg

SEQ ID NO: 14333 - DNA, 20 bp, human
gcccagggcgggatgcacgg

SEQ ID NO: 14334 - DNA, 20 bp, human
gggggtctgcaggggacgag

SEQ ID NO: 14335 - DNA, 20 bp, human
gccgcccgcgcccgagcagg

SEQ ID NO: 14336 - DNA, 20 bp, human
gggcaggctgcggtaaatcc

SEQ ID NO: 14337 - DNA, 20 bp, human
gcggccacagactacgccag

SEQ ID NO: 14338 - DNA, 20 bp, human
gcggccgctggcgtagtctg

SEQ ID NO: 14339 - DNA, 20 bp, human
ggcgcgcagcaacgaccacc

SEQ ID NO: 14340 - DNA, 20 bp, human
ggcgctccagcagacccgac

SEQ ID NO: 14341 - DNA, 20 bp, human
gggcctgctgaagaccacca

SEQ ID NO: 14342 - DNA, 20 bp, human
ggtggccgcgaacaccgaca

SEQ ID NO: 14343 - DNA, 20 bp, human
gtggtagaaggcgcaccgga

SEQ ID NO: 14344 - DNA, 20 bp, human
ggacatctgcatggctctcg

SEQ ID NO: 14345 - DNA, 20 bp, human
gcggtccgtggaccaggtca

SEQ ID NO: 14346 - DNA, 20 bp, human
gagcctggagtgaggcgcag

SEQ ID NO: 14347 - DNA, 20 bp, human
gatgcggcaggagccaccta

SEQ ID NO: 14348 - DNA, 20 bp, human
gggtaagggaggcttaaatg

SEQ ID NO: 14349 - DNA, 20 bp, human
gcagcggcaacaagtgccgg

SEQ ID NO: 14350 - DNA, 20 bp, human
gggaggaagccgtccctagg

SEQ ID NO: 14351 - DNA, 20 bp, human
gggcggcccggcggtgtcgg

SEQ ID NO: 14352 - DNA, 20 bp, human
ggaaccggcgaggaaccggg

SEQ ID NO: 14353 - DNA, 20 bp, human
gggtggaggaagccgtccct

SEQ ID NO: 14354 - DNA, 20 bp, human
ggcttggctctgctagcctc

SEQ ID NO: 14355 - DNA, 20 bp, human
ggcgggtacgaagccggaac

SEQ ID NO: 14356 - DNA, 20 bp, human
gggtccgccagatcctccgg

SEQ ID NO: 14357 - DNA, 20 bp, human
gaggatctggcggaccccag

SEQ ID NO: 14358 - DNA, 20 bp, human
gcccttggttgggagtatct

SEQ ID NO: 14359 - DNA, 20 bp, human
gtagcagcgggccagaccca

SEQ ID NO: 14360 - DNA, 20 bp, human
gctgcagcaccggaaccgca

SEQ ID NO: 14361 - DNA, 20 bp, human
gagaggcgggactgtcgtct

SEQ ID NO: 14362 - DNA, 20 bp, human
gcttcggctcgcgagctgag

SEQ ID NO: 14363 - DNA, 20 bp, human
ggccggagacaattacggat

SEQ ID NO: 14364 - DNA, 20 bp, human
gggaacgccggagacaatta

SEQ ID NO: 14365 - DNA, 20 bp, human
ggcgggccagacccaaggtg

SEQ ID NO: 14366 - DNA, 20 bp, human
gtcgtgcagcggagccaggg

SEQ ID NO: 14367 - DNA, 20 bp, human
gcaacgcgacagtctccgaa

SEQ ID NO: 14368 - DNA, 20 bp, human
ggggcgtggagctcgtgcag

SEQ ID NO: 14369 - DNA, 20 bp, human
gcaggtgcgcggagctctcg

SEQ ID NO: 14370 - DNA, 20 bp, human
ggcagcagagacccactctg

SEQ ID NO: 14371 - DNA, 20 bp, human
gacagtctccgaagggctga

SEQ ID NO: 14372 - DNA, 20 bp, human
ggagcgtgacgccggggtac

SEQ ID NO: 14373 - DNA, 20 bp, human
gcccggcgtcacgctcaggt

SEQ ID NO: 14374 - DNA, 20 bp, human
ggagctccacgcccgtaccc

SEQ ID NO: 14375 - DNA, 20 bp, human
ggcgggcagggggcgaactc

SEQ ID NO: 14376 - DNA, 20 bp, human
gtcttgggcgaggactggac

SEQ ID NO: 14377 - DNA, 20 bp, human
gctacgcccagggaacgccg

SEQ ID NO: 14378 - DNA, 20 bp, human
gtcccgtgtgggaggaaccg

SEQ ID NO: 14379 - DNA, 20 bp, human
gcggaaccggtgtcccgtgt

SEQ ID NO: 14380 - DNA, 20 bp, human
ggcatcggagctaaagtcgc

SEQ ID NO: 14381 - DNA, 20 bp, human
gcttgcgggctttaaatctt

SEQ ID NO: 14382 - DNA, 20 bp, human
gtacagcccgcatcccgccg

SEQ ID NO: 14383 - DNA, 20 bp, human
gaggaaccgcggcgttccct

SEQ ID NO: 14384 - DNA, 20 bp, human
gctcgcgggccctacgccca

SEQ ID NO: 14385 - DNA, 20 bp, human
gcgccgcggttcctcccaca

SEQ ID NO: 14386 - DNA, 20 bp, human
gtatctcagcatcaaaccag

SEQ ID NO: 14387 - DNA, 20 bp, human
ggggattaaaggctagtctc

SEQ ID NO: 14388 - DNA, 20 bp, human
gtaaaggctagtctcaggct

SEQ ID NO: 14389 - DNA, 20 bp, human
ggtgcagaccccagggctca

SEQ ID NO: 14390 - DNA, 20 bp, human
ggggatagtatggaatgggt

SEQ ID NO: 14391 - DNA, 20 bp, human
gggaataccctgggatagta

SEQ ID NO: 14392 - DNA, 20 bp, human
ggtgccaagcaagaaacagg

SEQ ID NO: 14393 - DNA, 20 bp, human
gccctgggatagtatggaat

SEQ ID NO: 14394 - DNA, 20 bp, human
gggccctaatagctaataaa

SEQ ID NO: 14395 - DNA, 20 bp, human
ggcctgggcttcttcctatt

SEQ ID NO: 14396 - DNA, 20 bp, human
gccagctgccggcaagacct

SEQ ID NO: 14397 - DNA, 20 bp, human
ggcgagcggctcgcagctct

SEQ ID NO: 14398 - DNA, 20 bp, human
ggagagtggcccggacgcag

SEQ ID NO: 14399 - DNA, 20 bp, human
gcggacgcagggggccctca

SEQ ID NO: 14400 - DNA, 20 bp, human
gactcaccacagcgacatgg

SEQ ID NO: 14401 - DNA, 20 bp, human
ggctctgggcgccacggctc

SEQ ID NO: 14402 - DNA, 20 bp, human
gggtcctggagcggtgtcca

SEQ ID NO: 14403 - DNA, 20 bp, human
gggccactctcctcctctcg

SEQ ID NO: 14404 - DNA, 20 bp, human
gcccactcaccacagcgaca

SEQ ID NO: 14405 - DNA, 20 bp, human
gcggtccgaggtcccgcgga

SEQ ID NO: 14406 - DNA, 20 bp, human
ggagcagagagaggagaact

SEQ ID NO: 14407 - DNA, 20 bp, human
ggagagggaagagacggcca

SEQ ID NO: 14408 - DNA, 20 bp, human
gctggtgagacagctgggaa

SEQ ID NO: 14409 - DNA, 20 bp, human
ggcgaggcagggtcccactg

SEQ ID NO: 14410 - DNA, 20 bp, human
gagccacagaaacaagacgg

SEQ ID NO: 14411 - DNA, 20 bp, human
gactggggtgagacaggcga

SEQ ID NO: 14412 - DNA, 20 bp, human
gaggagaactggggtgagac

SEQ ID NO: 14413 - DNA, 20 bp, human
ggacagctgggaagggtgca

SEQ ID NO: 14414 - DNA, 20 bp, human
ggggagtgttagagtgacca

SEQ ID NO: 14415 - DNA, 20 bp, human
gatggggctctggcgtgtta

SEQ ID NO: 14416 - DNA, 20 bp, human
ggctcgggcccggtccatgg

SEQ ID NO: 14417 - DNA, 20 bp, human
gccgactgcgacccttacag

SEQ ID NO: 14418 - DNA, 20 bp, human
ggtcgctggagccccccccg

SEQ ID NO: 14419 - DNA, 20 bp, human
ggcacagctggagggtcacg

SEQ ID NO: 14420 - DNA, 20 bp, human
gccgcgcggagatgaggagg

SEQ ID NO: 14421 - DNA, 20 bp, human
gcccgagccaaatgcagcgt

SEQ ID NO: 14422 - DNA, 20 bp, human
gcgaggggccgccatggacc

SEQ ID NO: 14423 - DNA, 20 bp, human
gacgcaaggggctcaaccgt

SEQ ID NO: 14424 - DNA, 20 bp, human
gaggccgcgcggagatgagg

SEQ ID NO: 14425 - DNA, 20 bp, human
gcgtgtcgcaccgccgggac

SEQ ID NO: 14426 - DNA, 20 bp, human
gccgctggcacctaccacgt

SEQ ID NO: 14427 - DNA, 20 bp, human
gcaggcgccgtaggccgaag

SEQ ID NO: 14428 - DNA, 20 bp, human
gccatgcaggcccacgtggt

SEQ ID NO: 14429 - DNA, 20 bp, human
gctcagggcggagaccccgt

SEQ ID NO: 14430 - DNA, 20 bp, human
ggaccaggtgagggcgaacg

SEQ ID NO: 14431 - DNA, 20 bp, human
gggacccagcctgcacggcg

SEQ ID NO: 14432 - DNA, 20 bp, human
gtcgccctcacctggtcgtg

SEQ ID NO: 14433 - DNA, 20 bp, human
ggttcctccaccccacgacc

SEQ ID NO: 14434 - DNA, 20 bp, human
gccaccccacgaccaggtga

SEQ ID NO: 14435 - DNA, 20 bp, human
ggcgccgtaggccgaagcgg

SEQ ID NO: 14436 - DNA, 20 bp, human
gctgaaagcagaacactggc

SEQ ID NO: 14437 - DNA, 20 bp, human
gctgctttcaggacaagtct

SEQ ID NO: 14438 - DNA, 20 bp, human
ggagtgaagctggaagattc

SEQ ID NO: 14439 - DNA, 20 bp, human
gtgtccacgtgatcattggg

SEQ ID NO: 14440 - DNA, 20 bp, human
ggtgccccccaatgatcacg

SEQ ID NO: 14441 - DNA, 20 bp, human
gtggggctatcattgaaaaa

SEQ ID NO: 14442 - DNA, 20 bp, human
gagcagaacactggcaggtc

SEQ ID NO: 14443 - DNA, 20 bp, human
gcaacggttgactgttcgga

SEQ ID NO: 14444 - DNA, 20 bp, human
gtacttaccgcctctaggag

SEQ ID NO: 14445 - DNA, 20 bp, human
gtaagcaacggttgactgtt

SEQ ID NO: 14446 - DNA, 20 bp, human
ggcgtcccactggcagcgcg

SEQ ID NO: 14447 - DNA, 20 bp, human
gcgaagcagccgcaacgagc

SEQ ID NO: 14448 - DNA, 20 bp, human
gtgcggtgcgaagagccggg

SEQ ID NO: 14449 - DNA, 20 bp, human
gtagacaggtcagtgcccgg

SEQ ID NO: 14450 - DNA, 20 bp, human
ggcggaggtgacccgatgag

SEQ ID NO: 14451 - DNA, 20 bp, human
ggaaaagccccgctctatca

SEQ ID NO: 14452 - DNA, 20 bp, human
ggtctaacgctctaaggcag

SEQ ID NO: 14453 - DNA, 20 bp, human
gcggcctgagggtcctcatg

SEQ ID NO: 14454 - DNA, 20 bp, human
gcgctgcggtgcgaagagcc

SEQ ID NO: 14455 - DNA, 20 bp, human
gtgacctgtctaacgctcta

SEQ ID NO: 14456 - DNA, 20 bp, human
gtgacggcggctcctcccgt

SEQ ID NO: 14457 - DNA, 20 bp, human
gctcagactgccggatgtca

SEQ ID NO: 14458 - DNA, 20 bp, human
gactcacatacccctgacgg

SEQ ID NO: 14459 - DNA, 20 bp, human
gggcactcacatacccctga

SEQ ID NO: 14460 - DNA, 20 bp, human
gagacgccagaaaggacccg

SEQ ID NO: 14461 - DNA, 20 bp, human
gtgctaggctccgtgacatc

SEQ ID NO: 14462 - DNA, 20 bp, human
ggattcgggatgacttcggg

SEQ ID NO: 14463 - DNA, 20 bp, human
gcccgtttgctgcccacggg

SEQ ID NO: 14464 - DNA, 20 bp, human
gcagcgctccccattcctgg

SEQ ID NO: 14465 - DNA, 20 bp, human
ggcgggattcgggatgactt

SEQ ID NO: 14466 - DNA, 20 bp, human
gtcaccgggcgcaggagcag

SEQ ID NO: 14467 - DNA, 20 bp, human
ggcctccgcagcagcttcac

SEQ ID NO: 14468 - DNA, 20 bp, human
gcagagcccggagcccggtc

SEQ ID NO: 14469 - DNA, 20 bp, human
gggcgcccagcaggtctctc

SEQ ID NO: 14470 - DNA, 20 bp, human
ggctcccggagagacctgct

SEQ ID NO: 14471 - DNA, 20 bp, human
gccgggcgcgaggggtctcc

SEQ ID NO: 14472 - DNA, 20 bp, human
ggtcccggcccagcgtctca

SEQ ID NO: 14473 - DNA, 20 bp, human
ggccggggaagcctccttct

SEQ ID NO: 14474 - DNA, 20 bp, human
gccggagtaagtagcaccca

SEQ ID NO: 14475 - DNA, 20 bp, human
gccatggcgctgcgccgagg

SEQ ID NO: 14476 - DNA, 20 bp, human
gagcgcctgggctacgggcg

SEQ ID NO: 14477 - DNA, 20 bp, human
gcacctgggcctggtgcgcc

SEQ ID NO: 14478 - DNA, 20 bp, human
gaccaggcccaggtgcacgt

SEQ ID NO: 14479 - DNA, 20 bp, human
ggccggggcccgatccgcgg

SEQ ID NO: 14480 - DNA, 20 bp, human
gcgatccgcggtggcagccg

SEQ ID NO: 14481 - DNA, 20 bp, human
gtcccggctccgcgctcctg

SEQ ID NO: 14482 - DNA, 20 bp, human
gtgcacgtaggtgagccacg

SEQ ID NO: 14483 - DNA, 20 bp, human
gctgggctacgggcgaggta

SEQ ID NO: 14484 - DNA, 20 bp, human
gtccctggcgcaccaggccc

SEQ ID NO: 14485 - DNA, 20 bp, human
gggctcacctacgtgcacct

SEQ ID NO: 14486 - DNA, 20 bp, human
gcggcgctgccgctcaggag

SEQ ID NO: 14487 - DNA, 20 bp, human
gaggcggcaggcccgctgta

SEQ ID NO: 14488 - DNA, 20 bp, human
gaagcagcggggactcctca

SEQ ID NO: 14489 - DNA, 20 bp, human
ggcagacggccacgagcagg

SEQ ID NO: 14490 - DNA, 20 bp, human
gaagcggcggcgggaagatg

SEQ ID NO: 14491 - DNA, 20 bp, human
gccagccaggtagtaaacga

SEQ ID NO: 14492 - DNA, 20 bp, human
gagcgcagacggccacgagc

SEQ ID NO: 14493 - DNA, 20 bp, human
gagggacgcgcctggcatcg

SEQ ID NO: 14494 - DNA, 20 bp, human
gaccctgtcggggaaatccg

SEQ ID NO: 14495 - DNA, 20 bp, human
ggcttggtaaggactcgggt

SEQ ID NO: 14496 - DNA, 20 bp, human
ggccgggcagacccacggac

SEQ ID NO: 14497 - DNA, 20 bp, human
gccgccggcgcctctctcac

SEQ ID NO: 14498 - DNA, 20 bp, human
ggggcgagcgaggacaatga

SEQ ID NO: 14499 - DNA, 20 bp, human
gcaggccgcacagaccgggt

SEQ ID NO: 14500 - DNA, 20 bp, human
ggggcggccgggcagaccca

SEQ ID NO: 14501 - DNA, 20 bp, human
ggggcagacccacggaccgg

SEQ ID NO: 14502 - DNA, 20 bp, human
gccacggaccggcggaccca

SEQ ID NO: 14503 - DNA, 20 bp, human
gagccctgcccaagtcggag

SEQ ID NO: 14504 - DNA, 20 bp, human
gcgagcgccgggtgagagga

SEQ ID NO: 14505 - DNA, 20 bp, human
ggaggcgccgtagcgcggga

SEQ ID NO: 14506 - DNA, 20 bp, human
gcggagctcggcggagagta

SEQ ID NO: 14507 - DNA, 20 bp, human
gttggggtggcggtgacgac

SEQ ID NO: 14508 - DNA, 20 bp, human
gagctcggcggagagtaggg

SEQ ID NO: 14509 - DNA, 20 bp, human
gtcggcggagagtagggtgg

SEQ ID NO: 14510 - DNA, 20 bp, human
gcccacccccgctagaagag

SEQ ID NO: 14511 - DNA, 20 bp, human
gggttactgctgaagagaaa

SEQ ID NO: 14512 - DNA, 20 bp, human
ggggcagagacagtcagggg

SEQ ID NO: 14513 - DNA, 20 bp, human
gccccgctagaagaggggaa

SEQ ID NO: 14514 - DNA, 20 bp, human
ggatgcctgcccggctgttg

SEQ ID NO: 14515 - DNA, 20 bp, human
gcgacaggcagcaaaagacc

SEQ ID NO: 14516 - DNA, 20 bp, human
ggccagcgtactcaccccgg

SEQ ID NO: 14517 - DNA, 20 bp, human
gggagccagcgtactcaccc

SEQ ID NO: 14518 - DNA, 20 bp, human
gagcgtactcaccccggagg

SEQ ID NO: 14519 - DNA, 20 bp, human
gccgcggagaggggagaacg

SEQ ID NO: 14520 - DNA, 20 bp, human
gccggcccctcgcaggactg

SEQ ID NO: 14521 - DNA, 20 bp, human
gctcaccccggaggcggccg

SEQ ID NO: 14522 - DNA, 20 bp, human
ggggcagtgctagctcgccg

SEQ ID NO: 14523 - DNA, 20 bp, human
gttcaggttgatgcacccgg

SEQ ID NO: 14524 - DNA, 20 bp, human
ggtgagtacgctggctccgc

SEQ ID NO: 14525 - DNA, 20 bp, human
gcgcacggcgcccgtgtcca

SEQ ID NO: 14526 - DNA, 20 bp, human
ggccggggccccttagggag

SEQ ID NO: 14527 - DNA, 20 bp, human
gggcgcgggagagggatccc

SEQ ID NO: 14528 - DNA, 20 bp, human
gcctggtcctccgaagactc

SEQ ID NO: 14529 - DNA, 20 bp, human
gcgggccgggccacatgaag

SEQ ID NO: 14530 - DNA, 20 bp, human
gtggcccggcccgcgacggc

SEQ ID NO: 14531 - DNA, 20 bp, human
ggccaggactccggagtctt

SEQ ID NO: 14532 - DNA, 20 bp, human
gtgtggcgcccggcataggt

SEQ ID NO: 14533 - DNA, 20 bp, human
gggaggggcggggattcccc

SEQ ID NO: 14534 - DNA, 20 bp, human
gccgggccacatgaagcggg

SEQ ID NO: 14535 - DNA, 20 bp, human
gagtcctggcccggctctcg

SEQ ID NO: 14536 - DNA, 20 bp, human
gggaccccgctgcagtctcg

SEQ ID NO: 14537 - DNA, 20 bp, human
ggacgtgtcaaactgcttca

SEQ ID NO: 14538 - DNA, 20 bp, human
ggaaccccgagactgcagcg

SEQ ID NO: 14539 - DNA, 20 bp, human
ggtacagacaggacgaagag

SEQ ID NO: 14540 - DNA, 20 bp, human
gctggctgtggtgtgaccag

SEQ ID NO: 14541 - DNA, 20 bp, human
ggagggcccgagcggaaaag

SEQ ID NO: 14542 - DNA, 20 bp, human
ggcaggacggaagaaagccg

SEQ ID NO: 14543 - DNA, 20 bp, human
gcagcggggtccgcgcgggg

SEQ ID NO: 14544 - DNA, 20 bp, human
gatgggaggccagagagtcg

SEQ ID NO: 14545 - DNA, 20 bp, human
gggactcggggccactgtcc

SEQ ID NO: 14546 - DNA, 20 bp, human
gccgcgaggggaacatcgtg

SEQ ID NO: 14547 - DNA, 20 bp, human
ggagagagactagcaaagag

SEQ ID NO: 14548 - DNA, 20 bp, human
gggaacatcgtgcggagagg

SEQ ID NO: 14549 - DNA, 20 bp, human
gcccgcatgcagatagaggg

SEQ ID NO: 14550 - DNA, 20 bp, human
gaggggaacatcgtgcggag

SEQ ID NO: 14551 - DNA, 20 bp, human
gacatcgtgcggagaggcgg

SEQ ID NO: 14552 - DNA, 20 bp, human
gccggcggccgagaagggag

SEQ ID NO: 14553 - DNA, 20 bp, human
gactcacaaagggaagtcaa

SEQ ID NO: 14554 - DNA, 20 bp, human
gcggagaggcggcggcgcat

SEQ ID NO: 14555 - DNA, 20 bp, human
gagacccgcatgcagataga

SEQ ID NO: 14556 - DNA, 20 bp, human
ggtgaacgggcgccgttata

SEQ ID NO: 14557 - DNA, 20 bp, human
ggcgttgccctagaaacaga

SEQ ID NO: 14558 - DNA, 20 bp, human
ggtcgccatggcaggtctgg

SEQ ID NO: 14559 - DNA, 20 bp, human
gctaggactcgcggtcgcca

SEQ ID NO: 14560 - DNA, 20 bp, human
gtagtaccgaggtcacactc

SEQ ID NO: 14561 - DNA, 20 bp, human
ggccagtgatccaagcaagt

SEQ ID NO: 14562 - DNA, 20 bp, human
gcgggacagtaactccacac

SEQ ID NO: 14563 - DNA, 20 bp, human
gtcctcgcgttaaccccagg

SEQ ID NO: 14564 - DNA, 20 bp, human
gagaaagacgctaggactcg

SEQ ID NO: 14565 - DNA, 20 bp, human
gggctcctcgcgttaacccc

SEQ ID NO: 14566 - DNA, 20 bp, human
gcgcggtcgcggaagtatcg

SEQ ID NO: 14567 - DNA, 20 bp, human
ggtcaagacctcagcctcag

SEQ ID NO: 14568 - DNA, 20 bp, human
gtcgcagccaggcgggtcct

SEQ ID NO: 14569 - DNA, 20 bp, human
gacggaaaccaagacgagcg

SEQ ID NO: 14570 - DNA, 20 bp, human
ggttgccccagcaacaacca

SEQ ID NO: 14571 - DNA, 20 bp, human
gaccaagacgagcgcggtcg

SEQ ID NO: 14572 - DNA, 20 bp, human
gtagcttcgtcacacccctg

SEQ ID NO: 14573 - DNA, 20 bp, human
gtacatatctcgcagccagg

SEQ ID NO: 14574 - DNA, 20 bp, human
gccgttaagtgcgctaaggt

SEQ ID NO: 14575 - DNA, 20 bp, human
gaaagcctggaaaaaatggg

SEQ ID NO: 14576 - DNA, 20 bp, human
gggacctgcccactgatcag

SEQ ID NO: 14577 - DNA, 20 bp, human
ggagaggagccggttccctg

SEQ ID NO: 14578 - DNA, 20 bp, human
gcagccgcgcggagctcctg

SEQ ID NO: 14579 - DNA, 20 bp, human
ggggagagggcccggactag

SEQ ID NO: 14580 - DNA, 20 bp, human
gccggcccgcaaggaggcgg

SEQ ID NO: 14581 - DNA, 20 bp, human
ggcagccccggcccgcaagg

SEQ ID NO: 14582 - DNA, 20 bp, human
gtcccgcggcgcaggaggat

SEQ ID NO: 14583 - DNA, 20 bp, human
ggcaccgcaggagctccgcg

SEQ ID NO: 14584 - DNA, 20 bp, human
gggtccagctctcgtagtag

SEQ ID NO: 14585 - DNA, 20 bp, human
gccgcgccatcaattcctca

SEQ ID NO: 14586 - DNA, 20 bp, human
gacatatcagcaggaccgtg

SEQ ID NO: 14587 - DNA, 20 bp, human
gtttgtggctcggggcctca

SEQ ID NO: 14588 - DNA, 20 bp, human
ggaaaggattactgagagtc

SEQ ID NO: 14589 - DNA, 20 bp, human
gacctacgctgaaattttgg

SEQ ID NO: 14590 - DNA, 20 bp, human
gtttgctgaactaaaactat

SEQ ID NO: 14591 - DNA, 20 bp, human
ggggggcaggttctcttgct

SEQ ID NO: 14592 - DNA, 20 bp, human
gagaacctacgctgaaattt

SEQ ID NO: 14593 - DNA, 20 bp, human
gtatgtgacatcacccccgg

SEQ ID NO: 14594 - DNA, 20 bp, human
gtgatatgtgacatcacccc

SEQ ID NO: 14595 - DNA, 20 bp, human
gatttacagctgggcctccg

SEQ ID NO: 14596 - DNA, 20 bp, human
gggctcaagaggaagaatcc

SEQ ID NO: 14597 - DNA, 20 bp, human
gttctgggcaagttttggta

SEQ ID NO: 14598 - DNA, 20 bp, human
gagctctgttatacttccaa

SEQ ID NO: 14599 - DNA, 20 bp, human
gcctctactgctggaaaaga

SEQ ID NO: 14600 - DNA, 20 bp, human
gctggaaaagaaggctcaag

SEQ ID NO: 14601 - DNA, 20 bp, human
gaagagggagaaatattgat

SEQ ID NO: 14602 - DNA, 20 bp, human
gtggccttctgggcaagttt

SEQ ID NO: 14603 - DNA, 20 bp, human
gcttagaaaggatgtcagta

SEQ ID NO: 14604 - DNA, 20 bp, human
gtttgaggttttggccttct

SEQ ID NO: 14605 - DNA, 20 bp, human
ggaataagccctcctattct

SEQ ID NO: 14606 - DNA, 20 bp, human
ggctacggtgagccgaaggt

SEQ ID NO: 14607 - DNA, 20 bp, human
gcttccggctgtaaagatgg

SEQ ID NO: 14608 - DNA, 20 bp, human
gcggcttcctagtgagtcgg

SEQ ID NO: 14609 - DNA, 20 bp, human
gagtcggcggctgatttaga

SEQ ID NO: 14610 - DNA, 20 bp, human
gaatcagccgccgactcact

SEQ ID NO: 14611 - DNA, 20 bp, human
gagggacgagggtgtcctag

SEQ ID NO: 14612 - DNA, 20 bp, human
gggctgcgccgtacaacttc

SEQ ID NO: 14613 - DNA, 20 bp, human
gagacacccgctagggacga

SEQ ID NO: 14614 - DNA, 20 bp, human
gctcatgcagacacccgcta

SEQ ID NO: 14615 - DNA, 20 bp, human
gacggtgagccgaaggtggg

SEQ ID NO: 14616 - DNA, 20 bp, human
ggccgcgagctggattatgg

SEQ ID NO: 14617 - DNA, 20 bp, human
gcagcaccacccagacttgg

SEQ ID NO: 14618 - DNA, 20 bp, human
ggaggcggaaagacttgtgg

SEQ ID NO: 14619 - DNA, 20 bp, human
gcgagccgcgagctggatta

SEQ ID NO: 14620 - DNA, 20 bp, human
ggccaccataatccagctcg

SEQ ID NO: 14621 - DNA, 20 bp, human
gaggcgccagggacggacgt

SEQ ID NO: 14622 - DNA, 20 bp, human
gcgaaggccggggcccacca

SEQ ID NO: 14623 - DNA, 20 bp, human
gtgggccagtgcgagcccag

SEQ ID NO: 14624 - DNA, 20 bp, human
ggatccggagcccgctacat

SEQ ID NO: 14625 - DNA, 20 bp, human
ggcgagcccagagggcccga

SEQ ID NO: 14626 - DNA, 20 bp, human
gtagccggtcccgtcccgtc

SEQ ID NO: 14627 - DNA, 20 bp, human
gcgcagaaggtagggacccc

SEQ ID NO: 14628 - DNA, 20 bp, human
gtggccgcggccacccggag

SEQ ID NO: 14629 - DNA, 20 bp, human
gggacccccccgcagaaggt

SEQ ID NO: 14630 - DNA, 20 bp, human
gccgtcccgtccggcagccg

SEQ ID NO: 14631 - DNA, 20 bp, human
gcgggctcgttggagggagg

SEQ ID NO: 14632 - DNA, 20 bp, human
ggtccagagacgcctccacg

SEQ ID NO: 14633 - DNA, 20 bp, human
gtctggccgcggctactacc

SEQ ID NO: 14634 - DNA, 20 bp, human
gcggggtgggcgcaactacg

SEQ ID NO: 14635 - DNA, 20 bp, human
gaacgagcccgaaaagcccg

SEQ ID NO: 14636 - DNA, 20 bp, human
gcggcggacaggtccagtga

SEQ ID NO: 14637 - DNA, 20 bp, human
gacaggtccagtgaaggcgc

SEQ ID NO: 14638 - DNA, 20 bp, human
gggcggcggaggacaatacg

SEQ ID NO: 14639 - DNA, 20 bp, human
ggcgcctcagctctggtgag

SEQ ID NO: 14640 - DNA, 20 bp, human
ggctgagtagacgcgaggct

SEQ ID NO: 14641 - DNA, 20 bp, human
gccgcgccgcgcctcagctc

SEQ ID NO: 14642 - DNA, 20 bp, human
gtcgcgtctactcagcccgg

SEQ ID NO: 14643 - DNA, 20 bp, human
ggtcccgccggcccttctcc

SEQ ID NO: 14644 - DNA, 20 bp, human
gcgccaaccctcccggagaa

SEQ ID NO: 14645 - DNA, 20 bp, human
gcgccggcccttctccggga

SEQ ID NO: 14646 - DNA, 20 bp, human
gaccgcagcccgggcgtgca

SEQ ID NO: 14647 - DNA, 20 bp, human
gggcgaggtgggcagttcgt

SEQ ID NO: 14648 - DNA, 20 bp, human
gggaggggacgcgcatcaca

SEQ ID NO: 14649 - DNA, 20 bp, human
gggtcaccgaaagctcgcgg

SEQ ID NO: 14650 - DNA, 20 bp, human
gccttcccggcgcactcggg

SEQ ID NO: 14651 - DNA, 20 bp, human
gcgcacagcgctaacgtgag

SEQ ID NO: 14652 - DNA, 20 bp, human
ggtgggtcaccgaaagctcg

SEQ ID NO: 14653 - DNA, 20 bp, human
gtgagagtgtgggcgttccg

SEQ ID NO: 14654 - DNA, 20 bp, human
gtctccggcgaggtgagtcc

SEQ ID NO: 14655 - DNA, 20 bp, human
gtgcgagccgggaagacgcg

SEQ ID NO: 14656 - DNA, 20 bp, human
gggtcaggggcctcgagatc

SEQ ID NO: 14657 - DNA, 20 bp, human
gcggagcccggggtgctgga

SEQ ID NO: 14658 - DNA, 20 bp, human
gacctgtgcgccgtcaccac

SEQ ID NO: 14659 - DNA, 20 bp, human
gggcctgggggcgctacggt

SEQ ID NO: 14660 - DNA, 20 bp, human
gggtccaccggggttctgag

SEQ ID NO: 14661 - DNA, 20 bp, human
gtgagggcccgtcccctgcg

SEQ ID NO: 14662 - DNA, 20 bp, human
gtgtgcgccgtcaccacggg

SEQ ID NO: 14663 - DNA, 20 bp, human
gctcactcggctcaaactct

SEQ ID NO: 14664 - DNA, 20 bp, human
ggggacgggccctcaggctc

SEQ ID NO: 14665 - DNA, 20 bp, human
gaactagggcccggagcccg

SEQ ID NO: 14666 - DNA, 20 bp, human
gagagtgaggaggcgaccca

SEQ ID NO: 14667 - DNA, 20 bp, human
gggcgcccgacactcactgt

SEQ ID NO: 14668 - DNA, 20 bp, human
gccgggacgaggagtcgacc

SEQ ID NO: 14669 - DNA, 20 bp, human
ggaagaggcgacccagagtg

SEQ ID NO: 14670 - DNA, 20 bp, human
ggctgggcggtcaacaagtg

SEQ ID NO: 14671 - DNA, 20 bp, human
gaccgcgaggcgaccgggag

SEQ ID NO: 14672 - DNA, 20 bp, human
gcggagccaggaggtgaccc

SEQ ID NO: 14673 - DNA, 20 bp, human
ggaagcgacctggagtgaag

SEQ ID NO: 14674 - DNA, 20 bp, human
gcaggtggacgcccagaggg

SEQ ID NO: 14675 - DNA, 20 bp, human
gcggagaccgcgaggcgacc

SEQ ID NO: 14676 - DNA, 20 bp, human
gagtctctgaggcacgggag

SEQ ID NO: 14677 - DNA, 20 bp, human
gtggggagcgcaagtctctg

SEQ ID NO: 14678 - DNA, 20 bp, human
gcggcagaagcgcccctcgt

SEQ ID NO: 14679 - DNA, 20 bp, human
gagagaccgagcgcctaatg

SEQ ID NO: 14680 - DNA, 20 bp, human
gctcgaggatgggccgacag

SEQ ID NO: 14681 - DNA, 20 bp, human
ggcgcaagtctctgaggcac

SEQ ID NO: 14682 - DNA, 20 bp, human
gaggtcaccggcccctccgg

SEQ ID NO: 14683 - DNA, 20 bp, human
gcaacgctaaagccaacgag

SEQ ID NO: 14684 - DNA, 20 bp, human
gcccgcgtcggaggcttaga

SEQ ID NO: 14685 - DNA, 20 bp, human
gctggagcggtcagccatgg

SEQ ID NO: 14686 - DNA, 20 bp, human
gcgcgggtcgttccacgtag

SEQ ID NO: 14687 - DNA, 20 bp, human
gggcggcccggccagagact

SEQ ID NO: 14688 - DNA, 20 bp, human
gtcgccccgacgcctgtcaa

SEQ ID NO: 14689 - DNA, 20 bp, human
gcaacagccgcaccactacg

SEQ ID NO: 14690 - DNA, 20 bp, human
ggccggcttcccggacacgt

SEQ ID NO: 14691 - DNA, 20 bp, human
gggcttcccggacacgtcgg

SEQ ID NO: 14692 - DNA, 20 bp, human
ggtcggtggcgccacctcga

SEQ ID NO: 14693 - DNA, 20 bp, human
ggtcgttccacgtagtggtg

SEQ ID NO: 14694 - DNA, 20 bp, human
gaagggaggtagcaactggc

SEQ ID NO: 14695 - DNA, 20 bp, human
gtgttgtggtccacgaagaa

SEQ ID NO: 14696 - DNA, 20 bp, human
gagaccgagactaagatcag

SEQ ID NO: 14697 - DNA, 20 bp, human
ggtaggacggaccgtcactg

SEQ ID NO: 14698 - DNA, 20 bp, human
gggtcgaagcagaaaaggag

SEQ ID NO: 14699 - DNA, 20 bp, human
gcggggcgggaagcgcttca

SEQ ID NO: 14700 - DNA, 20 bp, human
gcgtagtagcggccgtagga

SEQ ID NO: 14701 - DNA, 20 bp, human
gcagggcgaagaggatataa

SEQ ID NO: 14702 - DNA, 20 bp, human
gttggggctggggttcgtaa

SEQ ID NO: 14703 - DNA, 20 bp, human
gcgggctacggccccagtga

SEQ ID NO: 14704 - DNA, 20 bp, human
ggggcgcctgcgcgatgggt

SEQ ID NO: 14705 - DNA, 20 bp, human
gcaacctctgatcttagtct

SEQ ID NO: 14706 - DNA, 20 bp, human
gccagtagcggccccttcac

SEQ ID NO: 14707 - DNA, 20 bp, human
ggctcagacctagtcgggag

SEQ ID NO: 14708 - DNA, 20 bp, human
gcggctgctgcagccagtag

SEQ ID NO: 14709 - DNA, 20 bp, human
gcgggccaagacgcccggag

SEQ ID NO: 14710 - DNA, 20 bp, human
gtccccccgagagagggaaa

SEQ ID NO: 14711 - DNA, 20 bp, human
ggccccgctcagacctagtc

SEQ ID NO: 14712 - DNA, 20 bp, human
ggcggaagtcgtggaagcgt

SEQ ID NO: 14713 - DNA, 20 bp, human
gcggtgccgcaccccgtaaa

SEQ ID NO: 14714 - DNA, 20 bp, human
gcggtcgcttccgaccccag

SEQ ID NO: 14715 - DNA, 20 bp, human
gtggcgtcccgtggctgagg

SEQ ID NO: 14716 - DNA, 20 bp, human
gacggtcccccgggcgacag

SEQ ID NO: 14717 - DNA, 20 bp, human
ggtcccccgggcgacagcgg

SEQ ID NO: 14718 - DNA, 20 bp, human
gtgagttaggagggttcgat

SEQ ID NO: 14719 - DNA, 20 bp, human
gaggcgtagtacggtccccc

SEQ ID NO: 14720 - DNA, 20 bp, human
ggagctggaggacgagaggt

SEQ ID NO: 14721 - DNA, 20 bp, human
ggtgggaaggcagtagacgc

SEQ ID NO: 14722 - DNA, 20 bp, human
ggacccgaaacggcactcac

SEQ ID NO: 14723 - DNA, 20 bp, human
gcggtccgtggggaagtcgg

SEQ ID NO: 14724 - DNA, 20 bp, human
ggacgcacgcaggcgtagta

SEQ ID NO: 14725 - DNA, 20 bp, human
gctgctggaacaccgtggga

SEQ ID NO: 14726 - DNA, 20 bp, human
gggagtacagcctgagtggt

SEQ ID NO: 14727 - DNA, 20 bp, human
gggtaggagtacagcctgag

SEQ ID NO: 14728 - DNA, 20 bp, human
gtacagcctgagtggtagga

SEQ ID NO: 14729 - DNA, 20 bp, human
ggcctggctacggttggtag

SEQ ID NO: 14730 - DNA, 20 bp, human
gctctgttagagtagtagaa

SEQ ID NO: 14731 - DNA, 20 bp, human
ggaaggtggtggggaattag

SEQ ID NO: 14732 - DNA, 20 bp, human
gaccgcggctcgcctggcta

SEQ ID NO: 14733 - DNA, 20 bp, human
ggataccagagaccctaaac

SEQ ID NO: 14734 - DNA, 20 bp, human
ggtgcactgccagcggaagg

SEQ ID NO: 14735 - DNA, 20 bp, human
gttccgctggcagtgcacga

SEQ ID NO: 14736 - DNA, 20 bp, human
ggataccagagaccctaaac

SEQ ID NO: 14737 - DNA, 20 bp, human
ggcctggctacggttggtag

SEQ ID NO: 14738 - DNA, 20 bp, human
gctctgttagagtagtagaa

SEQ ID NO: 14739 - DNA, 20 bp, human
gaccgcggctcgcctggcta

SEQ ID NO: 14740 - DNA, 20 bp, human
gggagtacagcctgagtggt

SEQ ID NO: 14741 - DNA, 20 bp, human
gggtaggagtacagcctgag

SEQ ID NO: 14742 - DNA, 20 bp, human
gtacagcctgagtggtagga

SEQ ID NO: 14743 - DNA, 20 bp, human
gcacgccagtttagggtctc

SEQ ID NO: 14744 - DNA, 20 bp, human
gcaggcctcacgccagttta

SEQ ID NO: 14745 - DNA, 20 bp, human
gggactgtgcccaacgctgg

SEQ ID NO: 14746 - DNA, 20 bp, human
ggataccagagaccctaaac

SEQ ID NO: 14747 - DNA, 20 bp, human
ggcctggctacggttggtag

SEQ ID NO: 14748 - DNA, 20 bp, human
gctctgttagagtagtagaa

SEQ ID NO: 14749 - DNA, 20 bp, human
gaccgcggctcgcctggcta

SEQ ID NO: 14750 - DNA, 20 bp, human
gggagtacagcctgagtggt

SEQ ID NO: 14751 - DNA, 20 bp, human
gggtaggagtacagcctgag

SEQ ID NO: 14752 - DNA, 20 bp, human
gtacagcctgagtggtagga

SEQ ID NO: 14753 - DNA, 20 bp, human
gcacgccagtttagggtctc

SEQ ID NO: 14754 - DNA, 20 bp, human
gcaggcctcacgccagttta

SEQ ID NO: 14755 - DNA, 20 bp, human
gggactgtgcccaacgctgg

SEQ ID NO: 14756 - DNA, 20 bp, human
ggataccagagaccctaaac

SEQ ID NO: 14757 - DNA, 20 bp, human
ggcctggctacggttggtag

SEQ ID NO: 14758 - DNA, 20 bp, human
gctctgttagagtagtagaa

SEQ ID NO: 14759 - DNA, 20 bp, human
gaccgcggctcgcctggcta

SEQ ID NO: 14760 - DNA, 20 bp, human
gggagtacagcctgagtggt

SEQ ID NO: 14761 - DNA, 20 bp, human
gggtaggagtacagcctgag

SEQ ID NO: 14762 - DNA, 20 bp, human
gtacagcctgagtggtagga

SEQ ID NO: 14763 - DNA, 20 bp, human
gcacgccagtttagggtctc

SEQ ID NO: 14764 - DNA, 20 bp, human
gcaggcctcacgccagttta

SEQ ID NO: 14765 - DNA, 20 bp, human
gggactgtgcccaacgctgg

SEQ ID NO: 14766 - DNA, 20 bp, human
ggtcagcacgcgggaggact

SEQ ID NO: 14767 - DNA, 20 bp, human
gcggccgcgcaccgagccag

SEQ ID NO: 14768 - DNA, 20 bp, human
gggaggactgggcttctcgg

SEQ ID NO: 14769 - DNA, 20 bp, human
gggacgggagcgttcgagag

SEQ ID NO: 14770 - DNA, 20 bp, human
ggctccgacagcagatgcgg

SEQ ID NO: 14771 - DNA, 20 bp, human
gagcgttcgagagcggaaca

SEQ ID NO: 14772 - DNA, 20 bp, human
gtctgctcccgggagcggag

SEQ ID NO: 14773 - DNA, 20 bp, human
ggacctgtgtgcgaagccat

SEQ ID NO: 14774 - DNA, 20 bp, human
gcgcgctccgacagcagatg

SEQ ID NO: 14775 - DNA, 20 bp, human
ggggccggtcagcacgcggg

SEQ ID NO: 14776 - DNA, 20 bp, human
gggtaggcagaagagcgaag

SEQ ID NO: 14777 - DNA, 20 bp, human
gggcggctggaaccccccgg

SEQ ID NO: 14778 - DNA, 20 bp, human
gcagcccgggaagggacgga

SEQ ID NO: 14779 - DNA, 20 bp, human
gcggccgggctggaatccgg

SEQ ID NO: 14780 - DNA, 20 bp, human
gggaaccgcgagcggcgtag

SEQ ID NO: 14781 - DNA, 20 bp, human
gaccgtggtgccggacccag

SEQ ID NO: 14782 - DNA, 20 bp, human
gtggcgcggcgcgctcggtg

SEQ ID NO: 14783 - DNA, 20 bp, human
ggagcgaagggggagagcac

SEQ ID NO: 14784 - DNA, 20 bp, human
gccgggggcgctcaattccc

SEQ ID NO: 14785 - DNA, 20 bp, human
gggtggggcgcgctgacggg

SEQ ID NO: 14786 - DNA, 20 bp, human
gcgccggcgaggactcgatc

SEQ ID NO: 14787 - DNA, 20 bp, human
gaaggtaaggaaggctccgg

SEQ ID NO: 14788 - DNA, 20 bp, human
gtcgccaggaaggggaaaaa

SEQ ID NO: 14789 - DNA, 20 bp, human
ggtgggggcgcagcgagggt

SEQ ID NO: 14790 - DNA, 20 bp, human
ggccggcgggtgctctccag

SEQ ID NO: 14791 - DNA, 20 bp, human
gcgccggatcgagtcctcgc

SEQ ID NO: 14792 - DNA, 20 bp, human
ggccccccccacctccggtc

SEQ ID NO: 14793 - DNA, 20 bp, human
ggcgggcatccggaccctcc

SEQ ID NO: 14794 - DNA, 20 bp, human
gtgctctccagggggcgtcc

SEQ ID NO: 14795 - DNA, 20 bp, human
ggtcccggcgaggcccagag

SEQ ID NO: 14796 - DNA, 20 bp, human
gcgcgcgccgggccgagtga

SEQ ID NO: 14797 - DNA, 20 bp, human
gccggaggaaccgggttcgg

SEQ ID NO: 14798 - DNA, 20 bp, human
gaccgggccgggcgcagggt

SEQ ID NO: 14799 - DNA, 20 bp, human
gggagttccccagaagatgg

SEQ ID NO: 14800 - DNA, 20 bp, human
gcggcccggtccccgactta

SEQ ID NO: 14801 - DNA, 20 bp, human
gccggtccccgacttaggga

SEQ ID NO: 14802 - DNA, 20 bp, human
gcggagcggccggaggaacc

SEQ ID NO: 14803 - DNA, 20 bp, human
gcggcgctcagagaccgaag

SEQ ID NO: 14804 - DNA, 20 bp, human
gcggccggaggaaccgggtt

SEQ ID NO: 14805 - DNA, 20 bp, human
ggccgccgcccgcaaatagg

SEQ ID NO: 14806 - DNA, 20 bp, human
ggagggagaagcccccccaa

SEQ ID NO: 14807 - DNA, 20 bp, human
gccccccaagggagactcta

SEQ ID NO: 14808 - DNA, 20 bp, human
gcgaggagggaggcgcgaga

SEQ ID NO: 14809 - DNA, 20 bp, human
gtgagacgagaagtgaccgg

SEQ ID NO: 14810 - DNA, 20 bp, human
ggagcggggaaaaaaatcct

SEQ ID NO: 14811 - DNA, 20 bp, human
gaccgaggggggctaaaggg

SEQ ID NO: 14812 - DNA, 20 bp, human
gggacggcgactaaggagag

SEQ ID NO: 14813 - DNA, 20 bp, human
gggttggattcagttggata

SEQ ID NO: 14814 - DNA, 20 bp, human
gccaacctccaaaccgaggg

SEQ ID NO: 14815 - DNA, 20 bp, human
ggatggacggacggcgacta

SEQ ID NO: 14816 - DNA, 20 bp, human
ggcggcagcagcggcggtaa

SEQ ID NO: 14817 - DNA, 20 bp, human
gagcaggacggagacgaaag

SEQ ID NO: 14818 - DNA, 20 bp, human
ggcgcgcccgagcccgacca

SEQ ID NO: 14819 - DNA, 20 bp, human
ggctgcaccacagaccggag

SEQ ID NO: 14820 - DNA, 20 bp, human
gccgagcagggccgtcggag

SEQ ID NO: 14821 - DNA, 20 bp, human
ggcaccacagaccggagcgg

SEQ ID NO: 14822 - DNA, 20 bp, human
gggagtgctccccgggcctg

SEQ ID NO: 14823 - DNA, 20 bp, human
gggacccgaaccacagagcc

SEQ ID NO: 14824 - DNA, 20 bp, human
ggacgccgggctctgtggtt

SEQ ID NO: 14825 - DNA, 20 bp, human
ggacccaggcgcacacggag

SEQ ID NO: 14826 - DNA, 20 bp, human
gggccttcttcgaggagcag

SEQ ID NO: 14827 - DNA, 20 bp, human
ggagcaagcgcgggaggacg

SEQ ID NO: 14828 - DNA, 20 bp, human
ggacgcgcgcgggcactctc

SEQ ID NO: 14829 - DNA, 20 bp, human
ggccgccctggccttcttcg

SEQ ID NO: 14830 - DNA, 20 bp, human
gcgggagaggtggaaggacg

SEQ ID NO: 14831 - DNA, 20 bp, human
gctcctctgctcctcgaaga

SEQ ID NO: 14832 - DNA, 20 bp, human
gagcggccggacgccgccag

SEQ ID NO: 14833 - DNA, 20 bp, human
ggggccggggcgcgactaag

SEQ ID NO: 14834 - DNA, 20 bp, human
ggctcacggagagcacctac

SEQ ID NO: 14835 - DNA, 20 bp, human
ggcgactaaggggctctgga

SEQ ID NO: 14836 - DNA, 20 bp, human
gccacagcctcgctctacag

SEQ ID NO: 14837 - DNA, 20 bp, human
gccctccgagtgggagacca

SEQ ID NO: 14838 - DNA, 20 bp, human
ggggcgctcgccaaaggagt

SEQ ID NO: 14839 - DNA, 20 bp, human
ggctcgcgctccaactcctt

SEQ ID NO: 14840 - DNA, 20 bp, human
gaccagggcgcggactctcc

SEQ ID NO: 14841 - DNA, 20 bp, human
gtggttggcgccctccgagt

SEQ ID NO: 14842 - DNA, 20 bp, human
gggatgacggtccttgagag

SEQ ID NO: 14843 - DNA, 20 bp, human
gggccagggaaacctcagtc

SEQ ID NO: 14844 - DNA, 20 bp, human
ggtgagtgggagccttggag

SEQ ID NO: 14845 - DNA, 20 bp, human
gcgtcatcctgaacttggta

SEQ ID NO: 14846 - DNA, 20 bp, human
gtccaccatggccatctaca

SEQ ID NO: 14847 - DNA, 20 bp, human
gggccatggaggggctgtcc

SEQ ID NO: 14848 - DNA, 20 bp, human
gtcgctgccagctgagtcgt

SEQ ID NO: 14849 - DNA, 20 bp, human
gggagcccaaggcccagggt

SEQ ID NO: 14850 - DNA, 20 bp, human
ggctgagtcgtgggcacctg

SEQ ID NO: 14851 - DNA, 20 bp, human
gcagtggtaggtagtccctc

SEQ ID NO: 14852 - DNA, 20 bp, human
gatctccaggtccctctccg

SEQ ID NO: 14853 - DNA, 20 bp, human
ggactacctaccactgctcc

SEQ ID NO: 14854 - DNA, 20 bp, human
ggaagcctcggagagggacc

SEQ ID NO: 14855 - DNA, 20 bp, human
gggctgggagctggtggcga

SEQ ID NO: 14856 - DNA, 20 bp, human
ggggctgcggccagtgctgt

SEQ ID NO: 14857 - DNA, 20 bp, human
gcagcccgcggcacttaccg

SEQ ID NO: 14858 - DNA, 20 bp, human
gtgcgctcggcaccagctcg

SEQ ID NO: 14859 - DNA, 20 bp, human
gcgccccaggcacacaccca

SEQ ID NO: 14860 - DNA, 20 bp, human
ggaacgcgcaggagagggtg

SEQ ID NO: 14861 - DNA, 20 bp, human
gggtcccccaggaggcacgg

SEQ ID NO: 14862 - DNA, 20 bp, human
gtcgcttggcggctcaagtg

SEQ ID NO: 14863 - DNA, 20 bp, human
gttggtccgggtcccccagg

SEQ ID NO: 14864 - DNA, 20 bp, human
gggtgcagcccgcccgggag

SEQ ID NO: 14865 - DNA, 20 bp, human
gaggccgcgcatgcttggag

SEQ ID NO: 14866 - DNA, 20 bp, human
ggattggagccgggtgccgc

SEQ ID NO: 14867 - DNA, 20 bp, human
ggtgatcatagaggtgccag

SEQ ID NO: 14868 - DNA, 20 bp, human
gtacagttctccggcatcca

SEQ ID NO: 14869 - DNA, 20 bp, human
gtcctctagagggagctgat

SEQ ID NO: 14870 - DNA, 20 bp, human
gaggatcaggtccccagccg

SEQ ID NO: 14871 - DNA, 20 bp, human
ggcctgccgggagccgggtg

SEQ ID NO: 14872 - DNA, 20 bp, human
gatccagggctgggccaaga

SEQ ID NO: 14873 - DNA, 20 bp, human
gcccagttcttacagttctc

SEQ ID NO: 14874 - DNA, 20 bp, human
gcccggcaggtaagctggaa

SEQ ID NO: 14875 - DNA, 20 bp, human
gacagagcaacttcctctag

SEQ ID NO: 14876 - DNA, 20 bp, human
ggggtctccacagcacgcaa

SEQ ID NO: 14877 - DNA, 20 bp, human
gcgcggagccggagagacct

SEQ ID NO: 14878 - DNA, 20 bp, human
gcgtgctgctcaccaaaggt

SEQ ID NO: 14879 - DNA, 20 bp, human
ggttctcagcgaagagagta

SEQ ID NO: 14880 - DNA, 20 bp, human
gttggtgagcagcacggcca

SEQ ID NO: 14881 - DNA, 20 bp, human
gagcatggagcgcggctaca

SEQ ID NO: 14882 - DNA, 20 bp, human
gcggatacccttgcgtgctg

SEQ ID NO: 14883 - DNA, 20 bp, human
gcgctgagaacggccgctag

SEQ ID NO: 14884 - DNA, 20 bp, human
gacgcacgctagccccgggt

SEQ ID NO: 14885 - DNA, 20 bp, human
gcaccaaaggtgggtgccgg

SEQ ID NO: 14886 - DNA, 20 bp, human
gggcgtggaaagctaaccaa

SEQ ID NO: 14887 - DNA, 20 bp, human
gtgagggagataggcctcca

SEQ ID NO: 14888 - DNA, 20 bp, human
ggttcagccaaggtcacaga

SEQ ID NO: 14889 - DNA, 20 bp, human
gtgcccagagtccgtagcca

SEQ ID NO: 14890 - DNA, 20 bp, human
gtcttgaagcgacccggaag

SEQ ID NO: 14891 - DNA, 20 bp, human
gcgcggagcagggccctgat

SEQ ID NO: 14892 - DNA, 20 bp, human
gcgagaagcgagaccttaga

SEQ ID NO: 14893 - DNA, 20 bp, human
gctaacaggtggcgcaagcg

SEQ ID NO: 14894 - DNA, 20 bp, human
gcaggcaggcagtgtcgtct

SEQ ID NO: 14895 - DNA, 20 bp, human
gtgtaggtagagagaccctt

SEQ ID NO: 14896 - DNA, 20 bp, human
ggcctgcagttccagatcca

SEQ ID NO: 14897 - DNA, 20 bp, human
gcacatagcaggatgagcag

SEQ ID NO: 14898 - DNA, 20 bp, human
gctagccctaattgaggtca

SEQ ID NO: 14899 - DNA, 20 bp, human
ggctgtccctgacctcaatt

SEQ ID NO: 14900 - DNA, 20 bp, human
gccacctgcaccagctccct

SEQ ID NO: 14901 - DNA, 20 bp, human
gcagctgccactggcttatc

SEQ ID NO: 14902 - DNA, 20 bp, human
gcttatgtcttaggcccatg

SEQ ID NO: 14903 - DNA, 20 bp, human
gaccttggatctggaactgc

SEQ ID NO: 14904 - DNA, 20 bp, human
gtgaggtcagggacagccat

SEQ ID NO: 14905 - DNA, 20 bp, human
ggtggcaagccgagtcttag

SEQ ID NO: 14906 - DNA, 20 bp, human
ggcccgcttgccacccgcgg

SEQ ID NO: 14907 - DNA, 20 bp, human
gacctggccgcagcctccgc

SEQ ID NO: 14908 - DNA, 20 bp, human
gccagcgcgctccctcctcg

SEQ ID NO: 14909 - DNA, 20 bp, human
gtgcgcgactacccacctgg

SEQ ID NO: 14910 - DNA, 20 bp, human
gggtagtcgcgcattcggag

SEQ ID NO: 14911 - DNA, 20 bp, human
gccagcccgcttgccacccg

SEQ ID NO: 14912 - DNA, 20 bp, human
gcggcccagcgcccccaggt

SEQ ID NO: 14913 - DNA, 20 bp, human
gctcaggaaacgcagccccg

SEQ ID NO: 14914 - DNA, 20 bp, human
gggggagagccgagggccaa

SEQ ID NO: 14915 - DNA, 20 bp, human
gggctgcgtttcctgagacc

SEQ ID NO: 14916 - DNA, 20 bp, human
gggagctgcaattaccgtgt

SEQ ID NO: 14917 - DNA, 20 bp, human
gcacggcggggagactggaa

SEQ ID NO: 14918 - DNA, 20 bp, human
gccagccaggcgggagcgac

SEQ ID NO: 14919 - DNA, 20 bp, human
gcggccgcgccccggaagag

SEQ ID NO: 14920 - DNA, 20 bp, human
ggtgggctgcggaattctcg

SEQ ID NO: 14921 - DNA, 20 bp, human
gtggcaggagcgaccccctt

SEQ ID NO: 14922 - DNA, 20 bp, human
gcgaggcccgggacagaggt

SEQ ID NO: 14923 - DNA, 20 bp, human
gggcccgaagtctcccaagg

SEQ ID NO: 14924 - DNA, 20 bp, human
ggaaggacccggagccacgg

SEQ ID NO: 14925 - DNA, 20 bp, human
gctccggtccacagccacgg

SEQ ID NO: 14926 - DNA, 20 bp, human
ggtctgtgtgtgggactgag

SEQ ID NO: 14927 - DNA, 20 bp, human
gctgcgccctcactcatcag

SEQ ID NO: 14928 - DNA, 20 bp, human
gctcatcgcaggtgtcaagg

SEQ ID NO: 14929 - DNA, 20 bp, human
gggtgagtggctgtacacca

SEQ ID NO: 14930 - DNA, 20 bp, human
gtgacacctgcgatgaggaa

SEQ ID NO: 14931 - DNA, 20 bp, human
ggcgggcgggtgacgcgact

SEQ ID NO: 14932 - DNA, 20 bp, human
gggccgccacagccccggtc

SEQ ID NO: 14933 - DNA, 20 bp, human
gcccgcgggaagatgaataa

SEQ ID NO: 14934 - DNA, 20 bp, human
gcggtgggggctcccggtgg

SEQ ID NO: 14935 - DNA, 20 bp, human
gccggcggcagacgtcacca

SEQ ID NO: 14936 - DNA, 20 bp, human
gcggcccgccgtcccagacg

SEQ ID NO: 14937 - DNA, 20 bp, human
gtaatcggcagccgaggaac

SEQ ID NO: 14938 - DNA, 20 bp, human
gggaagcctcgggaaaccac

SEQ ID NO: 14939 - DNA, 20 bp, human
gcgggaagcaaggaagcctc

SEQ ID NO: 14940 - DNA, 20 bp, human
gcccagacgcgggaagagct

SEQ ID NO: 14941 - DNA, 20 bp, human
gcaggccagcgactcgaaac

SEQ ID NO: 14942 - DNA, 20 bp, human
gtcccgcgctgcagtcgggt

SEQ ID NO: 14943 - DNA, 20 bp, human
gactgcagcgcgggaacgga

SEQ ID NO: 14944 - DNA, 20 bp, human
ggacgcgggaagagcttggc

SEQ ID NO: 14945 - DNA, 20 bp, human
gcgggtcgcacagtttctgg

SEQ ID NO: 14946 - DNA, 20 bp, human
ggcgcctccctgctcctcgg

SEQ ID NO: 14947 - DNA, 20 bp, human
ggagctcccgggctccccca

SEQ ID NO: 14948 - DNA, 20 bp, human
gcaggtgggagtccaaacct

SEQ ID NO: 14949 - DNA, 20 bp, human
gcaaggctgaactccgtcca

SEQ ID NO: 14950 - DNA, 20 bp, human
gtggatctaatgcgcagagg

SEQ ID NO: 14951 - DNA, 20 bp, human
gggagaaggcgcgcgcggac

SEQ ID NO: 14952 - DNA, 20 bp, human
gtctaatgcgcagaggaggt

SEQ ID NO: 14953 - DNA, 20 bp, human
gccgggcccgcagctatctg

SEQ ID NO: 14954 - DNA, 20 bp, human
gaggatgtccctgatcagaa

SEQ ID NO: 14955 - DNA, 20 bp, human
gcatgccagcccgcagctag

SEQ ID NO: 14956 - DNA, 20 bp, human
gggcgacagcaaacctctgg

SEQ ID NO: 14957 - DNA, 20 bp, human
ggaagaaggcgccgtcccta

SEQ ID NO: 14958 - DNA, 20 bp, human
ggctgctgctgttggggcaa

SEQ ID NO: 14959 - DNA, 20 bp, human
ggcagcccaggcatgatgaa

SEQ ID NO: 14960 - DNA, 20 bp, human
gagggtgcacatgccgccag

SEQ ID NO: 14961 - DNA, 20 bp, human
gaggatacgctggtgctgta

SEQ ID NO: 14962 - DNA, 20 bp, human
gaagcggcggcaacattgtt

SEQ ID NO: 14963 - DNA, 20 bp, human
gtttcttcgctggttcgggg

SEQ ID NO: 14964 - DNA, 20 bp, human
gctaccagatgcggctccgg

SEQ ID NO: 14965 - DNA, 20 bp, human
ggcctgactcctaaaatccg

SEQ ID NO: 14966 - DNA, 20 bp, human
ggccgccacacgtacccagg

SEQ ID NO: 14967 - DNA, 20 bp, human
gacagccacctgggtacgtg

SEQ ID NO: 14968 - DNA, 20 bp, human
gggcccttccacagccacct

SEQ ID NO: 14969 - DNA, 20 bp, human
ggcgcagtcccgggttcgac

SEQ ID NO: 14970 - DNA, 20 bp, human
ggcggccgccacacgtaccc

SEQ ID NO: 14971 - DNA, 20 bp, human
gacagcgagctgaaccgcgg

SEQ ID NO: 14972 - DNA, 20 bp, human
ggccacctgggtacgtgtgg

SEQ ID NO: 14973 - DNA, 20 bp, human
ggagacagcgagctgaaccg

SEQ ID NO: 14974 - DNA, 20 bp, human
gcgggcgagctgctgaagtt

SEQ ID NO: 14975 - DNA, 20 bp, human
gcggagccacccgggcccaa

SEQ ID NO: 14976 - DNA, 20 bp, human
ggtggcagtgcatggtgagc

SEQ ID NO: 14977 - DNA, 20 bp, human
gcgcgagacaccagagcggg

SEQ ID NO: 14978 - DNA, 20 bp, human
gctgcgcgcctagtgcccgg

SEQ ID NO: 14979 - DNA, 20 bp, human
ggagcgcgagacaccagagc

SEQ ID NO: 14980 - DNA, 20 bp, human
ggacctgcgcgcctagtgcc

SEQ ID NO: 14981 - DNA, 20 bp, human
ggcactgccacgccgagctg

SEQ ID NO: 14982 - DNA, 20 bp, human
gaagatgctgatctgcgggt

SEQ ID NO: 14983 - DNA, 20 bp, human
ggatccgagggcgagaggaa

SEQ ID NO: 14984 - DNA, 20 bp, human
gctgcgcctcagcaagcggt

SEQ ID NO: 14985 - DNA, 20 bp, human
ggcgcaggtcggcgccggag

SEQ ID NO: 14986 - DNA, 20 bp, human
ggcgagcgcgagaaatgcag

SEQ ID NO: 14987 - DNA, 20 bp, human
gcccggagcgaggagccagt

SEQ ID NO: 14988 - DNA, 20 bp, human
gctctctcccggctcgacgg

SEQ ID NO: 14989 - DNA, 20 bp, human
ggcggcggcagcgctccaac

SEQ ID NO: 14990 - DNA, 20 bp, human
gaggctctctcccggctcga

SEQ ID NO: 14991 - DNA, 20 bp, human
gcggcaccgcgctaactcag

SEQ ID NO: 14992 - DNA, 20 bp, human
gagccgctcgcatggtggag

SEQ ID NO: 14993 - DNA, 20 bp, human
gtaggcacccagagccggta

SEQ ID NO: 14994 - DNA, 20 bp, human
gaggagctgcgggtgacggg

SEQ ID NO: 14995 - DNA, 20 bp, human
gtgcgacggagccctcacag

SEQ ID NO: 14996 - DNA, 20 bp, human
gcagagtgaggaggacgcag

SEQ ID NO: 14997 - DNA, 20 bp, human
gccctctgcaccccagagtg

SEQ ID NO: 14998 - DNA, 20 bp, human
gcagagggactgctccccaa

SEQ ID NO: 14999 - DNA, 20 bp, human
gaggaggacgcaggggtcag

SEQ ID NO: 15000 - DNA, 20 bp, human
gaggaagtggctcgttgcac

SEQ ID NO: 15001 - DNA, 20 bp, human
gctctgttagacttaggaca

SEQ ID NO: 15002 - DNA, 20 bp, human
gtcagaggtggctacagggc

SEQ ID NO: 15003 - DNA, 20 bp, human
gaggcagaggaggcacctgt

SEQ ID NO: 15004 - DNA, 20 bp, human
gcgggcactctgttagactt

SEQ ID NO: 15005 - DNA, 20 bp, human
gctcacgctggaagtcacat

SEQ ID NO: 15006 - DNA, 20 bp, human
gaagccatgcacctctgtgg

SEQ ID NO: 15007 - DNA, 20 bp, human
gctctggaggcctaaggaag

SEQ ID NO: 15008 - DNA, 20 bp, human
gcagcccattgcccccacag

SEQ ID NO: 15009 - DNA, 20 bp, human
gcagaggtgcatggcttagg

SEQ ID NO: 15010 - DNA, 20 bp, human
gaggtgcatggcttaggcgg

SEQ ID NO: 15011 - DNA, 20 bp, human
gcttaggcgggggagcagag

SEQ ID NO: 15012 - DNA, 20 bp, human
gggagagagcaagtacacag

SEQ ID NO: 15013 - DNA, 20 bp, human
gctctgagcagtgtgacaga

SEQ ID NO: 15014 - DNA, 20 bp, human
gcggcagataacatgaggtt

SEQ ID NO: 15015 - DNA, 20 bp, human
gtgagccggcctgggttatt

SEQ ID NO: 15016 - DNA, 20 bp, human
gtgcggccggagacaagcag

SEQ ID NO: 15017 - DNA, 20 bp, human
gggacactgtgcgcacgaca

SEQ ID NO: 15018 - DNA, 20 bp, human
gccggagacaagcagaggta

SEQ ID NO: 15019 - DNA, 20 bp, human
ggagagcgggaagcctgagg

SEQ ID NO: 15020 - DNA, 20 bp, human
gactggcgcgcggggacact

SEQ ID NO: 15021 - DNA, 20 bp, human
gagcgcccggcatgtcgcaa

SEQ ID NO: 15022 - DNA, 20 bp, human
ggggccgacgcgtggagtag

SEQ ID NO: 15023 - DNA, 20 bp, human
gagttccgtggtggtgactg

SEQ ID NO: 15024 - DNA, 20 bp, human
ggtcctgcagaggagcgtcg

SEQ ID NO: 15025 - DNA, 20 bp, human
gcgctggctgcgccaggatg

SEQ ID NO: 15026 - DNA, 20 bp, human
gggctggcagcgcccgatcc

SEQ ID NO: 15027 - DNA, 20 bp, human
gcggtaggaaggatcccgga

SEQ ID NO: 15028 - DNA, 20 bp, human
ggcgatctccaagcactgag

SEQ ID NO: 15029 - DNA, 20 bp, human
gcgggagcggcggtgatgga

SEQ ID NO: 15030 - DNA, 20 bp, human
gcccctcccaccagtgccag

SEQ ID NO: 15031 - DNA, 20 bp, human
gtcctgcctctggcactggt

SEQ ID NO: 15032 - DNA, 20 bp, human
gtccccggggaaagaggcta

SEQ ID NO: 15033 - DNA, 20 bp, human
gcctctcgccgggtccgcgc

SEQ ID NO: 15034 - DNA, 20 bp, human
ggcggccgcccgcgcggacc

SEQ ID NO: 15035 - DNA, 20 bp, human
gtcggaccctcgagaaccag

SEQ ID NO: 15036 - DNA, 20 bp, human
gacttcccaggagctccgag

SEQ ID NO: 15037 - DNA, 20 bp, human
gccgagaggcggggaagtgg

SEQ ID NO: 15038 - DNA, 20 bp, human
gggcaggacgagaggaggta

SEQ ID NO: 15039 - DNA, 20 bp, human
gctgccgccgcctcacaatg

SEQ ID NO: 15040 - DNA, 20 bp, human
gccaggagctccgagaggcg

SEQ ID NO: 15041 - DNA, 20 bp, human
ggaggcggggaagtggcggt

SEQ ID NO: 15042 - DNA, 20 bp, human
ggcggcggcaggacgagagg

SEQ ID NO: 15043 - DNA, 20 bp, human
ggtcctgccccattgtgagg

SEQ ID NO: 15044 - DNA, 20 bp, human
gggcgtcctgccccattgtg

SEQ ID NO: 15045 - DNA, 20 bp, human
gcccgcgcggagtcgggcag

SEQ ID NO: 15046 - DNA, 20 bp, human
gtcctcctcagcagcaccgg

SEQ ID NO: 15047 - DNA, 20 bp, human
gcgggcaacggcttcaccag

SEQ ID NO: 15048 - DNA, 20 bp, human
ggtgaagccgttgcccggag

SEQ ID NO: 15049 - DNA, 20 bp, human
gcggccgccgggacccgaag

SEQ ID NO: 15050 - DNA, 20 bp, human
gacggcttcaccagcgggaa

SEQ ID NO: 15051 - DNA, 20 bp, human
ggaaggcctcctgagtgtgc

SEQ ID NO: 15052 - DNA, 20 bp, human
gcgggacccgaagcggaggt

SEQ ID NO: 15053 - DNA, 20 bp, human
ggcggctcctctccgggcaa

SEQ ID NO: 15054 - DNA, 20 bp, human
ggcctcctgagtgtgcggga

SEQ ID NO: 15055 - DNA, 20 bp, human
ggtcatggagcggaacgcca

SEQ ID NO: 15056 - DNA, 20 bp, human
gcgcgctccgggcgccagaa

SEQ ID NO: 15057 - DNA, 20 bp, human
gggagccccgctttcatccg

SEQ ID NO: 15058 - DNA, 20 bp, human
gctccgggcgccagaacggg

SEQ ID NO: 15059 - DNA, 20 bp, human
gcctcccccgccggccatgt

SEQ ID NO: 15060 - DNA, 20 bp, human
ggagccaacatggccggcgg

SEQ ID NO: 15061 - DNA, 20 bp, human
ggggggacgcggctcaaccg

SEQ ID NO: 15062 - DNA, 20 bp, human
ggctcccggcgacagtgagg

SEQ ID NO: 15063 - DNA, 20 bp, human
gctgctgaggaccccggacg

SEQ ID NO: 15064 - DNA, 20 bp, human
gggagaccctcgcctcgggt

SEQ ID NO: 15065 - DNA, 20 bp, human
gccgctggggagggggtctg

SEQ ID NO: 15066 - DNA, 20 bp, human
gcacagcctgaactgctgta

SEQ ID NO: 15067 - DNA, 20 bp, human
gaccacgggatcctgagtat

SEQ ID NO: 15068 - DNA, 20 bp, human
gtccctggctgactcagcag

SEQ ID NO: 15069 - DNA, 20 bp, human
ggcaggggcaatcctccacg

SEQ ID NO: 15070 - DNA, 20 bp, human
gagctgtgccagcctgacat

SEQ ID NO: 15071 - DNA, 20 bp, human
gtgagacgcatcttaggcca

SEQ ID NO: 15072 - DNA, 20 bp, human
gtagcgaggctgccgaccac

SEQ ID NO: 15073 - DNA, 20 bp, human
ggtccctgtgtgacagactg

SEQ ID NO: 15074 - DNA, 20 bp, human
gggggcaatcctccacgggg

SEQ ID NO: 15075 - DNA, 20 bp, human
gatccctcaggccttccccg

SEQ ID NO: 15076 - DNA, 20 bp, human
ggaccggcgaggataaacag

SEQ ID NO: 15077 - DNA, 20 bp, human
ggagccgcgaaagagaacgg

SEQ ID NO: 15078 - DNA, 20 bp, human
gacagcggcggagggcgaga

SEQ ID NO: 15079 - DNA, 20 bp, human
gcggcgaggataaacagcgg

SEQ ID NO: 15080 - DNA, 20 bp, human
gctccggagttgctgcgtgg

SEQ ID NO: 15081 - DNA, 20 bp, human
gaagccggtggaaacagcag

SEQ ID NO: 15082 - DNA, 20 bp, human
gagagcctccagctacacac

SEQ ID NO: 15083 - DNA, 20 bp, human
gcggccgggagcacaaccca

SEQ ID NO: 15084 - DNA, 20 bp, human
gagggcggccggcacaaagg

SEQ ID NO: 15085 - DNA, 20 bp, human
ggccagggcggccggcacaa

SEQ ID NO: 15086 - DNA, 20 bp, human
ggcaccagcgatcccagcag

SEQ ID NO: 15087 - DNA, 20 bp, human
gagggtcgccgggtgagagg

SEQ ID NO: 15088 - DNA, 20 bp, human
gcccagcagcggccacgacg

SEQ ID NO: 15089 - DNA, 20 bp, human
ggcgcgcacactcaccccgg

SEQ ID NO: 15090 - DNA, 20 bp, human
gtggccgctgctgggatcgc

SEQ ID NO: 15091 - DNA, 20 bp, human
gcatgcgagcgggcgcctgg

SEQ ID NO: 15092 - DNA, 20 bp, human
gtccctcgcggggtttggag

SEQ ID NO: 15093 - DNA, 20 bp, human
gggagaggcgcggtgtgggg

SEQ ID NO: 15094 - DNA, 20 bp, human
gggcacctgtgcgcccagac

SEQ ID NO: 15095 - DNA, 20 bp, human
gggcatgaacacgccggagg

SEQ ID NO: 15096 - DNA, 20 bp, human
gccccgggtaacggtgagac

SEQ ID NO: 15097 - DNA, 20 bp, human
gcagctgttgccccgggtaa

SEQ ID NO: 15098 - DNA, 20 bp, human
gagacggcgtagaggaactg

SEQ ID NO: 15099 - DNA, 20 bp, human
gagagcggcctcaccccaca

SEQ ID NO: 15100 - DNA, 20 bp, human
gcgggccggacggtccctgt

SEQ ID NO: 15101 - DNA, 20 bp, human
gcagggccgcttccgttgga

SEQ ID NO: 15102 - DNA, 20 bp, human
gccccacagggagcctcacg

SEQ ID NO: 15103 - DNA, 20 bp, human
ggtgggacagagcgctgaaa

SEQ ID NO: 15104 - DNA, 20 bp, human
ggtccgtggaccccaaccag

SEQ ID NO: 15105 - DNA, 20 bp, human
gctgtagcccggctagccag

SEQ ID NO: 15106 - DNA, 20 bp, human
gcagtgttaaaaggaatctc

SEQ ID NO: 15107 - DNA, 20 bp, human
gctcctgaagaccggaaaca

SEQ ID NO: 15108 - DNA, 20 bp, human
gccaagtactatacaaacgt

SEQ ID NO: 15109 - DNA, 20 bp, human
gatggcttgtaccatccaaa

SEQ ID NO: 15110 - DNA, 20 bp, human
gtattgaacttgagaaagaa

SEQ ID NO: 15111 - DNA, 20 bp, human
gacaaacgtgggttcatatg

SEQ ID NO: 15112 - DNA, 20 bp, human
gggcagataagatctaaact

SEQ ID NO: 15113 - DNA, 20 bp, human
gatgacaaatcagtgttaaa

SEQ ID NO: 15114 - DNA, 20 bp, human
gccaggtagcaatcagagca

SEQ ID NO: 15115 - DNA, 20 bp, human
gaacactgatttgtcatagc

SEQ ID NO: 15116 - DNA, 20 bp, human
gcagaatgctccctctccaa

SEQ ID NO: 15117 - DNA, 20 bp, human
ggtccttagatcctttggag

SEQ ID NO: 15118 - DNA, 20 bp, human
ggggcaaggaggattctggt

SEQ ID NO: 15119 - DNA, 20 bp, human
ggctgtctaaaaagagactg

SEQ ID NO: 15120 - DNA, 20 bp, human
ggatggggcaaggaggattc

SEQ ID NO: 15121 - DNA, 20 bp, human
gcacatcagattggaaactg

SEQ ID NO: 15122 - DNA, 20 bp, human
gctttggtccttagatcctt

SEQ ID NO: 15123 - DNA, 20 bp, human
gatgggttgtggattattca

SEQ ID NO: 15124 - DNA, 20 bp, human
ggtctgtggactgaggtggt

SEQ ID NO: 15125 - DNA, 20 bp, human
ggtaaagaaactgtcagctt

SEQ ID NO: 15126 - DNA, 20 bp, human
gcccaatagtgcccgagcac

SEQ ID NO: 15127 - DNA, 20 bp, human
gcgacgcctgcggagctgag

SEQ ID NO: 15128 - DNA, 20 bp, human
gcaggcgtcggaatccgatg

SEQ ID NO: 15129 - DNA, 20 bp, human
ggaatccgatgaggacgcag

SEQ ID NO: 15130 - DNA, 20 bp, human
gtggttccagagactcacct

SEQ ID NO: 15131 - DNA, 20 bp, human
gatggccgctgcgtcctcat

SEQ ID NO: 15132 - DNA, 20 bp, human
gtcgctcggtgagccagtgg

SEQ ID NO: 15133 - DNA, 20 bp, human
gcccagagcccggggaccaa

SEQ ID NO: 15134 - DNA, 20 bp, human
gcccatcccactagaaccca

SEQ ID NO: 15135 - DNA, 20 bp, human
gacgcagcggccatcttcgc

SEQ ID NO: 15136 - DNA, 20 bp, human
gccgggccgaccgaaaacag

SEQ ID NO: 15137 - DNA, 20 bp, human
gctgcaagctggtcaaaaag

SEQ ID NO: 15138 - DNA, 20 bp, human
gtaagtgtagcgcctccagg

SEQ ID NO: 15139 - DNA, 20 bp, human
ggccgctgcagggtctgtga

SEQ ID NO: 15140 - DNA, 20 bp, human
ggccgaccgaaaacaggggt

SEQ ID NO: 15141 - DNA, 20 bp, human
ggctggtcaaaaaggggaag

SEQ ID NO: 15142 - DNA, 20 bp, human
gcaggaggcggcctccattc

SEQ ID NO: 15143 - DNA, 20 bp, human
ggaacggccggaaacggaat

SEQ ID NO: 15144 - DNA, 20 bp, human
ggacgcgggtacctggctat

SEQ ID NO: 15145 - DNA, 20 bp, human
ggaccagcttgcagaacacc

SEQ ID NO: 15146 - DNA, 20 bp, human
gatccctgcccaaaacaggg

SEQ ID NO: 15147 - DNA, 20 bp, human
gaaactgcggacggggaact

SEQ ID NO: 15148 - DNA, 20 bp, human
ggaactgggctccctagccc

SEQ ID NO: 15149 - DNA, 20 bp, human
gagaatccctgcccaaaaca

SEQ ID NO: 15150 - DNA, 20 bp, human
gcatgcgcaaactgcggacg

SEQ ID NO: 15151 - DNA, 20 bp, human
gagcaacaccaaaaacgcca

SEQ ID NO: 15152 - DNA, 20 bp, human
ggggaactccagccccctgt

SEQ ID NO: 15153 - DNA, 20 bp, human
gatgtggctaggagtactag

SEQ ID NO: 15154 - DNA, 20 bp, human
gagtgtcgttggagggacgt

SEQ ID NO: 15155 - DNA, 20 bp, human
gaccaaaaacgccagggcta

SEQ ID NO: 15156 - DNA, 20 bp, human
ggagcaggcggtacctggac

SEQ ID NO: 15157 - DNA, 20 bp, human
gaccggttgccgggcaacac

SEQ ID NO: 15158 - DNA, 20 bp, human
ggccggacgcgaaacagccc

SEQ ID NO: 15159 - DNA, 20 bp, human
gcgcgcagccgcaaaaagag

SEQ ID NO: 15160 - DNA, 20 bp, human
ggcagtttcagggtgaacac

SEQ ID NO: 15161 - DNA, 20 bp, human
gccggtcggcgagcaccttg

SEQ ID NO: 15162 - DNA, 20 bp, human
gccatcctgcagaggacagt

SEQ ID NO: 15163 - DNA, 20 bp, human
gacctggacgggttcgtccc

SEQ ID NO: 15164 - DNA, 20 bp, human
ggcccgggacgaacccgtcc

SEQ ID NO: 15165 - DNA, 20 bp, human
gagccgcaaaaagagcggac

SEQ ID NO: 15166 - DNA, 20 bp, human
ggctgaggagagagtcgcga

SEQ ID NO: 15167 - DNA, 20 bp, human
ggcagggcaaggcaagctgg

SEQ ID NO: 15168 - DNA, 20 bp, human
ggtgccgagcgtctcagggt

SEQ ID NO: 15169 - DNA, 20 bp, human
gccccaggcgaccagttccc

SEQ ID NO: 15170 - DNA, 20 bp, human
gcttccggccgcgcagcggt

SEQ ID NO: 15171 - DNA, 20 bp, human
gcttgccttgccctgcggcc

SEQ ID NO: 15172 - DNA, 20 bp, human
gagtgacgctgcaagcttcc

SEQ ID NO: 15173 - DNA, 20 bp, human
gaaacacagtcccgctccac

SEQ ID NO: 15174 - DNA, 20 bp, human
ggtcccgctccactggcaga

SEQ ID NO: 15175 - DNA, 20 bp, human
gcgtcactgccttctgccag

SEQ ID NO: 15176 - DNA, 20 bp, human
ggccgtagacgtcgtgacag

SEQ ID NO: 15177 - DNA, 20 bp, human
gggggaaccggaggtcgcat

SEQ ID NO: 15178 - DNA, 20 bp, human
gcgccgcggcaagagcgcat

SEQ ID NO: 15179 - DNA, 20 bp, human
ggccaggatgggggaaccgg

SEQ ID NO: 15180 - DNA, 20 bp, human
gagctcacgtgggtgtatac

SEQ ID NO: 15181 - DNA, 20 bp, human
gctggcccgcgggacggatc

SEQ ID NO: 15182 - DNA, 20 bp, human
gcagctcgcggccctggtga

SEQ ID NO: 15183 - DNA, 20 bp, human
gcacggcggcgccctctaca

SEQ ID NO: 15184 - DNA, 20 bp, human
ggcctctgtcacgacgtcta

SEQ ID NO: 15185 - DNA, 20 bp, human
gagctaggcctgcacggctg

SEQ ID NO: 15186 - DNA, 20 bp, human
ggacctaggcgcggtagctg

SEQ ID NO: 15187 - DNA, 20 bp, human
gctgcacaggcggggcgaca

SEQ ID NO: 15188 - DNA, 20 bp, human
ggctaccgcgcctaggtcct

SEQ ID NO: 15189 - DNA, 20 bp, human
gcctgtgcagcccaggacct

SEQ ID NO: 15190 - DNA, 20 bp, human
gggcctccgacccagtcaga

SEQ ID NO: 15191 - DNA, 20 bp, human
gcgaggggaccggggaaaag

SEQ ID NO: 15192 - DNA, 20 bp, human
ggcagcccaggacctaggcg

SEQ ID NO: 15193 - DNA, 20 bp, human
ggcgccggacaagaacagga

SEQ ID NO: 15194 - DNA, 20 bp, human
gacgaaagggagctgcccaa

SEQ ID NO: 15195 - DNA, 20 bp, human
gcggcagaagccagtaccgt

SEQ ID NO: 15196 - DNA, 20 bp, human
ggagggttcgcagaaaggtg

SEQ ID NO: 15197 - DNA, 20 bp, human
gggatgtagcagaaacccga

SEQ ID NO: 15198 - DNA, 20 bp, human
gggtcccagtgatggagcag

SEQ ID NO: 15199 - DNA, 20 bp, human
gcccgacggccgcagcggaa

SEQ ID NO: 15200 - DNA, 20 bp, human
gagaaacccgacggccgcag

SEQ ID NO: 15201 - DNA, 20 bp, human
gtatgacaacagggcgaaga

SEQ ID NO: 15202 - DNA, 20 bp, human
gccatcactgggaccttgtc

SEQ ID NO: 15203 - DNA, 20 bp, human
gcagagggagcaagaacgga

SEQ ID NO: 15204 - DNA, 20 bp, human
ggggcagagctcatctgacg

SEQ ID NO: 15205 - DNA, 20 bp, human
ggagggaatagtgaagctaa

SEQ ID NO: 15206 - DNA, 20 bp, human
ggcagtgtacagtgaagcgg

SEQ ID NO: 15207 - DNA, 20 bp, human
gagccctcagcggccagtca

SEQ ID NO: 15208 - DNA, 20 bp, human
ggaaagtggagagaagctcg

SEQ ID NO: 15209 - DNA, 20 bp, human
gggagcagtgtacagtgaag

SEQ ID NO: 15210 - DNA, 20 bp, human
ggtgtgtagctagccctcag

SEQ ID NO: 15211 - DNA, 20 bp, human
gccagtcagggtttctctat

SEQ ID NO: 15212 - DNA, 20 bp, human
ggcagtgccctgcgagcggg

SEQ ID NO: 15213 - DNA, 20 bp, human
gtgcaaacgcagcctggcac

SEQ ID NO: 15214 - DNA, 20 bp, human
gggccgggctggggagtagt

SEQ ID NO: 15215 - DNA, 20 bp, human
gaaccctgactggccgctga

SEQ ID NO: 15216 - DNA, 20 bp, human
gcctgggccggtgcgtccgg

SEQ ID NO: 15217 - DNA, 20 bp, human
ggggggctccatgttcacgg

SEQ ID NO: 15218 - DNA, 20 bp, human
gggctccatgttcacggcgg

SEQ ID NO: 15219 - DNA, 20 bp, human
gccccaaggaggagggatat

SEQ ID NO: 15220 - DNA, 20 bp, human
gatggagcccccggacgcac

SEQ ID NO: 15221 - DNA, 20 bp, human
ggctagaatagcttccccca

SEQ ID NO: 15222 - DNA, 20 bp, human
gccgggaaagcgaggagaaa

SEQ ID NO: 15223 - DNA, 20 bp, human
gccagggctctctccctcaa

SEQ ID NO: 15224 - DNA, 20 bp, human
gtccatgttcacggcggcgg

SEQ ID NO: 15225 - DNA, 20 bp, human
gtccgggggctccatgttca

SEQ ID NO: 15226 - DNA, 20 bp, human
gactgcgcgagcgtgaggag

SEQ ID NO: 15227 - DNA, 20 bp, human
ggaagatgcgaggacccgag

SEQ ID NO: 15228 - DNA, 20 bp, human
ggactgagccgtgcacccgg

SEQ ID NO: 15229 - DNA, 20 bp, human
gggaggcactcacctaccca

SEQ ID NO: 15230 - DNA, 20 bp, human
ggtctgatcagcaacccctc

SEQ ID NO: 15231 - DNA, 20 bp, human
gcccttgcctcgaggctctg

SEQ ID NO: 15232 - DNA, 20 bp, human
gacaaggtcggaaatctcgg

SEQ ID NO: 15233 - DNA, 20 bp, human
gacggaggcaaggactgatc

SEQ ID NO: 15234 - DNA, 20 bp, human
ggctggggccgcaggacatt

SEQ ID NO: 15235 - DNA, 20 bp, human
gtcctccgggggtctcctcc

SEQ ID NO: 15236 - DNA, 20 bp, human
gctacgccccacgggtcccc

SEQ ID NO: 15237 - DNA, 20 bp, human
gtgcttgccttcccaggtgg

SEQ ID NO: 15238 - DNA, 20 bp, human
gcgcagaagcccttacccgc

SEQ ID NO: 15239 - DNA, 20 bp, human
gggctccctgcgctgctccg

SEQ ID NO: 15240 - DNA, 20 bp, human
ggcaagcacggaccccggtc

SEQ ID NO: 15241 - DNA, 20 bp, human
gcacggaccccggtcaggaa

SEQ ID NO: 15242 - DNA, 20 bp, human
gtgcgacccggggacccgtg

SEQ ID NO: 15243 - DNA, 20 bp, human
gtacccgccggcagcccgcc

SEQ ID NO: 15244 - DNA, 20 bp, human
ggttcccacgactcccaggg

SEQ ID NO: 15245 - DNA, 20 bp, human
gcgcgggacgtcagacgccg

SEQ ID NO: 15246 - DNA, 20 bp, human
gagcacctcaaggccccata

SEQ ID NO: 15247 - DNA, 20 bp, human
ggcccgcgagggctactgta

SEQ ID NO: 15248 - DNA, 20 bp, human
ggattcgggaccaagcgcaa

SEQ ID NO: 15249 - DNA, 20 bp, human
ggggcctgcacgttgactgt

SEQ ID NO: 15250 - DNA, 20 bp, human
gcgcaagagcgactcctaga

SEQ ID NO: 15251 - DNA, 20 bp, human
ggggctactgtaaggacccc

SEQ ID NO: 15252 - DNA, 20 bp, human
ggtctcgaccaagcacctca

SEQ ID NO: 15253 - DNA, 20 bp, human
gtttccggccgcggtatgag

SEQ ID NO: 15254 - DNA, 20 bp, human
ggccgctggatcctcgaggg

SEQ ID NO: 15255 - DNA, 20 bp, human
gctctagaagctggtctcgg

SEQ ID NO: 15256 - DNA, 20 bp, human
ggacacaggaaccctcctac

SEQ ID NO: 15257 - DNA, 20 bp, human
gggccgggcatgctgggatc

SEQ ID NO: 15258 - DNA, 20 bp, human
gcaacgcacccgaggcgcac

SEQ ID NO: 15259 - DNA, 20 bp, human
gctggaaggggttaagcgag

SEQ ID NO: 15260 - DNA, 20 bp, human
gagggcagaaggagatccca

SEQ ID NO: 15261 - DNA, 20 bp, human
gtacgcggcccggccccacc

SEQ ID NO: 15262 - DNA, 20 bp, human
gggccccgccaacgcacccg

SEQ ID NO: 15263 - DNA, 20 bp, human
gcaggaaccctcctaccggc

SEQ ID NO: 15264 - DNA, 20 bp, human
gtgacacagcaggcggccgt

SEQ ID NO: 15265 - DNA, 20 bp, human
gcgctctccgcctgccgcca

SEQ ID NO: 15266 - DNA, 20 bp, human
ggggaacgctcaggagccgg

SEQ ID NO: 15267 - DNA, 20 bp, human
ggtccgcccgcgccgctcag

SEQ ID NO: 15268 - DNA, 20 bp, human
gcccccaagatggctaggtc

SEQ ID NO: 15269 - DNA, 20 bp, human
gccggcgtccgggaacgctc

SEQ ID NO: 15270 - DNA, 20 bp, human
gcccagtccgggagccaacg

SEQ ID NO: 15271 - DNA, 20 bp, human
gaaagcgccgggacccctcg

SEQ ID NO: 15272 - DNA, 20 bp, human
gtggtccccgggaaacccct

SEQ ID NO: 15273 - DNA, 20 bp, human
gcggaggagccggaaagcgc

SEQ ID NO: 15274 - DNA, 20 bp, human
gctggagcggccggacagtc

SEQ ID NO: 15275 - DNA, 20 bp, human
gccaggaccccgcaccagga

SEQ ID NO: 15276 - DNA, 20 bp, human
gggcgggggtgactgaagtg

SEQ ID NO: 15277 - DNA, 20 bp, human
gcgggaggaacagcaccccg

SEQ ID NO: 15278 - DNA, 20 bp, human
ggagtcccagcgcgctcgga

SEQ ID NO: 15279 - DNA, 20 bp, human
gggtagggaccaacaaacgc

SEQ ID NO: 15280 - DNA, 20 bp, human
ggcggcggagactcacctcc

SEQ ID NO: 15281 - DNA, 20 bp, human
gacgcgcgcgggattctcgg

SEQ ID NO: 15282 - DNA, 20 bp, human
gcccgagacgtggcccacgg

SEQ ID NO: 15283 - DNA, 20 bp, human
gcccgccgtgggccacgtct

SEQ ID NO: 15284 - DNA, 20 bp, human
gtagacgcgcgcgggattct

SEQ ID NO: 15285 - DNA, 20 bp, human
ggagccggcggcgcgcactc

SEQ ID NO: 15286 - DNA, 20 bp, human
ggcctgggcctgcaactctg

SEQ ID NO: 15287 - DNA, 20 bp, human
gagcggccgccggagagacc

SEQ ID NO: 15288 - DNA, 20 bp, human
gcccgcctaccaggtctctc

SEQ ID NO: 15289 - DNA, 20 bp, human
gcggcaagacgagctctcgg

SEQ ID NO: 15290 - DNA, 20 bp, human
gagctgcgcggcgtccttgg

SEQ ID NO: 15291 - DNA, 20 bp, human
ggcccggcttaacggtgcaa

SEQ ID NO: 15292 - DNA, 20 bp, human
gaccccagagttgcaggccc

SEQ ID NO: 15293 - DNA, 20 bp, human
gcgtaaaggcccggcgtcac

SEQ ID NO: 15294 - DNA, 20 bp, human
gacggtgcaacggctggcct

SEQ ID NO: 15295 - DNA, 20 bp, human
gccggggcccgcgactgcgt

SEQ ID NO: 15296 - DNA, 20 bp, human
gccaccgacagccaggcact

SEQ ID NO: 15297 - DNA, 20 bp, human
gggcactgggcagcacgcac

SEQ ID NO: 15298 - DNA, 20 bp, human
gcagctccgggtgacacgag

SEQ ID NO: 15299 - DNA, 20 bp, human
gtaggcaatgcctgaggtga

SEQ ID NO: 15300 - DNA, 20 bp, human
ggaatctgagccttcacctc

SEQ ID NO: 15301 - DNA, 20 bp, human
ggactgaagatactcccaca

SEQ ID NO: 15302 - DNA, 20 bp, human
gtggctgaatacacagagca

SEQ ID NO: 15303 - DNA, 20 bp, human
gaggccacacagtgaacaga

SEQ ID NO: 15304 - DNA, 20 bp, human
gggtagacggtgtcatatag

SEQ ID NO: 15305 - DNA, 20 bp, human
ggcacaaggaagcaaagtgc

SEQ ID NO: 15306 - DNA, 20 bp, human
gacgcagacgcagaaaacgc

SEQ ID NO: 15307 - DNA, 20 bp, human
gtcctcagaatggcgggcac

SEQ ID NO: 15308 - DNA, 20 bp, human
ggtagtagctatgcaggcaa

SEQ ID NO: 15309 - DNA, 20 bp, human
gaggtaagtagtagctatgc

SEQ ID NO: 15310 - DNA, 20 bp, human
ggctgcagcgctggtggagg

SEQ ID NO: 15311 - DNA, 20 bp, human
gtactacttacctactgtat

SEQ ID NO: 15312 - DNA, 20 bp, human
gatagggaccagggtagaag

SEQ ID NO: 15313 - DNA, 20 bp, human
gtgcaggcaatggttaaaac

SEQ ID NO: 15314 - DNA, 20 bp, human
gaccgcttcccgcacaccag

SEQ ID NO: 15315 - DNA, 20 bp, human
gcaagacatacttacttcaa

SEQ ID NO: 15316 - DNA, 20 bp, human
ggccctgccagccctctcac

SEQ ID NO: 15317 - DNA, 20 bp, human
ggctgaggcgtggtaggaag

SEQ ID NO: 15318 - DNA, 20 bp, human
ggaggtgcaggtatcctctg

SEQ ID NO: 15319 - DNA, 20 bp, human
ggtgcaggtatcctctgagg

SEQ ID NO: 15320 - DNA, 20 bp, human
gtccgtgttggaggttaagt

SEQ ID NO: 15321 - DNA, 20 bp, human
gggctgccgtcaatcactcg

SEQ ID NO: 15322 - DNA, 20 bp, human
gagactagcgttaaccggcg

SEQ ID NO: 15323 - DNA, 20 bp, human
gcaaacagtgagcctagagc

SEQ ID NO: 15324 - DNA, 20 bp, human
gctagcgttaaccggcgggg

SEQ ID NO: 15325 - DNA, 20 bp, human
gggcggggcggccggtgaga

SEQ ID NO: 15326 - DNA, 20 bp, human
ggaggcccgggcgcaaccac

SEQ ID NO: 15327 - DNA, 20 bp, human
gtccacgagcagcatcagga

SEQ ID NO: 15328 - DNA, 20 bp, human
ggcggcgcctgaggacccgg

SEQ ID NO: 15329 - DNA, 20 bp, human
gcagcatcaggagggcgacg

SEQ ID NO: 15330 - DNA, 20 bp, human
gcaccgctcggaggtagccg

SEQ ID NO: 15331 - DNA, 20 bp, human
gtgccccggctacctccgag

SEQ ID NO: 15332 - DNA, 20 bp, human
gagggcggcgcctgaggacc

SEQ ID NO: 15333 - DNA, 20 bp, human
gggcgcaaccacgggctccc

SEQ ID NO: 15334 - DNA, 20 bp, human
gcggcccgggcaccgctcgg

SEQ ID NO: 15335 - DNA, 20 bp, human
gacctcggccccaggctcgg

SEQ ID NO: 15336 - DNA, 20 bp, human
gccggctgcagcaagacctg

SEQ ID NO: 15337 - DNA, 20 bp, human
gcggcggcgagtacacgtgg

SEQ ID NO: 15338 - DNA, 20 bp, human
ggagggaagctcgagctgag

SEQ ID NO: 15339 - DNA, 20 bp, human
gaggcacgtcctgcgagtgg

SEQ ID NO: 15340 - DNA, 20 bp, human
ggccgtgtggaccgggtctg

SEQ ID NO: 15341 - DNA, 20 bp, human
ggccgcagacccggtccaca

SEQ ID NO: 15342 - DNA, 20 bp, human
gagaaggcacgtcctgcgag

SEQ ID NO: 15343 - DNA, 20 bp, human
gaatgtgaaaaagtccgaga

SEQ ID NO: 15344 - DNA, 20 bp, human
gacccggtccacacggccag

SEQ ID NO: 15345 - DNA, 20 bp, human
gcatcagcaggaagacacta

SEQ ID NO: 15346 - DNA, 20 bp, human
gcatggccgcagccgctctg

SEQ ID NO: 15347 - DNA, 20 bp, human
ggctgcggccatgatccgtg

SEQ ID NO: 15348 - DNA, 20 bp, human
gcagggccgggtgcaggtga

SEQ ID NO: 15349 - DNA, 20 bp, human
ggggtctgggaaataaccgg

SEQ ID NO: 15350 - DNA, 20 bp, human
gaaaggggcccagacctcca

SEQ ID NO: 15351 - DNA, 20 bp, human
gggtagacgcggatgaggtg

SEQ ID NO: 15352 - DNA, 20 bp, human
ggccctgcagcggaacccca

SEQ ID NO: 15353 - DNA, 20 bp, human
gtgtgcgggagctggaataa

SEQ ID NO: 15354 - DNA, 20 bp, human
gttacgcgccgcacggatca

SEQ ID NO: 15355 - DNA, 20 bp, human
gggttcgcagccccgcgccg

SEQ ID NO: 15356 - DNA, 20 bp, human
gcggcgtgccgtggaaagtg

SEQ ID NO: 15357 - DNA, 20 bp, human
gtgcggaaccccactttcca

SEQ ID NO: 15358 - DNA, 20 bp, human
gacggcacgccgcttagacc

SEQ ID NO: 15359 - DNA, 20 bp, human
ggtggccgattcaggatctg

SEQ ID NO: 15360 - DNA, 20 bp, human
gtcctcgtcgcgctggactg

SEQ ID NO: 15361 - DNA, 20 bp, human
gcgcagtgtgagcggcaaca

SEQ ID NO: 15362 - DNA, 20 bp, human
gcgcgctggactgggggatc

SEQ ID NO: 15363 - DNA, 20 bp, human
ggtccagcgcgacgaggaag

SEQ ID NO: 15364 - DNA, 20 bp, human
ggagcggcaacatggcgtcc

SEQ ID NO: 15365 - DNA, 20 bp, human
gatcctgaatcggccacccc

SEQ ID NO: 15366 - DNA, 20 bp, human
gagtgttaaggagaccgcag

SEQ ID NO: 15367 - DNA, 20 bp, human
gtccctccatccagttccgt

SEQ ID NO: 15368 - DNA, 20 bp, human
gcggttccgccacggcccag

SEQ ID NO: 15369 - DNA, 20 bp, human
gtcagggccagaccccaggt

SEQ ID NO: 15370 - DNA, 20 bp, human
gaggctaatggcggtgccca

SEQ ID NO: 15371 - DNA, 20 bp, human
gagattcctaagacagatgg

SEQ ID NO: 15372 - DNA, 20 bp, human
gcacagcctctgggccgtgg

SEQ ID NO: 15373 - DNA, 20 bp, human
gcgagaacgggccgattctg

SEQ ID NO: 15374 - DNA, 20 bp, human
ggacgtggggtgtaactccg

SEQ ID NO: 15375 - DNA, 20 bp, human
gatggcggtgcccacggaac

SEQ ID NO: 15376 - DNA, 20 bp, human
gtaaaggaccatagcacgtg

SEQ ID NO: 15377 - DNA, 20 bp, human
ggttccccacagagcaccaa

SEQ ID NO: 15378 - DNA, 20 bp, human
gcgattctctgcaacaaaga

SEQ ID NO: 15379 - DNA, 20 bp, human
gtaatacttcggggaaatgc

SEQ ID NO: 15380 - DNA, 20 bp, human
gacagaggaagtgagccagc

SEQ ID NO: 15381 - DNA, 20 bp, human
gaacttggatctctacacga

SEQ ID NO: 15382 - DNA, 20 bp, human
ggtccctttggtgctctgtg

SEQ ID NO: 15383 - DNA, 20 bp, human
gtgcagtccaatttacaggc

SEQ ID NO: 15384 - DNA, 20 bp, human
ggctgctccagcctgtaaat

SEQ ID NO: 15385 - DNA, 20 bp, human
gtcagtgcagtccaatttac

SEQ ID NO: 15386 - DNA, 20 bp, human
gcgctgcagcgagggtctgg

SEQ ID NO: 15387 - DNA, 20 bp, human
gtggttgttagccaagatgg

SEQ ID NO: 15388 - DNA, 20 bp, human
ggatcgctgcagcgagggtc

SEQ ID NO: 15389 - DNA, 20 bp, human
gggcagcctggctcaaacca

SEQ ID NO: 15390 - DNA, 20 bp, human
gagctgccactggtattcag

SEQ ID NO: 15391 - DNA, 20 bp, human
ggggtctggcggctaaaccg

SEQ ID NO: 15392 - DNA, 20 bp, human
gtaacaaccactcagcggtc

SEQ ID NO: 15393 - DNA, 20 bp, human
gtgagtgccggaccgctgag

SEQ ID NO: 15394 - DNA, 20 bp, human
gttcaggggaggctccttgg

SEQ ID NO: 15395 - DNA, 20 bp, human
gtgccactggtattcagggg

SEQ ID NO: 15396 - DNA, 20 bp, human
gccagacccccgggagtcgt

SEQ ID NO: 15397 - DNA, 20 bp, human
gaggcttggggaccttccag

SEQ ID NO: 15398 - DNA, 20 bp, human
gggcctgggctcacgaggaa

SEQ ID NO: 15399 - DNA, 20 bp, human
ggaaggccctggagaatccg

SEQ ID NO: 15400 - DNA, 20 bp, human
gctgccaccgaggatccaag

SEQ ID NO: 15401 - DNA, 20 bp, human
ggaccttccagggggatcgt

SEQ ID NO: 15402 - DNA, 20 bp, human
ggaggaaatcggctcagtca

SEQ ID NO: 15403 - DNA, 20 bp, human
gtccccaactccaggaccca

SEQ ID NO: 15404 - DNA, 20 bp, human
gccctcctccggcagagctt

SEQ ID NO: 15405 - DNA, 20 bp, human
ggcgccccttggatcctcgg

SEQ ID NO: 15406 - DNA, 20 bp, human
gcatagcctgagaatcccgg

SEQ ID NO: 15407 - DNA, 20 bp, human
gggctgccggctggctactc

SEQ ID NO: 15408 - DNA, 20 bp, human
gctcaggctcagggcggcag

SEQ ID NO: 15409 - DNA, 20 bp, human
gggctggctactcaggctca

SEQ ID NO: 15410 - DNA, 20 bp, human
gagaatcccggtggtgagcg

SEQ ID NO: 15411 - DNA, 20 bp, human
ggggatggcggttgtagcgg

SEQ ID NO: 15412 - DNA, 20 bp, human
gaccctcaggctcttccagg

SEQ ID NO: 15413 - DNA, 20 bp, human
ggaaccacagttagaccctg

SEQ ID NO: 15414 - DNA, 20 bp, human
gaggggggactgcgtctcga

SEQ ID NO: 15415 - DNA, 20 bp, human
ggggctgcagcgggaccgag

SEQ ID NO: 15416 - DNA, 20 bp, human
gaaaggacctagcctcccgg

SEQ ID NO: 15417 - DNA, 20 bp, human
gcgggctggaagggtctgag

SEQ ID NO: 15418 - DNA, 20 bp, human
gtgcggcacggagtccccag

SEQ ID NO: 15419 - DNA, 20 bp, human
gcgcccacgcgacgtcacgg

SEQ ID NO: 15420 - DNA, 20 bp, human
ggggcctccgcggactgagt

SEQ ID NO: 15421 - DNA, 20 bp, human
gacccaggcgacccaaaatg

SEQ ID NO: 15422 - DNA, 20 bp, human
ggagcagctcccatctaccg

SEQ ID NO: 15423 - DNA, 20 bp, human
gccccaacccgaggctctac

SEQ ID NO: 15424 - DNA, 20 bp, human
gtccggccccgcggtaagtg

SEQ ID NO: 15425 - DNA, 20 bp, human
gggctctactggcggtggga

SEQ ID NO: 15426 - DNA, 20 bp, human
gctggagtccgaggacaagg

SEQ ID NO: 15427 - DNA, 20 bp, human
gtcgccgtcgacctcagagg

SEQ ID NO: 15428 - DNA, 20 bp, human
ggcccagcgggagacgaaag

SEQ ID NO: 15429 - DNA, 20 bp, human
ggcgtcgccgtcgacctcag

SEQ ID NO: 15430 - DNA, 20 bp, human
gcgggaacagagggactcgg

SEQ ID NO: 15431 - DNA, 20 bp, human
gggaggatcctccaggtcgg

SEQ ID NO: 15432 - DNA, 20 bp, human
gtgcatccgagggaccttgg

SEQ ID NO: 15433 - DNA, 20 bp, human
ggccccgcctctgaggtcga

SEQ ID NO: 15434 - DNA, 20 bp, human
gtgagcctctacgagaggga

SEQ ID NO: 15435 - DNA, 20 bp, human
ggagcggaaagtcctagcac

SEQ ID NO: 15436 - DNA, 20 bp, human
ggcttgcggcgagacatggt

SEQ ID NO: 15437 - DNA, 20 bp, human
ggagagccgggttagaaaga

SEQ ID NO: 15438 - DNA, 20 bp, human
gcgcagggaagatgaattgt

SEQ ID NO: 15439 - DNA, 20 bp, human
gaattgtgggagagccgtca

SEQ ID NO: 15440 - DNA, 20 bp, human
gtgagctgcaagttcaagtg

SEQ ID NO: 15441 - DNA, 20 bp, human
gccttgcttgcggcgagaca

SEQ ID NO: 15442 - DNA, 20 bp, human
gactagaagcaaaagcgagg

SEQ ID NO: 15443 - DNA, 20 bp, human
gcacggcaatggttccagat

SEQ ID NO: 15444 - DNA, 20 bp, human
gcgagacatggtgggctgcg

SEQ ID NO: 15445 - DNA, 20 bp, human
gacgacggctcggttcacat

SEQ ID NO: 15446 - DNA, 20 bp, human
gcctcctcctctgcccgggt

SEQ ID NO: 15447 - DNA, 20 bp, human
gaaaacaccaacccgggcag

SEQ ID NO: 15448 - DNA, 20 bp, human
gaaagaaaccagccagtccg

SEQ ID NO: 15449 - DNA, 20 bp, human
gctttctttcagggtctggt

SEQ ID NO: 15450 - DNA, 20 bp, human
ggaccctgaaagaaagtgtc

SEQ ID NO: 15451 - DNA, 20 bp, human
ggctgttgctttccgcggac

SEQ ID NO: 15452 - DNA, 20 bp, human
gtctttcagggtctggtagg

SEQ ID NO: 15453 - DNA, 20 bp, human
gaaactgctgttgctttccg

SEQ ID NO: 15454 - DNA, 20 bp, human
gttttgagggggcggggtga

SEQ ID NO: 15455 - DNA, 20 bp, human
gtgggttttttgagggggcg

SEQ ID NO: 15456 - DNA, 20 bp, human
ggccgccgcgcaggaccagg

SEQ ID NO: 15457 - DNA, 20 bp, human
ggcgcggcgggagctccggg

SEQ ID NO: 15458 - DNA, 20 bp, human
gaaagctgctggataaatga

SEQ ID NO: 15459 - DNA, 20 bp, human
gtcctcctggtcctgcgcgg

SEQ ID NO: 15460 - DNA, 20 bp, human
ggaaagggtgcgcagcccgg

SEQ ID NO: 15461 - DNA, 20 bp, human
gtctagcgctcggcaccggc

SEQ ID NO: 15462 - DNA, 20 bp, human
gggagccccggcaccttcgc

SEQ ID NO: 15463 - DNA, 20 bp, human
ggcaccttcgctggcagcgg

SEQ ID NO: 15464 - DNA, 20 bp, human
gcggccgtcagcgctcggag

SEQ ID NO: 15465 - DNA, 20 bp, human
ggccgcaccacacacagcgc

SEQ ID NO: 15466 - DNA, 20 bp, human
gccggatgtggatacctata

SEQ ID NO: 15467 - DNA, 20 bp, human
gggagagcaaagtcttgagc

SEQ ID NO: 15468 - DNA, 20 bp, human
gcagcaaattgccccggatg

SEQ ID NO: 15469 - DNA, 20 bp, human
gcattgcctcaacagcttca

SEQ ID NO: 15470 - DNA, 20 bp, human
gagtgttctggcagtgtcta

SEQ ID NO: 15471 - DNA, 20 bp, human
ggacacatgatgatacatgg

SEQ ID NO: 15472 - DNA, 20 bp, human
gacttggttgaatagtgttc

SEQ ID NO: 15473 - DNA, 20 bp, human
gataaggcaaaacggaggct

SEQ ID NO: 15474 - DNA, 20 bp, human
gtccaggttgtggtatctgt

SEQ ID NO: 15475 - DNA, 20 bp, human
ggaagacggcatcattaact

SEQ ID NO: 15476 - DNA, 20 bp, human
ggagcggccgccctcgatcc

SEQ ID NO: 15477 - DNA, 20 bp, human
gccggagggatcatgcgacc

SEQ ID NO: 15478 - DNA, 20 bp, human
gggagcccagaaggcgacac

SEQ ID NO: 15479 - DNA, 20 bp, human
gtcgatccgggcgatggagg

SEQ ID NO: 15480 - DNA, 20 bp, human
gccctcgatccgggcgatgg

SEQ ID NO: 15481 - DNA, 20 bp, human
gtgggagattcagagtccac

SEQ ID NO: 15482 - DNA, 20 bp, human
gggaggaggaagcaagcgag

SEQ ID NO: 15483 - DNA, 20 bp, human
ggtcaaatcgaaagcaccag

SEQ ID NO: 15484 - DNA, 20 bp, human
gcacaggaattgcgaagctc

SEQ ID NO: 15485 - DNA, 20 bp, human
gcagttctggtacctggagg

SEQ ID NO: 15486 - DNA, 20 bp, human
ggtttcccctgaagagacag

SEQ ID NO: 15487 - DNA, 20 bp, human
gcctctccggagcccagggt

SEQ ID NO: 15488 - DNA, 20 bp, human
gccggcttgttcgggagaga

SEQ ID NO: 15489 - DNA, 20 bp, human
gcggctgtcacgcacagggg

SEQ ID NO: 15490 - DNA, 20 bp, human
gacctggctgccggcctacc

SEQ ID NO: 15491 - DNA, 20 bp, human
ggccgcagccggcccaccct

SEQ ID NO: 15492 - DNA, 20 bp, human
gcaacggctgtcacgcacag

SEQ ID NO: 15493 - DNA, 20 bp, human
gtcctctcaggaaggtctag

SEQ ID NO: 15494 - DNA, 20 bp, human
ggacggcgaaggctcctatt

SEQ ID NO: 15495 - DNA, 20 bp, human
gaactgaggccggcttgttc

SEQ ID NO: 15496 - DNA, 20 bp, human
gcagctcgaagcggttcccg

SEQ ID NO: 15497 - DNA, 20 bp, human
gcgcctacctcggctacccc

SEQ ID NO: 15498 - DNA, 20 bp, human
gcagcgccaccagctcgaag

SEQ ID NO: 15499 - DNA, 20 bp, human
gaggcccggccccccagcag

SEQ ID NO: 15500 - DNA, 20 bp, human
gccggggctgtcggagagca

SEQ ID NO: 15501 - DNA, 20 bp, human
gctgccggcctttctgccag

SEQ ID NO: 15502 - DNA, 20 bp, human
gttcccggggtagccgaggt

SEQ ID NO: 15503 - DNA, 20 bp, human
gacgttcgctgtgaagtctg

SEQ ID NO: 15504 - DNA, 20 bp, human
gtccaccgggcggtcaccag

SEQ ID NO: 15505 - DNA, 20 bp, human
gcaggttacggcagattcac

SEQ ID NO: 15506 - DNA, 20 bp, human
gactagcgctggagcccgaa

SEQ ID NO: 15507 - DNA, 20 bp, human
gcgcctggtctgcagtttgt

SEQ ID NO: 15508 - DNA, 20 bp, human
gcgggaggtggggatccgtg

SEQ ID NO: 15509 - DNA, 20 bp, human
gagagggaacccgatccaca

SEQ ID NO: 15510 - DNA, 20 bp, human
gttgtcgccggcgggaggtg

SEQ ID NO: 15511 - DNA, 20 bp, human
gctccaacaaactgcagacc

SEQ ID NO: 15512 - DNA, 20 bp, human
gccaagaaagggcgccgagg

SEQ ID NO: 15513 - DNA, 20 bp, human
gtgtggcagggttcgcaggg

SEQ ID NO: 15514 - DNA, 20 bp, human
gggtggggatccgtgtggat

SEQ ID NO: 15515 - DNA, 20 bp, human
gacgggaagcgggcagtagg

SEQ ID NO: 15516 - DNA, 20 bp, human
gaggcggaggatgttcccgg

SEQ ID NO: 15517 - DNA, 20 bp, human
gctctgaggtgcacaccgtg

SEQ ID NO: 15518 - DNA, 20 bp, human
gccggacgctgcgctctgaa

SEQ ID NO: 15519 - DNA, 20 bp, human
gacgctgcgctctgaaggga

SEQ ID NO: 15520 - DNA, 20 bp, human
gtgcggagccctcggctgcc

SEQ ID NO: 15521 - DNA, 20 bp, human
ggggccagaggcgcggcgtg

SEQ ID NO: 15522 - DNA, 20 bp, human
gcggagagagcgccagagcc

SEQ ID NO: 15523 - DNA, 20 bp, human
gagggtctgtgggatgaagg

SEQ ID NO: 15524 - DNA, 20 bp, human
gtcggtgcggcgtgcggtac

SEQ ID NO: 15525 - DNA, 20 bp, human
gtccgcaggctaggcgacac

SEQ ID NO: 15526 - DNA, 20 bp, human
ggaggagaccgcaagttgag

SEQ ID NO: 15527 - DNA, 20 bp, human
ggagaccgcaagttgagtgg

SEQ ID NO: 15528 - DNA, 20 bp, human
ggtttgtacgagttcagtgg

SEQ ID NO: 15529 - DNA, 20 bp, human
gaccgcaagttgagtggagg

SEQ ID NO: 15530 - DNA, 20 bp, human
gtgggagacctaagggtctg

SEQ ID NO: 15531 - DNA, 20 bp, human
ggctgggtgcccagattcgt

SEQ ID NO: 15532 - DNA, 20 bp, human
gagattcgtgggtctaaagg

SEQ ID NO: 15533 - DNA, 20 bp, human
gttcttcctgggagacctaa

SEQ ID NO: 15534 - DNA, 20 bp, human
gaaagtttgtacgagttcag

SEQ ID NO: 15535 - DNA, 20 bp, human
ggcctcctccactcaacttg

SEQ ID NO: 15536 - DNA, 20 bp, human
gtggcggcggcggtagatta

SEQ ID NO: 15537 - DNA, 20 bp, human
gttccgacagggtcccccag

SEQ ID NO: 15538 - DNA, 20 bp, human
gcggtgagtgctccgacccg

SEQ ID NO: 15539 - DNA, 20 bp, human
ggtagattagggccgcgggt

SEQ ID NO: 15540 - DNA, 20 bp, human
gtcaccctccaacatggcgg

SEQ ID NO: 15541 - DNA, 20 bp, human
gccgccgccgccatgttgga

SEQ ID NO: 15542 - DNA, 20 bp, human
gcggcggtagattagggccg

SEQ ID NO: 15543 - DNA, 20 bp, human
gggacagcggcgtggagcca

SEQ ID NO: 15544 - DNA, 20 bp, human
gccgtgacgaaggcacgccg

SEQ ID NO: 15545 - DNA, 20 bp, human
gcgccgctgggggaccctgt

SEQ ID NO: 15546 - DNA, 20 bp, human
gcagaccaggtaacaccagg

SEQ ID NO: 15547 - DNA, 20 bp, human
ggaagaaagtttagagcctg

SEQ ID NO: 15548 - DNA, 20 bp, human
gtcaggtagtttagagcccc

SEQ ID NO: 15549 - DNA, 20 bp, human
gtgtcctcctgcaaaggctg

SEQ ID NO: 15550 - DNA, 20 bp, human
gaaaggctgaggatgaagac

SEQ ID NO: 15551 - DNA, 20 bp, human
gttccagaccaggtaacacc

SEQ ID NO: 15552 - DNA, 20 bp, human
gttccaggaaagacgaagaa

SEQ ID NO: 15553 - DNA, 20 bp, human
gaactttcaacaggtcttct

SEQ ID NO: 15554 - DNA, 20 bp, human
gtcagttaagaacacattac

SEQ ID NO: 15555 - DNA, 20 bp, human
gcacagacagcttccagacc

SEQ ID NO: 15556 - DNA, 20 bp, human
gttctgccaggcgagtccag

SEQ ID NO: 15557 - DNA, 20 bp, human
ggaggccacgactaatgccc

SEQ ID NO: 15558 - DNA, 20 bp, human
gtggcatgcaaaggctggac

SEQ ID NO: 15559 - DNA, 20 bp, human
gacactcagggccaagggta

SEQ ID NO: 15560 - DNA, 20 bp, human
gctaatgccctggcatgcaa

SEQ ID NO: 15561 - DNA, 20 bp, human
gttcatcctagaggctaaat

SEQ ID NO: 15562 - DNA, 20 bp, human
gacaataacgttcttctagg

SEQ ID NO: 15563 - DNA, 20 bp, human
gctaggtggttagttctgcc

SEQ ID NO: 15564 - DNA, 20 bp, human
gcaggtggcagaaacactca

SEQ ID NO: 15565 - DNA, 20 bp, human
ggaggctaaatgggctcccc

SEQ ID NO: 15566 - DNA, 20 bp, human
gacacagctgctcagaaagg

SEQ ID NO: 15567 - DNA, 20 bp, human
ggattacctacttggaactg

SEQ ID NO: 15568 - DNA, 20 bp, human
ggacctgcaatcaccgccta

SEQ ID NO: 15569 - DNA, 20 bp, human
gcatgtcaggaaactacaag

SEQ ID NO: 15570 - DNA, 20 bp, human
ggctggcaacctgcaatgtt

SEQ ID NO: 15571 - DNA, 20 bp, human
gctcagaaggattacctact

SEQ ID NO: 15572 - DNA, 20 bp, human
ggatgaagtagattcaggta

SEQ ID NO: 15573 - DNA, 20 bp, human
gtgtgtttgaagaaagctag

SEQ ID NO: 15574 - DNA, 20 bp, human
ggtaaggttcctgccctagg

SEQ ID NO: 15575 - DNA, 20 bp, human
ggtttcctgacatgtaatcc

SEQ ID NO: 15576 - DNA, 20 bp, human
gcaggaaacggcccggatcc

SEQ ID NO: 15577 - DNA, 20 bp, human
ggccaggttagggatctcac

SEQ ID NO: 15578 - DNA, 20 bp, human
ggacactcacccagccggga

SEQ ID NO: 15579 - DNA, 20 bp, human
gacggcccggatcccggcag

SEQ ID NO: 15580 - DNA, 20 bp, human
gcctgcaccaggaaacggcc

SEQ ID NO: 15581 - DNA, 20 bp, human
gcccgcccgcctgccaggtt

SEQ ID NO: 15582 - DNA, 20 bp, human
gagctcttaagacacagcac

SEQ ID NO: 15583 - DNA, 20 bp, human
gaagagctgccatcccggct

SEQ ID NO: 15584 - DNA, 20 bp, human
ggttagggatctcacgggtc

SEQ ID NO: 15585 - DNA, 20 bp, human
gccgggaatagagatggtgt

SEQ ID NO: 15586 - DNA, 20 bp, human
ggccaggttagggatctcac

SEQ ID NO: 15587 - DNA, 20 bp, human
gcaggaaacggcccggatcc

SEQ ID NO: 15588 - DNA, 20 bp, human
ggacactcacccagccggga

SEQ ID NO: 15589 - DNA, 20 bp, human
gacggcccggatcccggcag

SEQ ID NO: 15590 - DNA, 20 bp, human
gccgggaatagagatggtgt

SEQ ID NO: 15591 - DNA, 20 bp, human
gcccgcccgcctgccaggtt

SEQ ID NO: 15592 - DNA, 20 bp, human
gcctgcaccaggaaacggcc

SEQ ID NO: 15593 - DNA, 20 bp, human
gagctcttaagacacagcac

SEQ ID NO: 15594 - DNA, 20 bp, human
ggcctttgggctgcactagg

SEQ ID NO: 15595 - DNA, 20 bp, human
gtgtcctcccgggaaaccca

SEQ ID NO: 15596 - DNA, 20 bp, human
gtgggctcggctgcacggga

SEQ ID NO: 15597 - DNA, 20 bp, human
gcggcggccggagagcggct

SEQ ID NO: 15598 - DNA, 20 bp, human
ggctcggctgcacgggaggg

SEQ ID NO: 15599 - DNA, 20 bp, human
gtgggatccacacagagcat

SEQ ID NO: 15600 - DNA, 20 bp, human
gtggcccccgcggggcatcg

SEQ ID NO: 15601 - DNA, 20 bp, human
gctccggccgccgtccccgg

SEQ ID NO: 15602 - DNA, 20 bp, human
gtgcagccggctgaactgaa

SEQ ID NO: 15603 - DNA, 20 bp, human
gcagagcttgaggcacaaac

SEQ ID NO: 15604 - DNA, 20 bp, human
gaccctcgggggccactcac

SEQ ID NO: 15605 - DNA, 20 bp, human
gacccggcccggaccctcgg

SEQ ID NO: 15606 - DNA, 20 bp, human
ggagacgtgggactaatctt

SEQ ID NO: 15607 - DNA, 20 bp, human
gagcaacagcaataatcacc

SEQ ID NO: 15608 - DNA, 20 bp, human
gtgatcatgagcagcggcgg

SEQ ID NO: 15609 - DNA, 20 bp, human
gtcctatggtgggagagacg

SEQ ID NO: 15610 - DNA, 20 bp, human
ggcaataatcacctggtgtc

SEQ ID NO: 15611 - DNA, 20 bp, human
gctggccccagaccgcggag

SEQ ID NO: 15612 - DNA, 20 bp, human
gagaggaaggaggggaatta

SEQ ID NO: 15613 - DNA, 20 bp, human
gcgagcgcgcgtcctctccg

SEQ ID NO: 15614 - DNA, 20 bp, human
gtaatgatcatgagcagcgg

SEQ ID NO: 15615 - DNA, 20 bp, human
gggtgattcgggctagtctg

SEQ ID NO: 15616 - DNA, 20 bp, human
gggagcgagggtgtcgtaga

SEQ ID NO: 15617 - DNA, 20 bp, human
gcggcttctcttcttaaggg

SEQ ID NO: 15618 - DNA, 20 bp, human
gggcaggccgtgagatctcg

SEQ ID NO: 15619 - DNA, 20 bp, human
gactcctgggtcccccaaga

SEQ ID NO: 15620 - DNA, 20 bp, human
gaaaggagccgaggccaaga

SEQ ID NO: 15621 - DNA, 20 bp, human
gcaactggctccaagcgctg

SEQ ID NO: 15622 - DNA, 20 bp, human
gactgagggagccagactcc

SEQ ID NO: 15623 - DNA, 20 bp, human
gagggaggctgcgtgtgccg

SEQ ID NO: 15624 - DNA, 20 bp, human
gggttggacacctgagacac

SEQ ID NO: 15625 - DNA, 20 bp, human
gctccaagcgctgtgggatc

SEQ ID NO: 15626 - DNA, 20 bp, human
gtacaggcgcgagcgcacct

SEQ ID NO: 15627 - DNA, 20 bp, human
gctgtgcgcgagtgagtgag

SEQ ID NO: 15628 - DNA, 20 bp, human
ggagcgcgagcaggacccgg

SEQ ID NO: 15629 - DNA, 20 bp, human
gcgcgagcgcacctgggcag

SEQ ID NO: 15630 - DNA, 20 bp, human
gcagcctggcgcaggtgacc

SEQ ID NO: 15631 - DNA, 20 bp, human
gtccccgccggaaccatgtc

SEQ ID NO: 15632 - DNA, 20 bp, human
ggtgcgcaaatggtaagcgg

SEQ ID NO: 15633 - DNA, 20 bp, human
gggttccggcggggagacgg

SEQ ID NO: 15634 - DNA, 20 bp, human
ggatatcaagagggtcatgg

SEQ ID NO: 15635 - DNA, 20 bp, human
ggcgcgagtgagtgagcggc

SEQ ID NO: 15636 - DNA, 20 bp, human
ggcgggctgacaccactcca

SEQ ID NO: 15637 - DNA, 20 bp, human
gcgccgccgcagcgtcacag

SEQ ID NO: 15638 - DNA, 20 bp, human
gaccgaccggcccgacatgg

SEQ ID NO: 15639 - DNA, 20 bp, human
ggacggccgctgtgacgctg

SEQ ID NO: 15640 - DNA, 20 bp, human
gacgccaggcagctccagtc

SEQ ID NO: 15641 - DNA, 20 bp, human
ggccggaatcccctcccagg

SEQ ID NO: 15642 - DNA, 20 bp, human
gggccgctgtgacgctgcgg

SEQ ID NO: 15643 - DNA, 20 bp, human
gcactgctcccaagacaccg

SEQ ID NO: 15644 - DNA, 20 bp, human
gtgggactggcgggtcaggt

SEQ ID NO: 15645 - DNA, 20 bp, human
gtccaggccctgaggagcgt

SEQ ID NO: 15646 - DNA, 20 bp, human
gggcgcggccaactccaggg

SEQ ID NO: 15647 - DNA, 20 bp, human
gggccagggacgggacacag

SEQ ID NO: 15648 - DNA, 20 bp, human
gctcccgctctgggaggaca

SEQ ID NO: 15649 - DNA, 20 bp, human
ggagggcgcggccaactcca

SEQ ID NO: 15650 - DNA, 20 bp, human
gcccctggggcacacatggg

SEQ ID NO: 15651 - DNA, 20 bp, human
gagggggcggggcacaagag

SEQ ID NO: 15652 - DNA, 20 bp, human
gctctgggaggacacggctg

SEQ ID NO: 15653 - DNA, 20 bp, human
gtctgcagggctctgatccc

SEQ ID NO: 15654 - DNA, 20 bp, human
ggatccagggcaaagctagt

SEQ ID NO: 15655 - DNA, 20 bp, human
ggagcctgagcccgccggac

SEQ ID NO: 15656 - DNA, 20 bp, human
ggtgtcaccgcagcaagagg

SEQ ID NO: 15657 - DNA, 20 bp, human
gctcctggtatcaagacacc

SEQ ID NO: 15658 - DNA, 20 bp, human
gtgccttgaaagacttccag

SEQ ID NO: 15659 - DNA, 20 bp, human
ggacaacatcaaagcaactt

SEQ ID NO: 15660 - DNA, 20 bp, human
gcttagggggaacactttag

SEQ ID NO: 15661 - DNA, 20 bp, human
gacgatctgtgcctctgggt

SEQ ID NO: 15662 - DNA, 20 bp, human
ggccagggattgcaggaaaa

SEQ ID NO: 15663 - DNA, 20 bp, human
ggtcctggtgtcttgatacc

SEQ ID NO: 15664 - DNA, 20 bp, human
gggcacagatcgtgttactg

SEQ ID NO: 15665 - DNA, 20 bp, human
gtgcccctggaagtctttca

SEQ ID NO: 15666 - DNA, 20 bp, human
gggaggggcaagcgaggctc

SEQ ID NO: 15667 - DNA, 20 bp, human
ggtctcggccccgaacctca

SEQ ID NO: 15668 - DNA, 20 bp, human
gggggagtggagccgagtgg

SEQ ID NO: 15669 - DNA, 20 bp, human
gccgatgcttattcaggctg

SEQ ID NO: 15670 - DNA, 20 bp, human
gcctcgcttgcccctccact

SEQ ID NO: 15671 - DNA, 20 bp, human
gaccatgctccgcggttggg

SEQ ID NO: 15672 - DNA, 20 bp, human
gcggcagcgcaggggagccc

SEQ ID NO: 15673 - DNA, 20 bp, human
gagagcgcgcacacccgccg

SEQ ID NO: 15674 - DNA, 20 bp, human
gagagccccgatgcttattc

SEQ ID NO: 15675 - DNA, 20 bp, human
gccaggcacccagcgatccc

SEQ ID NO: 15676 - DNA, 20 bp, human
gtcgggaaatggccgctgtg

SEQ ID NO: 15677 - DNA, 20 bp, human
gagacgtgctagcgcgtcga

SEQ ID NO: 15678 - DNA, 20 bp, human
gcgggcgcgcgcagaggtac

SEQ ID NO: 15679 - DNA, 20 bp, human
gcgcgtcgaaggtagctcta

SEQ ID NO: 15680 - DNA, 20 bp, human
gctccgttgcaaccacacag

SEQ ID NO: 15681 - DNA, 20 bp, human
ggtgcgcggagcgttcagtc

SEQ ID NO: 15682 - DNA, 20 bp, human
gccgtcggcgccataggcgg

SEQ ID NO: 15683 - DNA, 20 bp, human
gttcagtcgggcgcgcgcag

SEQ ID NO: 15684 - DNA, 20 bp, human
gggccgctgtgtggttgcaa

SEQ ID NO: 15685 - DNA, 20 bp, human
gcgccccagatcggaagtga

SEQ ID NO: 15686 - DNA, 20 bp, human
gagatccagggctcttggag

SEQ ID NO: 15687 - DNA, 20 bp, human
ggtgaatgtaaagagatcca

SEQ ID NO: 15688 - DNA, 20 bp, human
gctgtgagggccaaagtgac

SEQ ID NO: 15689 - DNA, 20 bp, human
gtgtccctctccaagagccc

SEQ ID NO: 15690 - DNA, 20 bp, human
ggagacagagatgtgaagga

SEQ ID NO: 15691 - DNA, 20 bp, human
gccctcggcaccctgagcaa

SEQ ID NO: 15692 - DNA, 20 bp, human
gaagtgagagccagccaaaa

SEQ ID NO: 15693 - DNA, 20 bp, human
ggatctctttacattcacaa

SEQ ID NO: 15694 - DNA, 20 bp, human
gtccattgctcagggtgccg

SEQ ID NO: 15695 - DNA, 20 bp, human
gagcaggaaggaaacgcagg

SEQ ID NO: 15696 - DNA, 20 bp, human
gctgccagtgtgagaggatt

SEQ ID NO: 15697 - DNA, 20 bp, human
gggaaggaaatccactgcag

SEQ ID NO: 15698 - DNA, 20 bp, human
gggagccggtgcaccatcac

SEQ ID NO: 15699 - DNA, 20 bp, human
ggaacacgcacagaactgcc

SEQ ID NO: 15700 - DNA, 20 bp, human
gccagcaaccttcaggaaag

SEQ ID NO: 15701 - DNA, 20 bp, human
gtttccaaatcctctcacac

SEQ ID NO: 15702 - DNA, 20 bp, human
ggagtcctggaagttaaaga

SEQ ID NO: 15703 - DNA, 20 bp, human
gacaattacattagaacgtg

SEQ ID NO: 15704 - DNA, 20 bp, human
gtgcaccggctcccaggtag

SEQ ID NO: 15705 - DNA, 20 bp, human
ggaagctcccagcaaccttc

SEQ ID NO: 15706 - DNA, 20 bp, human
gggctcccagcggcaaggtg

SEQ ID NO: 15707 - DNA, 20 bp, human
gtcggcggggccgaccccga

SEQ ID NO: 15708 - DNA, 20 bp, human
gggagcccggaggatcgcac

SEQ ID NO: 15709 - DNA, 20 bp, human
ggtcggccccgccgaggggt

SEQ ID NO: 15710 - DNA, 20 bp, human
ggcggcggcagacggagcct

SEQ ID NO: 15711 - DNA, 20 bp, human
ggctgtcgccacctgcccgg

SEQ ID NO: 15712 - DNA, 20 bp, human
ggggctcccgcagctggact

SEQ ID NO: 15713 - DNA, 20 bp, human
gttgggatcgcggcgtgcgg

SEQ ID NO: 15714 - DNA, 20 bp, human
gtgcgctcctcgctgaacgc

SEQ ID NO: 15715 - DNA, 20 bp, human
ggctcggcccgcgttcagcg

SEQ ID NO: 15716 - DNA, 20 bp, human
gaaggaggtcggtggcgata

SEQ ID NO: 15717 - DNA, 20 bp, human
gcggtggcgataaggggcgg

SEQ ID NO: 15718 - DNA, 20 bp, human
gtcggactctaggaactgag

SEQ ID NO: 15719 - DNA, 20 bp, human
gcggcgagcgaaagagtgag

SEQ ID NO: 15720 - DNA, 20 bp, human
gcgctcggcttgccccccgg

SEQ ID NO: 15721 - DNA, 20 bp, human
gtccagggagcgctacgtcc

SEQ ID NO: 15722 - DNA, 20 bp, human
gcgcggctgctgccagtgtg

SEQ ID NO: 15723 - DNA, 20 bp, human
gggagctgtcccgaagggag

SEQ ID NO: 15724 - DNA, 20 bp, human
gtacgtccggggacacgaag

SEQ ID NO: 15725 - DNA, 20 bp, human
gagcggccgcagggaaaaga

SEQ ID NO: 15726 - DNA, 20 bp, human
gggctccgtcatccgcgccg

SEQ ID NO: 15727 - DNA, 20 bp, human
ggggccgcgccgtgggcaca

SEQ ID NO: 15728 - DNA, 20 bp, human
ggcgccatggtggacccggt

SEQ ID NO: 15729 - DNA, 20 bp, human
gcgcgcggggcccgtctcag

SEQ ID NO: 15730 - DNA, 20 bp, human
gaagcccaccgggtccacca

SEQ ID NO: 15731 - DNA, 20 bp, human
gggagccccgcacacaatag

SEQ ID NO: 15732 - DNA, 20 bp, human
ggcggggcccgtctcagcgg

SEQ ID NO: 15733 - DNA, 20 bp, human
gcagcccggcggcgcaggta

SEQ ID NO: 15734 - DNA, 20 bp, human
ggacccggtgggcttcgcgg

SEQ ID NO: 15735 - DNA, 20 bp, human
gtcacctgccaccagggagt

SEQ ID NO: 15736 - DNA, 20 bp, human
gcgggttaccccaaaccatg

SEQ ID NO: 15737 - DNA, 20 bp, human
ggagggccagagagtcacgg

SEQ ID NO: 15738 - DNA, 20 bp, human
ggagagtcacggcggtgaga

SEQ ID NO: 15739 - DNA, 20 bp, human
gcggtgagagggctgagtga

SEQ ID NO: 15740 - DNA, 20 bp, human
ggtgaaaccatcgagacgga

SEQ ID NO: 15741 - DNA, 20 bp, human
ggcatgagcaaggagttggg

SEQ ID NO: 15742 - DNA, 20 bp, human
gcgcggtgaaaccatcgaga

SEQ ID NO: 15743 - DNA, 20 bp, human
gcgtggagaaagtagcagat

SEQ ID NO: 15744 - DNA, 20 bp, human
gcactgcatgagcaaggagt

SEQ ID NO: 15745 - DNA, 20 bp, human
gtgccaggcgcagggcaaag

SEQ ID NO: 15746 - DNA, 20 bp, human
gcgcaggagtgctggtggag

SEQ ID NO: 15747 - DNA, 20 bp, human
ggcgtgtagaagcgtccggg

SEQ ID NO: 15748 - DNA, 20 bp, human
gatcatgctgctggagacgc

SEQ ID NO: 15749 - DNA, 20 bp, human
gtgtagaagcgtccgggtgg

SEQ ID NO: 15750 - DNA, 20 bp, human
ggccgagagggagactccct

SEQ ID NO: 15751 - DNA, 20 bp, human
ggccgcagcggggtaagggt

SEQ ID NO: 15752 - DNA, 20 bp, human
gccgcaggccgcaggagtgc

SEQ ID NO: 15753 - DNA, 20 bp, human
gttcgcgtgtagaagcgtcc

SEQ ID NO: 15754 - DNA, 20 bp, human
ggccggcagaaaagccgaga

SEQ ID NO: 15755 - DNA, 20 bp, human
gctgcggcagcgccccccct

SEQ ID NO: 15756 - DNA, 20 bp, human
gcagggcgtattgacacccc

SEQ ID NO: 15757 - DNA, 20 bp, human
ggcctggaaaaggtttccag

SEQ ID NO: 15758 - DNA, 20 bp, human
gtgtgggctgtcactgagag

SEQ ID NO: 15759 - DNA, 20 bp, human
gtctgtccctggtagcaata

SEQ ID NO: 15760 - DNA, 20 bp, human
gctgaggcacctgccagcta

SEQ ID NO: 15761 - DNA, 20 bp, human
gtcttaattctcagttgaca

SEQ ID NO: 15762 - DNA, 20 bp, human
gctccaggcaagtgaccagc

SEQ ID NO: 15763 - DNA, 20 bp, human
gtattcattgggaaaataat

SEQ ID NO: 15764 - DNA, 20 bp, human
gagcatgcaggatcctctcc

SEQ ID NO: 15765 - DNA, 20 bp, human
gtgggtaaggcctggtagaa

SEQ ID NO: 15766 - DNA, 20 bp, human
ggagcaaacacggcctgaaa

SEQ ID NO: 15767 - DNA, 20 bp, human
gtttagaacggaaagagggg

SEQ ID NO: 15768 - DNA, 20 bp, human
gctaaggaagccaacatgta

SEQ ID NO: 15769 - DNA, 20 bp, human
gtcacattggatatattgag

SEQ ID NO: 15770 - DNA, 20 bp, human
gaactttagaacggaaagag

SEQ ID NO: 15771 - DNA, 20 bp, human
gggaagaaaactcttcactt

SEQ ID NO: 15772 - DNA, 20 bp, human
gactttaagcagcgagctga

SEQ ID NO: 15773 - DNA, 20 bp, human
gttgacttgcttccagacaa

SEQ ID NO: 15774 - DNA, 20 bp, human
gtcctggctcttgaaaacaa

SEQ ID NO: 15775 - DNA, 20 bp, human
ggttagatcagtgtaaagat

SEQ ID NO: 15776 - DNA, 20 bp, human
gggcgttcacaactgtagtt

SEQ ID NO: 15777 - DNA, 20 bp, human
gagtcaggtgaaacatgtca

SEQ ID NO: 15778 - DNA, 20 bp, human
gcagtccatgcgaactctgg

SEQ ID NO: 15779 - DNA, 20 bp, human
gtagtgagagctgcttttgg

SEQ ID NO: 15780 - DNA, 20 bp, human
gggtcagtccatgcgaactc

SEQ ID NO: 15781 - DNA, 20 bp, human
gttccagaacaggaggagga

SEQ ID NO: 15782 - DNA, 20 bp, human
gggtggtcatttacttactc

SEQ ID NO: 15783 - DNA, 20 bp, human
gcataagaccaataactggt

SEQ ID NO: 15784 - DNA, 20 bp, human
ggcagccaccagagttcgca

SEQ ID NO: 15785 - DNA, 20 bp, human
ggccaataggtaggtgtaaa

SEQ ID NO: 15786 - DNA, 20 bp, human
ggcttctgggctccgaggag

SEQ ID NO: 15787 - DNA, 20 bp, human
ggtcgctccctggtactgcg

SEQ ID NO: 15788 - DNA, 20 bp, human
gaggctgccccgcagtacca

SEQ ID NO: 15789 - DNA, 20 bp, human
gctgggctccgaggaggggt

SEQ ID NO: 15790 - DNA, 20 bp, human
gtggggacggtggggacatc

SEQ ID NO: 15791 - DNA, 20 bp, human
ggagtggacaccttggagta

SEQ ID NO: 15792 - DNA, 20 bp, human
gcgcttgctccggagaaggt

SEQ ID NO: 15793 - DNA, 20 bp, human
gtctccggagcaagcggcat

SEQ ID NO: 15794 - DNA, 20 bp, human
ggtcagacctcccctccgga

SEQ ID NO: 15795 - DNA, 20 bp, human
gggaggtctgacaggcgatg

SEQ ID NO: 15796 - DNA, 20 bp, human
gcggcggcggagtcacatcg

SEQ ID NO: 15797 - DNA, 20 bp, human
gatcgtcccttctaccggag

SEQ ID NO: 15798 - DNA, 20 bp, human
gggtgcgcgggacagcgagc

SEQ ID NO: 15799 - DNA, 20 bp, human
gtgggcgctggagccagaat

SEQ ID NO: 15800 - DNA, 20 bp, human
gccgggagcccgaggcgcta

SEQ ID NO: 15801 - DNA, 20 bp, human
gaaacctcacgggtccccgg

SEQ ID NO: 15802 - DNA, 20 bp, human
gcgcgggagagagttgactg

SEQ ID NO: 15803 - DNA, 20 bp, human
gaggtcagccggcaccacca

SEQ ID NO: 15804 - DNA, 20 bp, human
gccagccccggtccccgtcg

SEQ ID NO: 15805 - DNA, 20 bp, human
gagcaccgcgacggggaccg

SEQ ID NO: 15806 - DNA, 20 bp, human
gcggaacatggcggaggcag

SEQ ID NO: 15807 - DNA, 20 bp, human
gcagggtcatgaaaaagcgg

SEQ ID NO: 15808 - DNA, 20 bp, human
gtggcagggtcatgaaaaag

SEQ ID NO: 15809 - DNA, 20 bp, human
gccaggtgacatgcccggag

SEQ ID NO: 15810 - DNA, 20 bp, human
gcgtgccctgcggaacatgg

SEQ ID NO: 15811 - DNA, 20 bp, human
gggtcatgaaaaagcggcgg

SEQ ID NO: 15812 - DNA, 20 bp, human
gtagccatcggtgtgtggca

SEQ ID NO: 15813 - DNA, 20 bp, human
gcggcggggcagtgaaacta

SEQ ID NO: 15814 - DNA, 20 bp, human
gtgaccctgccacacaccga

SEQ ID NO: 15815 - DNA, 20 bp, human
gtgagcgcggggatgctggg

SEQ ID NO: 15816 - DNA, 20 bp, human
gctccgagcgggaaccggac

SEQ ID NO: 15817 - DNA, 20 bp, human
gcggctcgcgcagatcccag

SEQ ID NO: 15818 - DNA, 20 bp, human
gcggcgaacgacacacccgg

SEQ ID NO: 15819 - DNA, 20 bp, human
gagcgcagtggcctccgagc

SEQ ID NO: 15820 - DNA, 20 bp, human
gctcgtcggggactcgagtc

SEQ ID NO: 15821 - DNA, 20 bp, human
gccagcaggccgaagcgtag

SEQ ID NO: 15822 - DNA, 20 bp, human
gccggctccggctcccagtc

SEQ ID NO: 15823 - DNA, 20 bp, human
gaggcccgagggcgcgatca

SEQ ID NO: 15824 - DNA, 20 bp, human
gcaggggtccccgaaaccga

SEQ ID NO: 15825 - DNA, 20 bp, human
ggcgcgatcagggtcagcct

SEQ ID NO: 15826 - DNA, 20 bp, human
gccacggcctcagggatgga

SEQ ID NO: 15827 - DNA, 20 bp, human
gtccgggacagcctgagcaa

SEQ ID NO: 15828 - DNA, 20 bp, human
ggtcgctgaagacagagcga

SEQ ID NO: 15829 - DNA, 20 bp, human
gcaagtccggtctaccgcgg

SEQ ID NO: 15830 - DNA, 20 bp, human
ggacagagcgatggtagttc

SEQ ID NO: 15831 - DNA, 20 bp, human
gtcgctccggggccgacccg

SEQ ID NO: 15832 - DNA, 20 bp, human
gagagcgatggtagttctgg

SEQ ID NO: 15833 - DNA, 20 bp, human
gagttctggaggcctcgctc

SEQ ID NO: 15834 - DNA, 20 bp, human
gggagcccgtcacccaagtc

SEQ ID NO: 15835 - DNA, 20 bp, human
gaccccgggccggaggtcaa

SEQ ID NO: 15836 - DNA, 20 bp, human
gggcgcgctcggcctcggag

SEQ ID NO: 15837 - DNA, 20 bp, human
gctgggaactgggcactctc

SEQ ID NO: 15838 - DNA, 20 bp, human
gcctgcggcggaaggaaagg

SEQ ID NO: 15839 - DNA, 20 bp, human
gaggagggacgggtgaccaa

SEQ ID NO: 15840 - DNA, 20 bp, human
gggaccccgcgataggaccc

SEQ ID NO: 15841 - DNA, 20 bp, human
ggcccctgcggcggaaggaa

SEQ ID NO: 15842 - DNA, 20 bp, human
ggagcgcccgggtcctatcg

SEQ ID NO: 15843 - DNA, 20 bp, human
ggaactgggcactctcgggt

SEQ ID NO: 15844 - DNA, 20 bp, human
ggagtacctgcgagccggga

SEQ ID NO: 15845 - DNA, 20 bp, human
gcgcaggggcgcgcgtgtca

SEQ ID NO: 15846 - DNA, 20 bp, human
gcaatgggtgcacagcccag

SEQ ID NO: 15847 - DNA, 20 bp, human
gcacagcccaggggctatct

SEQ ID NO: 15848 - DNA, 20 bp, human
gacccaagcgaggggagtag

SEQ ID NO: 15849 - DNA, 20 bp, human
gcttgtggtgactgactctt

SEQ ID NO: 15850 - DNA, 20 bp, human
gaaggtcccacagcacatct

SEQ ID NO: 15851 - DNA, 20 bp, human
ggaagtcccgggtgtcatga

SEQ ID NO: 15852 - DNA, 20 bp, human
gggattgtgttgctgtgaga

SEQ ID NO: 15853 - DNA, 20 bp, human
gtgaaggaaacttgaggtgt

SEQ ID NO: 15854 - DNA, 20 bp, human
ggtgtcatgaaggaaacttg

SEQ ID NO: 15855 - DNA, 20 bp, human
gcgacccaaacccaagcgag

SEQ ID NO: 15856 - DNA, 20 bp, human
gagagccgcggcgcagacgt

SEQ ID NO: 15857 - DNA, 20 bp, human
gagggttcaggtcgtctcag

SEQ ID NO: 15858 - DNA, 20 bp, human
ggcgtctccgtggctcttgg

SEQ ID NO: 15859 - DNA, 20 bp, human
ggacgtaggcctcaggtctc

SEQ ID NO: 15860 - DNA, 20 bp, human
ggctcttggtggctcagggt

SEQ ID NO: 15861 - DNA, 20 bp, human
gagcagttacctcagagccg

SEQ ID NO: 15862 - DNA, 20 bp, human
gtaactgcttggtaactgtg

SEQ ID NO: 15863 - DNA, 20 bp, human
ggcagatggccaatacccag

SEQ ID NO: 15864 - DNA, 20 bp, human
gaagatgtcccggagacgtg

SEQ ID NO: 15865 - DNA, 20 bp, human
ggaggcctacgtctgcgccg

SEQ ID NO: 15866 - DNA, 20 bp, human
ggttccgagcgggcacaaag

SEQ ID NO: 15867 - DNA, 20 bp, human
gatgggcgcggcgagcccgt

SEQ ID NO: 15868 - DNA, 20 bp, human
ggcgggccgagcgaccggag

SEQ ID NO: 15869 - DNA, 20 bp, human
ggtgcccgctcggaacgcgg

SEQ ID NO: 15870 - DNA, 20 bp, human
gaaaggggcgcgcagcacaa

SEQ ID NO: 15871 - DNA, 20 bp, human
ggagccgccgcgttccgagc

SEQ ID NO: 15872 - DNA, 20 bp, human
ggtcccaggtaagtgcgggg

SEQ ID NO: 15873 - DNA, 20 bp, human
gcgggggtgggcgctactac

SEQ ID NO: 15874 - DNA, 20 bp, human
gcttgtgcggaaatgacaca

SEQ ID NO: 15875 - DNA, 20 bp, human
gggtgggcgctactaccggc

SEQ ID NO: 15876 - DNA, 20 bp, human
gctggtgcgcgcgtgtggga

SEQ ID NO: 15877 - DNA, 20 bp, human
gcctcagcgacaggcggcgg

SEQ ID NO: 15878 - DNA, 20 bp, human
gtgccagcctcagcgacagg

SEQ ID NO: 15879 - DNA, 20 bp, human
ggacggcgacgacgacgaag

SEQ ID NO: 15880 - DNA, 20 bp, human
gtgtcaatcaggagctcggg

SEQ ID NO: 15881 - DNA, 20 bp, human
ggcgcctggaactgctgcgg

SEQ ID NO: 15882 - DNA, 20 bp, human
gtgccctggtgcgcgcgtgt

SEQ ID NO: 15883 - DNA, 20 bp, human
ggcgcgcaccagggcagacc

SEQ ID NO: 15884 - DNA, 20 bp, human
ggcaccagggcagacccggc

SEQ ID NO: 15885 - DNA, 20 bp, human
gagggtgtgtgtctgtgccg

SEQ ID NO: 15886 - DNA, 20 bp, human
gagtcgcgcacgcacgacac

SEQ ID NO: 15887 - DNA, 20 bp, human
gaccggggcccggaggaatt

SEQ ID NO: 15888 - DNA, 20 bp, human
ggcccggcgcccaattcctc

SEQ ID NO: 15889 - DNA, 20 bp, human
ggtacacggcgtacaccttc

SEQ ID NO: 15890 - DNA, 20 bp, human
gaatgacggtacaaacaggt

SEQ ID NO: 15891 - DNA, 20 bp, human
gaggtgtacgccgtgtaccg

SEQ ID NO: 15892 - DNA, 20 bp, human
gggggaagcggggaagacaa

SEQ ID NO: 15893 - DNA, 20 bp, human
gcgacttcagcccccgctcg

SEQ ID NO: 15894 - DNA, 20 bp, human
gtcctccaggaaccgcacaa

SEQ ID NO: 15895 - DNA, 20 bp, human
ggcacaaaggcgtacatggt

SEQ ID NO: 15896 - DNA, 20 bp, human
gggagtgggcctcccgttcc

SEQ ID NO: 15897 - DNA, 20 bp, human
gggtggagggtagcaccgcc

SEQ ID NO: 15898 - DNA, 20 bp, human
gcaggcccgggtgcagcccg

SEQ ID NO: 15899 - DNA, 20 bp, human
ggagcgctcctagtttagag

SEQ ID NO: 15900 - DNA, 20 bp, human
gcgaccagagcgtactaccc

SEQ ID NO: 15901 - DNA, 20 bp, human
ggccgggaagggccttccct

SEQ ID NO: 15902 - DNA, 20 bp, human
gcgggtgtccgggaagctag

SEQ ID NO: 15903 - DNA, 20 bp, human
ggctgacaggagcctcccgg

SEQ ID NO: 15904 - DNA, 20 bp, human
ggaagcgcgagcgccgggaa

SEQ ID NO: 15905 - DNA, 20 bp, human
gcagcgcgggcgcgcggaca

SEQ ID NO: 15906 - DNA, 20 bp, human
gttcctctcggagaactcca

SEQ ID NO: 15907 - DNA, 20 bp, human
gcagcctgcggtcgcggcgg

SEQ ID NO: 15908 - DNA, 20 bp, human
gggcggcggccccgaagacg

SEQ ID NO: 15909 - DNA, 20 bp, human
gcaaggtccgcgcctggagt

SEQ ID NO: 15910 - DNA, 20 bp, human
ggggcgcctagggcaccggg

SEQ ID NO: 15911 - DNA, 20 bp, human
gcaggcgcggaccttggtcc

SEQ ID NO: 15912 - DNA, 20 bp, human
ggcgcggaccttggtcccgg

SEQ ID NO: 15913 - DNA, 20 bp, human
ggcgcgggctcgtgtcaccg

SEQ ID NO: 15914 - DNA, 20 bp, human
gcggcccggcccgctcccaa

SEQ ID NO: 15915 - DNA, 20 bp, human
gccgctcccaacggaaagtt

SEQ ID NO: 15916 - DNA, 20 bp, human
gcacaggtggggttccaggt

SEQ ID NO: 15917 - DNA, 20 bp, human
gtagtcgccagaccttctgt

SEQ ID NO: 15918 - DNA, 20 bp, human
ggtgaggagacacagagcac

SEQ ID NO: 15919 - DNA, 20 bp, human
gaggagacacagagcaccgg

SEQ ID NO: 15920 - DNA, 20 bp, human
gggtccgatgatcccacaga

SEQ ID NO: 15921 - DNA, 20 bp, human
gagaccttctgtgggatcat

SEQ ID NO: 15922 - DNA, 20 bp, human
gccccagcccagtccacctg

SEQ ID NO: 15923 - DNA, 20 bp, human
ggtctggcgactaggctggt

SEQ ID NO: 15924 - DNA, 20 bp, human
gtggggcaccttgtactcac

SEQ ID NO: 15925 - DNA, 20 bp, human
ggaaggtctggcgactaggc

SEQ ID NO: 15926 - DNA, 20 bp, human
gggaggatcacgaggagctg

SEQ ID NO: 15927 - DNA, 20 bp, human
gcctggcctgtctggagcct

SEQ ID NO: 15928 - DNA, 20 bp, human
gggccgcccaggctccagac

SEQ ID NO: 15929 - DNA, 20 bp, human
ggaaggcgctcgggagcgag

SEQ ID NO: 15930 - DNA, 20 bp, human
gacccggaacagccagaagg

SEQ ID NO: 15931 - DNA, 20 bp, human
gtggctgttccgggtccctg

SEQ ID NO: 15932 - DNA, 20 bp, human
gcgggtccctgtggccgccc

SEQ ID NO: 15933 - DNA, 20 bp, human
gtcccgagcgccttccagga

SEQ ID NO: 15934 - DNA, 20 bp, human
gaggccaggggaggatcacg

SEQ ID NO: 15935 - DNA, 20 bp, human
ggctcctcgtgatcctcccc

SEQ ID NO: 15936 - DNA, 20 bp, human
ggagagtgggtggcccgggt

SEQ ID NO: 15937 - DNA, 20 bp, human
ggccggtgcaaggacccaca

SEQ ID NO: 15938 - DNA, 20 bp, human
ggcccaggcttggggaaata

SEQ ID NO: 15939 - DNA, 20 bp, human
ggatcgggcagagggtgact

SEQ ID NO: 15940 - DNA, 20 bp, human
gacctggaggcttagggaca

SEQ ID NO: 15941 - DNA, 20 bp, human
ggaagctacagcctagccga

SEQ ID NO: 15942 - DNA, 20 bp, human
gagcagaatgggtcaagact

SEQ ID NO: 15943 - DNA, 20 bp, human
ggaatggggcatgctacagg

SEQ ID NO: 15944 - DNA, 20 bp, human
gcttagggacagggcttcag

SEQ ID NO: 15945 - DNA, 20 bp, human
ggggctgagggagagaattt

SEQ ID NO: 15946 - DNA, 20 bp, human
ggcgtgcagcaccgacctga

SEQ ID NO: 15947 - DNA, 20 bp, human
gcgaagaggtgccttcaggt

SEQ ID NO: 15948 - DNA, 20 bp, human
gacgagcgaagggtgacacc

SEQ ID NO: 15949 - DNA, 20 bp, human
ggccttttggcacaagtaag

SEQ ID NO: 15950 - DNA, 20 bp, human
gatttcgggctcccccgaag

SEQ ID NO: 15951 - DNA, 20 bp, human
gcccccgaagaggtgccttc

SEQ ID NO: 15952 - DNA, 20 bp, human
gctgactgtgcacgagcgaa

SEQ ID NO: 15953 - DNA, 20 bp, human
gtgaaaatcacagcaagtag

SEQ ID NO: 15954 - DNA, 20 bp, human
gcagagtgtgacaagaacag

SEQ ID NO: 15955 - DNA, 20 bp, human
gagtggcattacaaaaggat

SEQ ID NO: 15956 - DNA, 20 bp, human
gagagcaggtaggcaggtat

SEQ ID NO: 15957 - DNA, 20 bp, human
gaactaaacgacagccctgg

SEQ ID NO: 15958 - DNA, 20 bp, human
ggtcacaagagttgccccca

SEQ ID NO: 15959 - DNA, 20 bp, human
gctagaactaccagggccca

SEQ ID NO: 15960 - DNA, 20 bp, human
gcctgcgtcagtggacaagg

SEQ ID NO: 15961 - DNA, 20 bp, human
ggcagaactgagcagtacat

SEQ ID NO: 15962 - DNA, 20 bp, human
ggccaggctagagttggaca

SEQ ID NO: 15963 - DNA, 20 bp, human
gggggtgtgtgagaccagag

SEQ ID NO: 15964 - DNA, 20 bp, human
gcccagttcatcttccacac

SEQ ID NO: 15965 - DNA, 20 bp, human
gctctgggcagcagcccgtg

SEQ ID NO: 15966 - DNA, 20 bp, human
gggccctggtactgaagacg

SEQ ID NO: 15967 - DNA, 20 bp, human
gagttcggggccctagaacc

SEQ ID NO: 15968 - DNA, 20 bp, human
ggtgagtaggaaacagctag

SEQ ID NO: 15969 - DNA, 20 bp, human
gtaaagcgccacgacatcag

SEQ ID NO: 15970 - DNA, 20 bp, human
ggaccgcgtcttcagtacca

SEQ ID NO: 15971 - DNA, 20 bp, human
gggtaggctagagaaagtag

SEQ ID NO: 15972 - DNA, 20 bp, human
gcctagaaccgggagcgctg

SEQ ID NO: 15973 - DNA, 20 bp, human
gctaagatccagggccagta

SEQ ID NO: 15974 - DNA, 20 bp, human
gtagagaaagtagtggacta

SEQ ID NO: 15975 - DNA, 20 bp, human
ggaaacagctaggggcgacc

SEQ ID NO: 15976 - DNA, 20 bp, human
gtgtccgcgtcgaggagccg

SEQ ID NO: 15977 - DNA, 20 bp, human
ggccacagccgcctcagacg

SEQ ID NO: 15978 - DNA, 20 bp, human
gctcgacgcggacaccgacg

SEQ ID NO: 15979 - DNA, 20 bp, human
ggactgcgccacgtctgagg

SEQ ID NO: 15980 - DNA, 20 bp, human
gagtcctgcttggacaccag

SEQ ID NO: 15981 - DNA, 20 bp, human
gcgcgactgcgccacgtctg

SEQ ID NO: 15982 - DNA, 20 bp, human
ggagcacagcctctactcct

SEQ ID NO: 15983 - DNA, 20 bp, human
gcgagaggaccctgtcaggg

SEQ ID NO: 15984 - DNA, 20 bp, human
gtgcagaacgatctcacagg

SEQ ID NO: 15985 - DNA, 20 bp, human
gcacgcggctctacaggcag

SEQ ID NO: 15986 - DNA, 20 bp, human
ggccccgcagacctgcagaa

SEQ ID NO: 15987 - DNA, 20 bp, human
gtggtgcctgccgagatcta

SEQ ID NO: 15988 - DNA, 20 bp, human
gcgaatgggggccccctagt

SEQ ID NO: 15989 - DNA, 20 bp, human
gggcgagaatcgggagaagg

SEQ ID NO: 15990 - DNA, 20 bp, human
gtctgcggggccaagtgtcc

SEQ ID NO: 15991 - DNA, 20 bp, human
gtgggcgcacgaaacctctc

SEQ ID NO: 15992 - DNA, 20 bp, human
gggaacatagtggtcccctg

SEQ ID NO: 15993 - DNA, 20 bp, human
ggtgcgagggacggtggtgg

SEQ ID NO: 15994 - DNA, 20 bp, human
gcagatccatccctagatct

SEQ ID NO: 15995 - DNA, 20 bp, human
ggggtgcagagtccagtctg

SEQ ID NO: 15996 - DNA, 20 bp, human
gaggacgtgcgggccaggta

SEQ ID NO: 15997 - DNA, 20 bp, human
gcggttctgacgccacaacg

SEQ ID NO: 15998 - DNA, 20 bp, human
gacaggtaccactgccgaga

SEQ ID NO: 15999 - DNA, 20 bp, human
gcctcagggacaccgggaac

SEQ ID NO: 16000 - DNA, 20 bp, human
gcaggtacggccccgaaagt

SEQ ID NO: 16001 - DNA, 20 bp, human
gcggcagtggtacctgttcc

SEQ ID NO: 16002 - DNA, 20 bp, human
gatcaagaagggcggagcag

SEQ ID NO: 16003 - DNA, 20 bp, human
gacgaggtaagactcagtgt

SEQ ID NO: 16004 - DNA, 20 bp, human
gccgtcgctcgctcccttct

SEQ ID NO: 16005 - DNA, 20 bp, human
gctgcagcggaacgctagag

SEQ ID NO: 16006 - DNA, 20 bp, human
gggtggccctgaggacgtgt

SEQ ID NO: 16007 - DNA, 20 bp, human
gtggctcgttccattctcgg

SEQ ID NO: 16008 - DNA, 20 bp, human
gagaatggaacgagccacga

SEQ ID NO: 16009 - DNA, 20 bp, human
gtctggcgtcagagccgtcg

SEQ ID NO: 16010 - DNA, 20 bp, human
ggcgagacaacactcagtgt

SEQ ID NO: 16011 - DNA, 20 bp, human
gaagcttgcgctgatggcgt

SEQ ID NO: 16012 - DNA, 20 bp, human
gctcgttccattctcggcgg

SEQ ID NO: 16013 - DNA, 20 bp, human
gctgaggacgtgtgggccag

SEQ ID NO: 16014 - DNA, 20 bp, human
gctgcggatgcccaccccgg

SEQ ID NO: 16015 - DNA, 20 bp, human
gaggacgtgtgggccagggg

SEQ ID NO: 16016 - DNA, 20 bp, human
gacagccggcaaccaagggt

SEQ ID NO: 16017 - DNA, 20 bp, human
ggttgtcgctggccgtgtga

SEQ ID NO: 16018 - DNA, 20 bp, human
ggcaacagcgagccgtcaca

SEQ ID NO: 16019 - DNA, 20 bp, human
gccagactgcaactaggagg

SEQ ID NO: 16020 - DNA, 20 bp, human
gggtcggtcggtgtaagcgt

SEQ ID NO: 16021 - DNA, 20 bp, human
gtccagctctaaatgggtag

SEQ ID NO: 16022 - DNA, 20 bp, human
gcaactaccagactgcaact

SEQ ID NO: 16023 - DNA, 20 bp, human
ggaggtacagccggcaacca

SEQ ID NO: 16024 - DNA, 20 bp, human
gcggctcgctgttgccctga

SEQ ID NO: 16025 - DNA, 20 bp, human
ggtgcgagaaatggagcggt

SEQ ID NO: 16026 - DNA, 20 bp, human
ggccctagggagccccagga

SEQ ID NO: 16027 - DNA, 20 bp, human
ggggtctgtgctgagaataa

SEQ ID NO: 16028 - DNA, 20 bp, human
gtggcccgggacgagtggaa

SEQ ID NO: 16029 - DNA, 20 bp, human
ggagggagaggcttcgctac

SEQ ID NO: 16030 - DNA, 20 bp, human
ggaaccccgcggccaggagt

SEQ ID NO: 16031 - DNA, 20 bp, human
gaagtaacaagacagagtgg

SEQ ID NO: 16032 - DNA, 20 bp, human
ggtcagagccactccctcct

SEQ ID NO: 16033 - DNA, 20 bp, human
gaccttggaggggaaccacg

SEQ ID NO: 16034 - DNA, 20 bp, human
gtgtggcaagcgctcctggc

SEQ ID NO: 16035 - DNA, 20 bp, human
gtccccagccgggtcgtagg

SEQ ID NO: 16036 - DNA, 20 bp, human
gtgggtaggcagggtacctc

SEQ ID NO: 16037 - DNA, 20 bp, human
gcagcccagacctggccctc

SEQ ID NO: 16038 - DNA, 20 bp, human
gttggagtcctgggtaggca

SEQ ID NO: 16039 - DNA, 20 bp, human
gggtctgggctgagaaagaa

SEQ ID NO: 16040 - DNA, 20 bp, human
gggcagcaggcagcacacct

SEQ ID NO: 16041 - DNA, 20 bp, human
gcgcttgctgtaccttctac

SEQ ID NO: 16042 - DNA, 20 bp, human
gtccattcagctcacatcca

SEQ ID NO: 16043 - DNA, 20 bp, human
gggaaagaaactcccgtaga

SEQ ID NO: 16044 - DNA, 20 bp, human
ggcagggtacctcaggcagc

SEQ ID NO: 16045 - DNA, 20 bp, human
gaactttggccgttcaagaa

SEQ ID NO: 16046 - DNA, 20 bp, human
gcgccagagcagccatgtac

SEQ ID NO: 16047 - DNA, 20 bp, human
gacgtagctgcgccggtaca

SEQ ID NO: 16048 - DNA, 20 bp, human
ggcacgctgctaccatgcag

SEQ ID NO: 16049 - DNA, 20 bp, human
gagtaagcggcggccatcgg

SEQ ID NO: 16050 - DNA, 20 bp, human
gctggagcgccagggcaccg

SEQ ID NO: 16051 - DNA, 20 bp, human
ggcggcgcgcgaagcctcgt

SEQ ID NO: 16052 - DNA, 20 bp, human
ggcgcgggcccgctggacgt

SEQ ID NO: 16053 - DNA, 20 bp, human
gctggaagacgtagctgcgc

SEQ ID NO: 16054 - DNA, 20 bp, human
gcagcgcgtccgggacctgg

SEQ ID NO: 16055 - DNA, 20 bp, human
gccggcatggcgctgctcga

SEQ ID NO: 16056 - DNA, 20 bp, human
gtgctggagctggcactggt

SEQ ID NO: 16057 - DNA, 20 bp, human
gagtgagaggcgagtggtag

SEQ ID NO: 16058 - DNA, 20 bp, human
gggcatgctggagctggcac

SEQ ID NO: 16059 - DNA, 20 bp, human
gctggcccaggaagcccgta

SEQ ID NO: 16060 - DNA, 20 bp, human
gggctgcctggtggaatata

SEQ ID NO: 16061 - DNA, 20 bp, human
gggagctggaaacacaactg

SEQ ID NO: 16062 - DNA, 20 bp, human
ggtgctgttgaggacctagg

SEQ ID NO: 16063 - DNA, 20 bp, human
gtcctgactgacttgctcaa

SEQ ID NO: 16064 - DNA, 20 bp, human
ggagcacccggggtctatgt

SEQ ID NO: 16065 - DNA, 20 bp, human
gtggactctgtaaacccact

SEQ ID NO: 16066 - DNA, 20 bp, human
gaagcaagtagcgccaatct

SEQ ID NO: 16067 - DNA, 20 bp, human
ggtagcgccaatctaggcag

SEQ ID NO: 16068 - DNA, 20 bp, human
gtcacagccgctgcctagat

SEQ ID NO: 16069 - DNA, 20 bp, human
gtggaggttcaacttcaaca

SEQ ID NO: 16070 - DNA, 20 bp, human
gaggccgggccagttagatt

SEQ ID NO: 16071 - DNA, 20 bp, human
gtcgaaatggtagtgccggg

SEQ ID NO: 16072 - DNA, 20 bp, human
gccgggccagttagatttgg

SEQ ID NO: 16073 - DNA, 20 bp, human
gccgcggtgggagtgtttgt

SEQ ID NO: 16074 - DNA, 20 bp, human
gtcgccgccggcaggtaaag

SEQ ID NO: 16075 - DNA, 20 bp, human
ggtgaataccctgactccta

SEQ ID NO: 16076 - DNA, 20 bp, human
gccagggcttgggacagcgg

SEQ ID NO: 16077 - DNA, 20 bp, human
gacccagccacgctctaggg

SEQ ID NO: 16078 - DNA, 20 bp, human
gcaccggacagatagacgtg

SEQ ID NO: 16079 - DNA, 20 bp, human
ggtcacccagccacgctcta

SEQ ID NO: 16080 - DNA, 20 bp, human
gatctgtccggtgtgtccgg

SEQ ID NO: 16081 - DNA, 20 bp, human
gggaccagggcttgggacag

SEQ ID NO: 16082 - DNA, 20 bp, human
gtggctaccaccctagagcg

SEQ ID NO: 16083 - DNA, 20 bp, human
gagagcaccggggaaatctg

SEQ ID NO: 16084 - DNA, 20 bp, human
gttcggtccgccggacacac

SEQ ID NO: 16085 - DNA, 20 bp, human
gtctatctgtccggtgtgtc

SEQ ID NO: 16086 - DNA, 20 bp, human
gagaggcgccccctaagcta

SEQ ID NO: 16087 - DNA, 20 bp, human
gacccgggagctgggaactc

SEQ ID NO: 16088 - DNA, 20 bp, human
gccagctcccgggttacctg

SEQ ID NO: 16089 - DNA, 20 bp, human
gacgtgtccttgtcccccgt

SEQ ID NO: 16090 - DNA, 20 bp, human
gggagctgggaactcgggtg

SEQ ID NO: 16091 - DNA, 20 bp, human
gcgggttacctggggatccg

SEQ ID NO: 16092 - DNA, 20 bp, human
ggagctcaggaggcactctg

SEQ ID NO: 16093 - DNA, 20 bp, human
ggcgccccctaagctagggt

SEQ ID NO: 16094 - DNA, 20 bp, human
ggggcagccgtggaggtcag

SEQ ID NO: 16095 - DNA, 20 bp, human
gggggcgcctctgccggagg

SEQ ID NO: 16096 - DNA, 20 bp, human
gcgctgcggcacgacctggg

SEQ ID NO: 16097 - DNA, 20 bp, human
gcgagccgggccaaggcagt

SEQ ID NO: 16098 - DNA, 20 bp, human
ggggctggcgcgcaggacca

SEQ ID NO: 16099 - DNA, 20 bp, human
gctgcgcagcgtggcgatct

SEQ ID NO: 16100 - DNA, 20 bp, human
gcataaagcccagctggaag

SEQ ID NO: 16101 - DNA, 20 bp, human
gcagggagagcgcggcgatg

SEQ ID NO: 16102 - DNA, 20 bp, human
gggctggacactcccgagac

SEQ ID NO: 16103 - DNA, 20 bp, human
gctcgggagtgtccagcccc

SEQ ID NO: 16104 - DNA, 20 bp, human
gtcgcgacgcggacggtccc

SEQ ID NO: 16105 - DNA, 20 bp, human
gcggctcctccgcctcgccc

SEQ ID NO: 16106 - DNA, 20 bp, human
ggctccgcagagcagaacgt

SEQ ID NO: 16107 - DNA, 20 bp, human
ggagggagcaggcggatctg

SEQ ID NO: 16108 - DNA, 20 bp, human
gctgcattaggcctgccgag

SEQ ID NO: 16109 - DNA, 20 bp, human
gccgcagagcagaacgtggg

SEQ ID NO: 16110 - DNA, 20 bp, human
gccttgggatgaggggtcaa

SEQ ID NO: 16111 - DNA, 20 bp, human
gcaggtgtcgtccgcctctc

SEQ ID NO: 16112 - DNA, 20 bp, human
gaacggcgggatgttaaggt

SEQ ID NO: 16113 - DNA, 20 bp, human
gcagaacgtgggaggaacgg

SEQ ID NO: 16114 - DNA, 20 bp, human
ggaggaacggcgggatgtta

SEQ ID NO: 16115 - DNA, 20 bp, human
ggttctgctctgcggagcac

SEQ ID NO: 16116 - DNA, 20 bp, human
gaagactcccccgtctgtgg

SEQ ID NO: 16117 - DNA, 20 bp, human
gtggagcgcgggatgcacct

SEQ ID NO: 16118 - DNA, 20 bp, human
gacagccgccgccacagacg

SEQ ID NO: 16119 - DNA, 20 bp, human
gccaagcaagataaacggtg

SEQ ID NO: 16120 - DNA, 20 bp, human
gaagaggtcgtcctcgccgg

SEQ ID NO: 16121 - DNA, 20 bp, human
ggggatgcacctcggtgcag

SEQ ID NO: 16122 - DNA, 20 bp, human
ggtggcggcggctgtttgat

SEQ ID NO: 16123 - DNA, 20 bp, human
gaggaagaggtcgtcctcgc

SEQ ID NO: 16124 - DNA, 20 bp, human
gggcggctgtttgatgggtc

SEQ ID NO: 16125 - DNA, 20 bp, human
ggcgcgggaccatggagcgc

SEQ ID NO: 16126 - DNA, 20 bp, human
ggccgggagcctcatcgcag

SEQ ID NO: 16127 - DNA, 20 bp, human
gagagcagcggcgaacagag

SEQ ID NO: 16128 - DNA, 20 bp, human
ggcgagagcagcggtctctg

SEQ ID NO: 16129 - DNA, 20 bp, human
gggtgggcggatgctcatgt

SEQ ID NO: 16130 - DNA, 20 bp, human
gccgggcggcgacctccccg

SEQ ID NO: 16131 - DNA, 20 bp, human
gggacgacgccttcgagcag

SEQ ID NO: 16132 - DNA, 20 bp, human
gctgcgcgtcgcggctggga

SEQ ID NO: 16133 - DNA, 20 bp, human
ggcggcgcgagaacccgaag

SEQ ID NO: 16134 - DNA, 20 bp, human
gtgtgggtgagcagcccccg

SEQ ID NO: 16135 - DNA, 20 bp, human
ggcacctcgcgccccagctc

SEQ ID NO: 16136 - DNA, 20 bp, human
ggactcagcgcacagactgg

SEQ ID NO: 16137 - DNA, 20 bp, human
gctgccgggcaagaacctcc

SEQ ID NO: 16138 - DNA, 20 bp, human
gtccgactcagcgcacagac

SEQ ID NO: 16139 - DNA, 20 bp, human
ggagagtggcgcataacatg

SEQ ID NO: 16140 - DNA, 20 bp, human
gtgcgctgagtcggagccag

SEQ ID NO: 16141 - DNA, 20 bp, human
gggagcacggagacctacca

SEQ ID NO: 16142 - DNA, 20 bp, human
gtaaatgggagcgagtgggt

SEQ ID NO: 16143 - DNA, 20 bp, human
gaagccgaggagtaatggag

SEQ ID NO: 16144 - DNA, 20 bp, human
ggagacctaccagggtaagt

SEQ ID NO: 16145 - DNA, 20 bp, human
ggcatggcccggtgtccccg

SEQ ID NO: 16146 - DNA, 20 bp, human
gcacagttggggaagctcag

SEQ ID NO: 16147 - DNA, 20 bp, human
ggcagagcccctccccgaat

SEQ ID NO: 16148 - DNA, 20 bp, human
gagcatcaggcacccattcg

SEQ ID NO: 16149 - DNA, 20 bp, human
gcaataatctgtgggacggt

SEQ ID NO: 16150 - DNA, 20 bp, human
ggagcaaactaccagcgcag

SEQ ID NO: 16151 - DNA, 20 bp, human
gggtagtttgctctcactcc

SEQ ID NO: 16152 - DNA, 20 bp, human
gtaggcttgggagaccttgg

SEQ ID NO: 16153 - DNA, 20 bp, human
gagacgcacagatcccccca

SEQ ID NO: 16154 - DNA, 20 bp, human
gcaggcacccattcggggag

SEQ ID NO: 16155 - DNA, 20 bp, human
gcccttgcgaatatctgtct

SEQ ID NO: 16156 - DNA, 20 bp, human
gacacggatgcggaccgact

SEQ ID NO: 16157 - DNA, 20 bp, human
ggcggactcggagcagctcg

SEQ ID NO: 16158 - DNA, 20 bp, human
gcaggtggtcgacacggatg

SEQ ID NO: 16159 - DNA, 20 bp, human
ggacacccagccgtcaggga

SEQ ID NO: 16160 - DNA, 20 bp, human
ggagggagtaggaggatgat

SEQ ID NO: 16161 - DNA, 20 bp, human
gcaaggatcacatagatctg

SEQ ID NO: 16162 - DNA, 20 bp, human
gtggggacacccagccgtca

SEQ ID NO: 16163 - DNA, 20 bp, human
gccacgaagatgccacccgt

SEQ ID NO: 16164 - DNA, 20 bp, human
gtggaaggctcggagttctg

SEQ ID NO: 16165 - DNA, 20 bp, human
gtccgtgtcgaccacctgtc

SEQ ID NO: 16166 - DNA, 20 bp, human
gggagctccgcgaggatcga

SEQ ID NO: 16167 - DNA, 20 bp, human
gccacagagccgcggcacca

SEQ ID NO: 16168 - DNA, 20 bp, human
gagcgccaggcaccgagtaa

SEQ ID NO: 16169 - DNA, 20 bp, human
gggacgcccgggggccaaga

SEQ ID NO: 16170 - DNA, 20 bp, human
gaagagctgcgggcgagggt

SEQ ID NO: 16171 - DNA, 20 bp, human
gggagtcgctcgcagcccag

SEQ ID NO: 16172 - DNA, 20 bp, human
gactcaccttcttggccccc

SEQ ID NO: 16173 - DNA, 20 bp, human
gtggcacctgctggacgccc

SEQ ID NO: 16174 - DNA, 20 bp, human
gagtccgaagagttcccgga

SEQ ID NO: 16175 - DNA, 20 bp, human
gaatccgtccgggaactctt

SEQ ID NO: 16176 - DNA, 20 bp, human
gggagagtccgagaacacga

SEQ ID NO: 16177 - DNA, 20 bp, human
gcagcgcctggaaatctgag

SEQ ID NO: 16178 - DNA, 20 bp, human
gggagagcccggctacctgg

SEQ ID NO: 16179 - DNA, 20 bp, human
gtgaggccatgttacaaggt

SEQ ID NO: 16180 - DNA, 20 bp, human
gcggagccggaggacaccca

SEQ ID NO: 16181 - DNA, 20 bp, human
gggccccggtccgggtccag

SEQ ID NO: 16182 - DNA, 20 bp, human
ggcagccactggacccggac

SEQ ID NO: 16183 - DNA, 20 bp, human
gggagcgcttccgcgtggac

SEQ ID NO: 16184 - DNA, 20 bp, human
gtgagaggcgtggaagggtg

SEQ ID NO: 16185 - DNA, 20 bp, human
gaggtagccgggctctccct

SEQ ID NO: 16186 - DNA, 20 bp, human
gggccctgcagcagccggtg

SEQ ID NO: 16187 - DNA, 20 bp, human
ggcggaatgatgcagtctcg

SEQ ID NO: 16188 - DNA, 20 bp, human
gccatagccccggtggatgg

SEQ ID NO: 16189 - DNA, 20 bp, human
ggatgccccgccggctctgg

SEQ ID NO: 16190 - DNA, 20 bp, human
gagactgcatcattccgcac

SEQ ID NO: 16191 - DNA, 20 bp, human
gccggccccgaggacacatg

SEQ ID NO: 16192 - DNA, 20 bp, human
gagccgccgccacgcgggaa

SEQ ID NO: 16193 - DNA, 20 bp, human
gtccctcccttcccgcgtgg

SEQ ID NO: 16194 - DNA, 20 bp, human
gcgcggcccgggagacatgg

SEQ ID NO: 16195 - DNA, 20 bp, human
gccgctgccaccagagccgg

SEQ ID NO: 16196 - DNA, 20 bp, human
gggcctgcgagagcctcagt

SEQ ID NO: 16197 - DNA, 20 bp, human
gcagcggcggcggctgagga

SEQ ID NO: 16198 - DNA, 20 bp, human
gggcgtcgtccctggcacca

SEQ ID NO: 16199 - DNA, 20 bp, human
gggcctgtgggcgtcgtccc

SEQ ID NO: 16200 - DNA, 20 bp, human
gctcccactgaggctctcgc

SEQ ID NO: 16201 - DNA, 20 bp, human
gaggtcagcttgccaagcgg

SEQ ID NO: 16202 - DNA, 20 bp, human
gacgcgtgagaagatccagg

SEQ ID NO: 16203 - DNA, 20 bp, human
gaccacgcgtgagaagatcc

SEQ ID NO: 16204 - DNA, 20 bp, human
gcagccctcggccaccatgt

SEQ ID NO: 16205 - DNA, 20 bp, human
gggcgggcgggcggccgtcg

SEQ ID NO: 16206 - DNA, 20 bp, human
gcgaccgtgtccgcgcgcct

SEQ ID NO: 16207 - DNA, 20 bp, human
gactcaccaccctccagccg

SEQ ID NO: 16208 - DNA, 20 bp, human
gggccgaggcagcgtctccc

SEQ ID NO: 16209 - DNA, 20 bp, human
gcaccaccctccagccgcgg

SEQ ID NO: 16210 - DNA, 20 bp, human
ggctggaaagaccacggtgt

SEQ ID NO: 16211 - DNA, 20 bp, human
ggaggggccgaggccagccc

SEQ ID NO: 16212 - DNA, 20 bp, human
ggattccgatccgccggcaa

SEQ ID NO: 16213 - DNA, 20 bp, human
gcgcgcggggcgccataagg

SEQ ID NO: 16214 - DNA, 20 bp, human
gcgcctgggagacgctgcct

SEQ ID NO: 16215 - DNA, 20 bp, human
gggcgccataaggaggaagc

SEQ ID NO: 16216 - DNA, 20 bp, human
gagacacgaagcctcccggg

SEQ ID NO: 16217 - DNA, 20 bp, human
gcacccggctccgaactctg

SEQ ID NO: 16218 - DNA, 20 bp, human
gcgtctgtaagccacccggg

SEQ ID NO: 16219 - DNA, 20 bp, human
ggccgcactggaggactgtg

SEQ ID NO: 16220 - DNA, 20 bp, human
gctggagccccggacagaga

SEQ ID NO: 16221 - DNA, 20 bp, human
gcagcgtctgtaagccaccc

SEQ ID NO: 16222 - DNA, 20 bp, human
gcacctggcggcggcgatgc

SEQ ID NO: 16223 - DNA, 20 bp, human
gtccgcacgaccccagagtt

SEQ ID NO: 16224 - DNA, 20 bp, human
gacccggccagaccgtagcg

SEQ ID NO: 16225 - DNA, 20 bp, human
gtaagggcaccggggctgtg

SEQ ID NO: 16226 - DNA, 20 bp, human
gcacgccgcgcacccgacag

SEQ ID NO: 16227 - DNA, 20 bp, human
gcgacagcggagccaactga

SEQ ID NO: 16228 - DNA, 20 bp, human
gcccggccgcgcgtccagac

SEQ ID NO: 16229 - DNA, 20 bp, human
gcagcggagccaactgacgg

SEQ ID NO: 16230 - DNA, 20 bp, human
gacccggccggggcaggaca

SEQ ID NO: 16231 - DNA, 20 bp, human
ggagggcacccagagcgccg

SEQ ID NO: 16232 - DNA, 20 bp, human
ggcgccgcgatggcagagat

SEQ ID NO: 16233 - DNA, 20 bp, human
gctagaggagcgctttcgag

SEQ ID NO: 16234 - DNA, 20 bp, human
gcggagccaactgacggagg

SEQ ID NO: 16235 - DNA, 20 bp, human
gtggctcggctgcacagcag

SEQ ID NO: 16236 - DNA, 20 bp, human
gagggtctgggctgacgaga

SEQ ID NO: 16237 - DNA, 20 bp, human
gcggccacctaccttctcct

SEQ ID NO: 16238 - DNA, 20 bp, human
gctcggcctcggctccctgt

SEQ ID NO: 16239 - DNA, 20 bp, human
ggccatcctgccaactccct

SEQ ID NO: 16240 - DNA, 20 bp, human
gtggggagacaacagtctct

SEQ ID NO: 16241 - DNA, 20 bp, human
gcgatcttgggcaaggataa

SEQ ID NO: 16242 - DNA, 20 bp, human
ggagaccgccacccgatctt

SEQ ID NO: 16243 - DNA, 20 bp, human
gtcagcctgagggttgtcga

SEQ ID NO: 16244 - DNA, 20 bp, human
gtgtgctagcaatccaaaat

SEQ ID NO: 16245 - DNA, 20 bp, human
gagaaccttcgacaaccctc

SEQ ID NO: 16246 - DNA, 20 bp, human
gcaccgagggaacgacccta

SEQ ID NO: 16247 - DNA, 20 bp, human
gggaccccggcggcagacgc

SEQ ID NO: 16248 - DNA, 20 bp, human
gaccctagagaaacgagttg

SEQ ID NO: 16249 - DNA, 20 bp, human
gcaggttcgggaccatgagc

SEQ ID NO: 16250 - DNA, 20 bp, human
gcgactccggaaagcaccga

SEQ ID NO: 16251 - DNA, 20 bp, human
ggaacctgcgtctgccgccg

SEQ ID NO: 16252 - DNA, 20 bp, human
ggccacaactcgtttctcta

SEQ ID NO: 16253 - DNA, 20 bp, human
ggcggggcagagatgcccac

SEQ ID NO: 16254 - DNA, 20 bp, human
ggacactgactccacctcaa

SEQ ID NO: 16255 - DNA, 20 bp, human
gcctggagactggttgaatc

SEQ ID NO: 16256 - DNA, 20 bp, human
gccgcagagccgggaatcag

SEQ ID NO: 16257 - DNA, 20 bp, human
gcggcgccgacaaggagata

SEQ ID NO: 16258 - DNA, 20 bp, human
ggtcagagtgagcccggatg

SEQ ID NO: 16259 - DNA, 20 bp, human
ggcgggccgtatctccttgt

SEQ ID NO: 16260 - DNA, 20 bp, human
gggaatcagcggcgccgaca

SEQ ID NO: 16261 - DNA, 20 bp, human
gaagctgcgcggctgcctag

SEQ ID NO: 16262 - DNA, 20 bp, human
gcggcgaacgaggaaggacg

SEQ ID NO: 16263 - DNA, 20 bp, human
gctggaatgacagagcgcag

SEQ ID NO: 16264 - DNA, 20 bp, human
ggctcggctcggatcagccc

SEQ ID NO: 16265 - DNA, 20 bp, human
gcggctctgcggaggcctct

SEQ ID NO: 16266 - DNA, 20 bp, human
gggtgtcgcttgaaaagact

SEQ ID NO: 16267 - DNA, 20 bp, human
gagagcctaaggcagagctc

SEQ ID NO: 16268 - DNA, 20 bp, human
ggcgccctccggcacggaaa

SEQ ID NO: 16269 - DNA, 20 bp, human
gagactcgcgccctccggca

SEQ ID NO: 16270 - DNA, 20 bp, human
ggcagagctctggcacagga

SEQ ID NO: 16271 - DNA, 20 bp, human
gggcagcaggtgggcaagga

SEQ ID NO: 16272 - DNA, 20 bp, human
ggacgacgcatgcaccagca

SEQ ID NO: 16273 - DNA, 20 bp, human
gacggaaaaggccaggcgac

SEQ ID NO: 16274 - DNA, 20 bp, human
ggcgtgagactcgcgccctc

SEQ ID NO: 16275 - DNA, 20 bp, human
gggttgccaagagttatcac

SEQ ID NO: 16276 - DNA, 20 bp, human
gcaggcagggggcaacgtcg

SEQ ID NO: 16277 - DNA, 20 bp, human
gcgggacccgttggcagagg

SEQ ID NO: 16278 - DNA, 20 bp, human
gtttgaatcgcgggacccgt

SEQ ID NO: 16279 - DNA, 20 bp, human
gcagcctcggccatctgcaa

SEQ ID NO: 16280 - DNA, 20 bp, human
gtcgcgggacccgttggcag

SEQ ID NO: 16281 - DNA, 20 bp, human
gggacagcacagctcgtgag

SEQ ID NO: 16282 - DNA, 20 bp, human
gcacagctcgtgagtggacg

SEQ ID NO: 16283 - DNA, 20 bp, human
gagtcacagtggcctcgcta

SEQ ID NO: 16284 - DNA, 20 bp, human
gcactgtgactgggcctcgg

SEQ ID NO: 16285 - DNA, 20 bp, human
ggtctggctcgttctcagtg

SEQ ID NO: 16286 - DNA, 20 bp, human
gcggaggggccaaactcgga

SEQ ID NO: 16287 - DNA, 20 bp, human
gacgcggaacgtcgatcgcc

SEQ ID NO: 16288 - DNA, 20 bp, human
ggctcagtgacagtcccggg

SEQ ID NO: 16289 - DNA, 20 bp, human
gagcggctcagtgacagtcc

SEQ ID NO: 16290 - DNA, 20 bp, human
gggaccatcaaagtcatcga

SEQ ID NO: 16291 - DNA, 20 bp, human
gaggcccggaagctgatgga

SEQ ID NO: 16292 - DNA, 20 bp, human
gtgcaggcctccgcgctcag

SEQ ID NO: 16293 - DNA, 20 bp, human
ggttcgggcccagccgtgaa

SEQ ID NO: 16294 - DNA, 20 bp, human
ggcgagatggcgagagggca

SEQ ID NO: 16295 - DNA, 20 bp, human
gagaccggcgagtcagggag

SEQ ID NO: 16296 - DNA, 20 bp, human
gtgtcacggggcccctggca

SEQ ID NO: 16297 - DNA, 20 bp, human
ggtggcacctcagcagtcag

SEQ ID NO: 16298 - DNA, 20 bp, human
gcagctgcggcccctgacag

SEQ ID NO: 16299 - DNA, 20 bp, human
ggcctgccaccagacaccct

SEQ ID NO: 16300 - DNA, 20 bp, human
ggtcagcggccagtcataga

SEQ ID NO: 16301 - DNA, 20 bp, human
gcagcagccagcagctcggg

SEQ ID NO: 16302 - DNA, 20 bp, human
gggacagcagggataggcac

SEQ ID NO: 16303 - DNA, 20 bp, human
gctgggaggggagtatccca

SEQ ID NO: 16304 - DNA, 20 bp, human
gtcctgcgtgggaccatcac

SEQ ID NO: 16305 - DNA, 20 bp, human
gagcggccagtcatagaagg

SEQ ID NO: 16306 - DNA, 20 bp, human
gcacttcccagagctccgaa

SEQ ID NO: 16307 - DNA, 20 bp, human
gtagacaggtggcaacgtgg

SEQ ID NO: 16308 - DNA, 20 bp, human
gcctccagctggaaaccacg

SEQ ID NO: 16309 - DNA, 20 bp, human
gccagctggaaaccacgcgg

SEQ ID NO: 16310 - DNA, 20 bp, human
gccctgaagcggtagacagg

SEQ ID NO: 16311 - DNA, 20 bp, human
gtaccgcttcagggcagcta

SEQ ID NO: 16312 - DNA, 20 bp, human
gagcgcgcggtgctaatcgt

SEQ ID NO: 16313 - DNA, 20 bp, human
ggtgtctgcagacatcaatg

SEQ ID NO: 16314 - DNA, 20 bp, human
gtggaaaccacgcggtggag

SEQ ID NO: 16315 - DNA, 20 bp, human
gccgtctcgcgccaggatag

SEQ ID NO: 16316 - DNA, 20 bp, human
gacaggccagaggtaccccg

SEQ ID NO: 16317 - DNA, 20 bp, human
ggcgagaggtggtaaaatcc

SEQ ID NO: 16318 - DNA, 20 bp, human
gcaggtggctgcgcgtagag

SEQ ID NO: 16319 - DNA, 20 bp, human
gtagttcgcgacaggacgag

SEQ ID NO: 16320 - DNA, 20 bp, human
gaccccacccgacaggccag

SEQ ID NO: 16321 - DNA, 20 bp, human
gcgcccaggtgcccagcgga

SEQ ID NO: 16322 - DNA, 20 bp, human
gtctcggtcaccgctttcgg

SEQ ID NO: 16323 - DNA, 20 bp, human
gaagtaaataaatgggcgag

SEQ ID NO: 16324 - DNA, 20 bp, human
ggacgagcggaaatactgcc

SEQ ID NO: 16325 - DNA, 20 bp, human
gacccgtgcgcccctttgat

SEQ ID NO: 16326 - DNA, 20 bp, human
gcccagcccgcagagcccaa

SEQ ID NO: 16327 - DNA, 20 bp, human
gcgcgggagggcgaaaccag

SEQ ID NO: 16328 - DNA, 20 bp, human
gcggtgagggaaggtagagg

SEQ ID NO: 16329 - DNA, 20 bp, human
gggaggacaccgggtgggaa

SEQ ID NO: 16330 - DNA, 20 bp, human
gtcttccggccggtgaggga

SEQ ID NO: 16331 - DNA, 20 bp, human
gcgagcggcgagcttgtcag

SEQ ID NO: 16332 - DNA, 20 bp, human
gggaggcctcggcggccctt

SEQ ID NO: 16333 - DNA, 20 bp, human
gcattccggtgacctcgtaa

SEQ ID NO: 16334 - DNA, 20 bp, human
gaccagaggcgcatagcccc

SEQ ID NO: 16335 - DNA, 20 bp, human
gcgagcttgtcagaggacgg

SEQ ID NO: 16336 - DNA, 20 bp, human
ggagcacccttgggtcccaa

SEQ ID NO: 16337 - DNA, 20 bp, human
gcacctgaagagaatctaca

SEQ ID NO: 16338 - DNA, 20 bp, human
ggagtcactggacaactcca

SEQ ID NO: 16339 - DNA, 20 bp, human
gaggagatggtcattatcca

SEQ ID NO: 16340 - DNA, 20 bp, human
ggaggtcgcctggttgagaa

SEQ ID NO: 16341 - DNA, 20 bp, human
gtgtccagtgactcatacac

SEQ ID NO: 16342 - DNA, 20 bp, human
gagataaagaggtactatca

SEQ ID NO: 16343 - DNA, 20 bp, human
gtcgaaacacaaatcaggta

SEQ ID NO: 16344 - DNA, 20 bp, human
gggtatcccgactagtacat

SEQ ID NO: 16345 - DNA, 20 bp, human
gccttgtataatactagata

SEQ ID NO: 16346 - DNA, 20 bp, human
gctgcggcagacggcgacag

SEQ ID NO: 16347 - DNA, 20 bp, human
ggtacctgcaagccctgcca

SEQ ID NO: 16348 - DNA, 20 bp, human
gcggcgtcggtggcgagctg

SEQ ID NO: 16349 - DNA, 20 bp, human
gcccaagcaggttgacgcca

SEQ ID NO: 16350 - DNA, 20 bp, human
gtctgcagccccgggttcca

SEQ ID NO: 16351 - DNA, 20 bp, human
gcccaggctaggtccaatca

SEQ ID NO: 16352 - DNA, 20 bp, human
ggcagggcttgcaggtaccg

SEQ ID NO: 16353 - DNA, 20 bp, human
gagccccgggttccacggca

SEQ ID NO: 16354 - DNA, 20 bp, human
gcggcttcctgcggcgtcgg

SEQ ID NO: 16355 - DNA, 20 bp, human
ggacaggcctctcacaagct

SEQ ID NO: 16356 - DNA, 20 bp, human
gaaagcacgcctgccactgg

SEQ ID NO: 16357 - DNA, 20 bp, human
gggcagttccatttatccag

SEQ ID NO: 16358 - DNA, 20 bp, human
ggaataagtacatgacccct

SEQ ID NO: 16359 - DNA, 20 bp, human
gcaagagcgcctccagtggc

SEQ ID NO: 16360 - DNA, 20 bp, human
ggatggatagagcgagcctc

SEQ ID NO: 16361 - DNA, 20 bp, human
gactgaaaacagcttccaag

SEQ ID NO: 16362 - DNA, 20 bp, human
gggataaatggaactgccag

SEQ ID NO: 16363 - DNA, 20 bp, human
ggtgtgtgctctacacagga

SEQ ID NO: 16364 - DNA, 20 bp, human
gagtagccacttgaaatcaa

SEQ ID NO: 16365 - DNA, 20 bp, human
gctgagtgtgtgctctacac

SEQ ID NO: 16366 - DNA, 20 bp, human
gttctgccggcagcagacag

SEQ ID NO: 16367 - DNA, 20 bp, human
gggcagtgaatgtgccacag

SEQ ID NO: 16368 - DNA, 20 bp, human
gggctctgatcgcagaccgg

SEQ ID NO: 16369 - DNA, 20 bp, human
gcagaggagagaagggacgt

SEQ ID NO: 16370 - DNA, 20 bp, human
gataaaaggtcatccatcca

SEQ ID NO: 16371 - DNA, 20 bp, human
ggtgccacagacggaggaag

SEQ ID NO: 16372 - DNA, 20 bp, human
gggagcctgctccactgtaa

SEQ ID NO: 16373 - DNA, 20 bp, human
gacagaggtggcagcacccc

SEQ ID NO: 16374 - DNA, 20 bp, human
gaagcagaatctaccctgga

SEQ ID NO: 16375 - DNA, 20 bp, human
gctgtgggtgccacagacgg

SEQ ID NO: 16376 - DNA, 20 bp, human
gcacgcagactcctagcgga

SEQ ID NO: 16377 - DNA, 20 bp, human
ggcgcgggaagtttggatcc

SEQ ID NO: 16378 - DNA, 20 bp, human
gctcgcacgcagactcctag

SEQ ID NO: 16379 - DNA, 20 bp, human
gtccggcgggaagtgagcca

SEQ ID NO: 16380 - DNA, 20 bp, human
gcgcgcgcgtaactacgggt

SEQ ID NO: 16381 - DNA, 20 bp, human
ggtagtagtgccagaggtct

SEQ ID NO: 16382 - DNA, 20 bp, human
ggccagactagaggactcag

SEQ ID NO: 16383 - DNA, 20 bp, human
gggttgcggcgcgggaagtt

SEQ ID NO: 16384 - DNA, 20 bp, human
gactcctagcggacggaacc

SEQ ID NO: 16385 - DNA, 20 bp, human
gggcgtcggaggccgagcat

SEQ ID NO: 16386 - DNA, 20 bp, human
gcgggtgcgagagacaggtc

SEQ ID NO: 16387 - DNA, 20 bp, human
ggagacaggtcgggccccct

SEQ ID NO: 16388 - DNA, 20 bp, human
gcgctccgggtgcgagagac

SEQ ID NO: 16389 - DNA, 20 bp, human
gcagcggggaaacccataag

SEQ ID NO: 16390 - DNA, 20 bp, human
gtctgggcaagtacgaactg

SEQ ID NO: 16391 - DNA, 20 bp, human
gtaagcggcatcctcctcca

SEQ ID NO: 16392 - DNA, 20 bp, human
ggctgcggctcgctgcctag

SEQ ID NO: 16393 - DNA, 20 bp, human
gagcgccggaaaaaggaaac

SEQ ID NO: 16394 - DNA, 20 bp, human
gcacccggagcgccggaaaa

SEQ ID NO: 16395 - DNA, 20 bp, human
ggagcgccgggattgcgctg

SEQ ID NO: 16396 - DNA, 20 bp, human
gccggaacccttgagaccag

SEQ ID NO: 16397 - DNA, 20 bp, human
ggcagttcctggccctccta

SEQ ID NO: 16398 - DNA, 20 bp, human
gggtaagcctctggtctcaa

SEQ ID NO: 16399 - DNA, 20 bp, human
ggagcagcatggtaagcctc

SEQ ID NO: 16400 - DNA, 20 bp, human
gctcagaaatcagacttgag

SEQ ID NO: 16401 - DNA, 20 bp, human
gtcagtagaatctaagccct

SEQ ID NO: 16402 - DNA, 20 bp, human
ggacacgaataactgtccag

SEQ ID NO: 16403 - DNA, 20 bp, human
gtaccatgctgctccctagg

SEQ ID NO: 16404 - DNA, 20 bp, human
gagatgccataagagcactg

SEQ ID NO: 16405 - DNA, 20 bp, human
gttgggtggcacttgctata

SEQ ID NO: 16406 - DNA, 20 bp, human
ggggacagcatggtcacgtc

SEQ ID NO: 16407 - DNA, 20 bp, human
gcaataggcagggcgctccg

SEQ ID NO: 16408 - DNA, 20 bp, human
gagaggctcccagggccaat

SEQ ID NO: 16409 - DNA, 20 bp, human
gcggcgggaaggagcgactc

SEQ ID NO: 16410 - DNA, 20 bp, human
gccaggacgagaggctccca

SEQ ID NO: 16411 - DNA, 20 bp, human
gaaggagcgactctggaggg

SEQ ID NO: 16412 - DNA, 20 bp, human
ggaagctggaacgctcacct

SEQ ID NO: 16413 - DNA, 20 bp, human
gcgggaaggagcgactctgg

SEQ ID NO: 16414 - DNA, 20 bp, human
gtccagcttccggagccgga

SEQ ID NO: 16415 - DNA, 20 bp, human
ggggtacgccgggccccctc

SEQ ID NO: 16416 - DNA, 20 bp, human
gaacagcgcggggtccgcta

SEQ ID NO: 16417 - DNA, 20 bp, human
gcgggtcgccagtacgccct

SEQ ID NO: 16418 - DNA, 20 bp, human
gaaggcaagtggagggatgt

SEQ ID NO: 16419 - DNA, 20 bp, human
gctatggcggcggcagccga

SEQ ID NO: 16420 - DNA, 20 bp, human
gcatccattccgggtacctc

SEQ ID NO: 16421 - DNA, 20 bp, human
gagcgcggggtccgctatgg

SEQ ID NO: 16422 - DNA, 20 bp, human
gtcctcagctgtctccacgg

SEQ ID NO: 16423 - DNA, 20 bp, human
gtcgggcgggctcatcactc

SEQ ID NO: 16424 - DNA, 20 bp, human
gctggattagcaccgggtgt

SEQ ID NO: 16425 - DNA, 20 bp, human
gccgcccgaggtacccggaa

SEQ ID NO: 16426 - DNA, 20 bp, human
gcagcactcgggttaggaag

SEQ ID NO: 16427 - DNA, 20 bp, human
gcggtgagaacgcagcactc

SEQ ID NO: 16428 - DNA, 20 bp, human
ggagcgtcagctgccgggta

SEQ ID NO: 16429 - DNA, 20 bp, human
gtctcaccgtggcagctgaa

SEQ ID NO: 16430 - DNA, 20 bp, human
gtaacgccaaagaccgtacc

SEQ ID NO: 16431 - DNA, 20 bp, human
gagaacgcagcactcgggtt

SEQ ID NO: 16432 - DNA, 20 bp, human
gacgccatggcaccgaacta

SEQ ID NO: 16433 - DNA, 20 bp, human
ggggtgtggcctctactagg

SEQ ID NO: 16434 - DNA, 20 bp, human
gggagggtgtggcctctact

SEQ ID NO: 16435 - DNA, 20 bp, human
gctctgctgggggcactcat

SEQ ID NO: 16436 - DNA, 20 bp, human
gctggaagtggagctaggat

SEQ ID NO: 16437 - DNA, 20 bp, human
gcccacaagaacccaggatg

SEQ ID NO: 16438 - DNA, 20 bp, human
gcagagcagagcccagtgtg

SEQ ID NO: 16439 - DNA, 20 bp, human
gaaaacaaggacccagccta

SEQ ID NO: 16440 - DNA, 20 bp, human
gactgccttcaccctaggct

SEQ ID NO: 16441 - DNA, 20 bp, human
gctgagtgaaggaagacggc

SEQ ID NO: 16442 - DNA, 20 bp, human
ggttcttcccacaagaaccc

SEQ ID NO: 16443 - DNA, 20 bp, human
gttaaccgggcagctggacg

SEQ ID NO: 16444 - DNA, 20 bp, human
gtttggtttctgcttatggt

SEQ ID NO: 16445 - DNA, 20 bp, human
ggccacatcctgggttcttg

SEQ ID NO: 16446 - DNA, 20 bp, human
gcgtgaacagacgccctcgc

SEQ ID NO: 16447 - DNA, 20 bp, human
gtgcgcagtcgggtggtcgc

SEQ ID NO: 16448 - DNA, 20 bp, human
gcagcggcgcggcgaagcag

SEQ ID NO: 16449 - DNA, 20 bp, human
gcgcgaaggccgccgagatg

SEQ ID NO: 16450 - DNA, 20 bp, human
gtagatgcgccgcatctcgg

SEQ ID NO: 16451 - DNA, 20 bp, human
gccagagtggacgagttcgt

SEQ ID NO: 16452 - DNA, 20 bp, human
gaagcgagcgctgcgcagtc

SEQ ID NO: 16453 - DNA, 20 bp, human
ggtgccgcgcatccacgcga

SEQ ID NO: 16454 - DNA, 20 bp, human
gacgccctcgctgacgacgt

SEQ ID NO: 16455 - DNA, 20 bp, human
gcgcagggcgccgcctggag

SEQ ID NO: 16456 - DNA, 20 bp, human
ggagggacagagacccctgt

SEQ ID NO: 16457 - DNA, 20 bp, human
gaactggtcgggatgagtgg

SEQ ID NO: 16458 - DNA, 20 bp, human
gcggaactggtcgggatgag

SEQ ID NO: 16459 - DNA, 20 bp, human
ggggcggcctcacaacccac

SEQ ID NO: 16460 - DNA, 20 bp, human
ggcgcagcgtggccgcgggt

SEQ ID NO: 16461 - DNA, 20 bp, human
gggcggtggcagcaagaaga

SEQ ID NO: 16462 - DNA, 20 bp, human
ggaccaggaacagatcgggt

SEQ ID NO: 16463 - DNA, 20 bp, human
gttgctgccaccgcccgggg

SEQ ID NO: 16464 - DNA, 20 bp, human
gcaccgacgtgtagtggaaa

SEQ ID NO: 16465 - DNA, 20 bp, human
ggcgccagcccgggacccgg

SEQ ID NO: 16466 - DNA, 20 bp, human
gcagggaagaagcaaacgtg

SEQ ID NO: 16467 - DNA, 20 bp, human
gcggcacctaacgactccag

SEQ ID NO: 16468 - DNA, 20 bp, human
ggccagccgctggagtcgtt

SEQ ID NO: 16469 - DNA, 20 bp, human
gaactccggagaaaccctgg

SEQ ID NO: 16470 - DNA, 20 bp, human
gtccctgtgttcccagctgg

SEQ ID NO: 16471 - DNA, 20 bp, human
ggcggaactgaagtcccgag

SEQ ID NO: 16472 - DNA, 20 bp, human
gacctgagtgagtagaactc

SEQ ID NO: 16473 - DNA, 20 bp, human
gccccggcctccaggcagta

SEQ ID NO: 16474 - DNA, 20 bp, human
ggggccccgtccggagacga

SEQ ID NO: 16475 - DNA, 20 bp, human
gcggcctccaggcagtaggg

SEQ ID NO: 16476 - DNA, 20 bp, human
ggcggtgcccgcgtcaggtg

SEQ ID NO: 16477 - DNA, 20 bp, human
gcgcgtgccgcgtagtccgg

SEQ ID NO: 16478 - DNA, 20 bp, human
gctggagccgccggactacg

SEQ ID NO: 16479 - DNA, 20 bp, human
gcgcgcgcctcacctgacgc

SEQ ID NO: 16480 - DNA, 20 bp, human
gcaaagccggtggcgcccgg

SEQ ID NO: 16481 - DNA, 20 bp, human
gggagagcggtgcccgcgtc

SEQ ID NO: 16482 - DNA, 20 bp, human
gcccgggcgtagccaccgca

SEQ ID NO: 16483 - DNA, 20 bp, human
gccccggtccgcaaagccgg

SEQ ID NO: 16484 - DNA, 20 bp, human
gtccgctggggcgaatcctg

SEQ ID NO: 16485 - DNA, 20 bp, human
ggtccgcgtgccgcgtagtc

SEQ ID NO: 16486 - DNA, 20 bp, human
ggttcctgtagcactcggct

SEQ ID NO: 16487 - DNA, 20 bp, human
gccgcaagcaaactaggttg

SEQ ID NO: 16488 - DNA, 20 bp, human
gctacaggaactgcgtacac

SEQ ID NO: 16489 - DNA, 20 bp, human
gttgcagccatcaagttccc

SEQ ID NO: 16490 - DNA, 20 bp, human
ggaagagagtggcttctctt

SEQ ID NO: 16491 - DNA, 20 bp, human
gatcaagttcccaggcacaa

SEQ ID NO: 16492 - DNA, 20 bp, human
ggagtcccatacctgttctt

SEQ ID NO: 16493 - DNA, 20 bp, human
gggcactgaccactcccaga

SEQ ID NO: 16494 - DNA, 20 bp, human
gacgcagttcctgtagcact

SEQ ID NO: 16495 - DNA, 20 bp, human
gctggctccgcaagcaaact

SEQ ID NO: 16496 - DNA, 20 bp, human
ggtgcaaggcctcagagtct

SEQ ID NO: 16497 - DNA, 20 bp, human
gccatcgtacgggatcgtgg

SEQ ID NO: 16498 - DNA, 20 bp, human
gcgcgcgtgccgagactctg

SEQ ID NO: 16499 - DNA, 20 bp, human
ggttgttcctggcttgagta

SEQ ID NO: 16500 - DNA, 20 bp, human
gcaggtgtatgaggactcag

SEQ ID NO: 16501 - DNA, 20 bp, human
gcagggtggtgagcccggtc

SEQ ID NO: 16502 - DNA, 20 bp, human
gcaagccaggaacaacgggg

SEQ ID NO: 16503 - DNA, 20 bp, human
gttcttgacggccatcgtac

SEQ ID NO: 16504 - DNA, 20 bp, human
gacagtcgtgtgtaagtcca

SEQ ID NO: 16505 - DNA, 20 bp, human
ggtgagcccggtctggccag

SEQ ID NO: 16506 - DNA, 20 bp, human
ggctgctctgcgaaacgtac

SEQ ID NO: 16507 - DNA, 20 bp, human
gttcgcagagcagctatcaa

SEQ ID NO: 16508 - DNA, 20 bp, human
ggagagagctgctggatatg

SEQ ID NO: 16509 - DNA, 20 bp, human
gagagctgctggatatgcgg

SEQ ID NO: 16510 - DNA, 20 bp, human
ggcggagggactgggcgggt

SEQ ID NO: 16511 - DNA, 20 bp, human
ggggcgggtcggcttccgaa

SEQ ID NO: 16512 - DNA, 20 bp, human
gctggatatgcggagggact

SEQ ID NO: 16513 - DNA, 20 bp, human
ggtcggcttccgaatggaag

SEQ ID NO: 16514 - DNA, 20 bp, human
gcttgataggctcttcggat

SEQ ID NO: 16515 - DNA, 20 bp, human
gggggtgaagaagtaagtag

SEQ ID NO: 16516 - DNA, 20 bp, human
ggaggccactccgcacggtg

SEQ ID NO: 16517 - DNA, 20 bp, human
ggccttcagactccgcagag

SEQ ID NO: 16518 - DNA, 20 bp, human
gcagaggctgggccgttctc

SEQ ID NO: 16519 - DNA, 20 bp, human
ggggaggaggccactccgca

SEQ ID NO: 16520 - DNA, 20 bp, human
ggaaacaataccgcaccgtg

SEQ ID NO: 16521 - DNA, 20 bp, human
ggggtgaccatgaagaactg

SEQ ID NO: 16522 - DNA, 20 bp, human
ggcctctctgcggagtctga

SEQ ID NO: 16523 - DNA, 20 bp, human
gaataccgcaccgtgcggag

SEQ ID NO: 16524 - DNA, 20 bp, human
ggagtggcctcctcccgccc

SEQ ID NO: 16525 - DNA, 20 bp, human
ggggtgcagaacccacagtt

SEQ ID NO: 16526 - DNA, 20 bp, human
ggcagagtggaaactgacac

SEQ ID NO: 16527 - DNA, 20 bp, human
ggctggttgcccattgacag

SEQ ID NO: 16528 - DNA, 20 bp, human
ggaggcgttggaggtcgagg

SEQ ID NO: 16529 - DNA, 20 bp, human
gggcgagacaatggggatgt

SEQ ID NO: 16530 - DNA, 20 bp, human
gcggcatgagacgagcgtgg

SEQ ID NO: 16531 - DNA, 20 bp, human
gagatcggggcgagacaatg

SEQ ID NO: 16532 - DNA, 20 bp, human
gtgcagacgccgctgtcaat

SEQ ID NO: 16533 - DNA, 20 bp, human
gaggcggcatgagacgagcg

SEQ ID NO: 16534 - DNA, 20 bp, human
ggaggaggcgttggaggtcg

SEQ ID NO: 16535 - DNA, 20 bp, human
gcctcccgctccgcactcgg

SEQ ID NO: 16536 - DNA, 20 bp, human
gtcttcccagaggattccag

SEQ ID NO: 16537 - DNA, 20 bp, human
ggacgcaaggagacttcctc

SEQ ID NO: 16538 - DNA, 20 bp, human
gtgtagtcggccaagtccag

SEQ ID NO: 16539 - DNA, 20 bp, human
gggaaaaccggcgggcaagg

SEQ ID NO: 16540 - DNA, 20 bp, human
ggagggaagcggcgcactgg

SEQ ID NO: 16541 - DNA, 20 bp, human
gtgcgtcccgggaaaaccgg

SEQ ID NO: 16542 - DNA, 20 bp, human
gcccgccagcatgcccggcg

SEQ ID NO: 16543 - DNA, 20 bp, human
gggggcggcggcgagggaag

SEQ ID NO: 16544 - DNA, 20 bp, human
ggccaggtcataggtgtagt

SEQ ID NO: 16545 - DNA, 20 bp, human
gccttgcgtcccgggaaaac

SEQ ID NO: 16546 - DNA, 20 bp, human
gggagctcgagcggagtcat

SEQ ID NO: 16547 - DNA, 20 bp, human
gcaatgcatgggaatgatat

SEQ ID NO: 16548 - DNA, 20 bp, human
gcttggcctaggagctcgag

SEQ ID NO: 16549 - DNA, 20 bp, human
gcgagctcctaggccaagcc

SEQ ID NO: 16550 - DNA, 20 bp, human
gagcggagtcatgggctctc

SEQ ID NO: 16551 - DNA, 20 bp, human
gcagggaagctaaaccttcc

SEQ ID NO: 16552 - DNA, 20 bp, human
gagcttccctgggctctaag

SEQ ID NO: 16553 - DNA, 20 bp, human
ggaaaagagcgcacagtgtc

SEQ ID NO: 16554 - DNA, 20 bp, human
gcatgggaatgatataggta

SEQ ID NO: 16555 - DNA, 20 bp, human
gctgctctaggttcatgatg

SEQ ID NO: 16556 - DNA, 20 bp, human
gtcagccagaagggcaatag

SEQ ID NO: 16557 - DNA, 20 bp, human
gtgaggaggaccatcttgaa

SEQ ID NO: 16558 - DNA, 20 bp, human
ggcgttcagctgactcgcat

SEQ ID NO: 16559 - DNA, 20 bp, human
gctcaccatggtggccccaa

SEQ ID NO: 16560 - DNA, 20 bp, human
gctagcagctcctcaatcag

SEQ ID NO: 16561 - DNA, 20 bp, human
gaaggaagccccggctccta

SEQ ID NO: 16562 - DNA, 20 bp, human
gtcaatcaggggcaaagtag

SEQ ID NO: 16563 - DNA, 20 bp, human
gaatggtgcggttctctcta

SEQ ID NO: 16564 - DNA, 20 bp, human
gggcttcaccagcctcacca

SEQ ID NO: 16565 - DNA, 20 bp, human
ggagaggagtgtagagaaaa

SEQ ID NO: 16566 - DNA, 20 bp, human
gcccagggctaggagagcga

SEQ ID NO: 16567 - DNA, 20 bp, human
gcgcggcggggcgaggactc

SEQ ID NO: 16568 - DNA, 20 bp, human
gggcggggcgaggactccgg

SEQ ID NO: 16569 - DNA, 20 bp, human
gaccccaggctagccacaaa

SEQ ID NO: 16570 - DNA, 20 bp, human
gcggctgccagtccccggcg

SEQ ID NO: 16571 - DNA, 20 bp, human
gggctgtggcggcagatgtg

SEQ ID NO: 16572 - DNA, 20 bp, human
gacctactgcaggagatcgg

SEQ ID NO: 16573 - DNA, 20 bp, human
gcgaggtgtgatcggacccc

SEQ ID NO: 16574 - DNA, 20 bp, human
gtagccggcggaggctgtgg

SEQ ID NO: 16575 - DNA, 20 bp, human
gggcgagtcgagccgagtcc

SEQ ID NO: 16576 - DNA, 20 bp, human
gcgccgcccaggaggacctg

SEQ ID NO: 16577 - DNA, 20 bp, human
gcagcaacgctagaagacag

SEQ ID NO: 16578 - DNA, 20 bp, human
gctgcaaagccctccaccgt

SEQ ID NO: 16579 - DNA, 20 bp, human
gcggccaagctgcctctaca

SEQ ID NO: 16580 - DNA, 20 bp, human
gcctgtccgcaggtcgacca

SEQ ID NO: 16581 - DNA, 20 bp, human
ggtccgcaggtcgaccatgg

SEQ ID NO: 16582 - DNA, 20 bp, human
gacaggtctagcatgtaggg

SEQ ID NO: 16583 - DNA, 20 bp, human
gactgcagccgtccctgtag

SEQ ID NO: 16584 - DNA, 20 bp, human
gggccaccatggtcgacctg

SEQ ID NO: 16585 - DNA, 20 bp, human
ggctagaagacagcgggtcc

SEQ ID NO: 16586 - DNA, 20 bp, human
gccaagtcggagggcggcag

SEQ ID NO: 16587 - DNA, 20 bp, human
gagctgcccggctcccgcag

SEQ ID NO: 16588 - DNA, 20 bp, human
gccggcagcagaggaagaat

SEQ ID NO: 16589 - DNA, 20 bp, human
ggtataagagtcagtccgga

SEQ ID NO: 16590 - DNA, 20 bp, human
gggctcggacaggcaggtga

SEQ ID NO: 16591 - DNA, 20 bp, human
gggccgcagcacgctcggac

SEQ ID NO: 16592 - DNA, 20 bp, human
ggagcgcggaatgtgaggct

SEQ ID NO: 16593 - DNA, 20 bp, human
gggatgcccaagtcggaggg

SEQ ID NO: 16594 - DNA, 20 bp, human
gagcgggggctcctaaagag

SEQ ID NO: 16595 - DNA, 20 bp, human
gagtcgctggccgaaggtac

SEQ ID NO: 16596 - DNA, 20 bp, human
gtcgctgcgggacactccga

SEQ ID NO: 16597 - DNA, 20 bp, human
gctgtgcgcagcggtccgga

SEQ ID NO: 16598 - DNA, 20 bp, human
ggccgggtgcagcgagatag

SEQ ID NO: 16599 - DNA, 20 bp, human
gccgcagctgctccaatccc

SEQ ID NO: 16600 - DNA, 20 bp, human
gtgggtcagcgcagcaagtg

SEQ ID NO: 16601 - DNA, 20 bp, human
gccgcgcgggtacctagcca

SEQ ID NO: 16602 - DNA, 20 bp, human
gcacagccccggctccgacc

SEQ ID NO: 16603 - DNA, 20 bp, human
gccagcgcagcctgacaggt

SEQ ID NO: 16604 - DNA, 20 bp, human
gctccgaaggcgcaaggagc

SEQ ID NO: 16605 - DNA, 20 bp, human
gcgctcgattgccttttcca

SEQ ID NO: 16606 - DNA, 20 bp, human
ggaggaaggaagatgcgaga

SEQ ID NO: 16607 - DNA, 20 bp, human
gcccggaagctaggtgagtg

SEQ ID NO: 16608 - DNA, 20 bp, human
gccgctactgcagggaccta

SEQ ID NO: 16609 - DNA, 20 bp, human
gggagcccggcccggaagct

SEQ ID NO: 16610 - DNA, 20 bp, human
gcaaaggtgagaatctccca

SEQ ID NO: 16611 - DNA, 20 bp, human
gctgtgaccgaggcaaaagg

SEQ ID NO: 16612 - DNA, 20 bp, human
gggagcagcagcggcgtctc

SEQ ID NO: 16613 - DNA, 20 bp, human
gggcagtagccgatatttaa

SEQ ID NO: 16614 - DNA, 20 bp, human
gcaatagtggtgctggaggt

SEQ ID NO: 16615 - DNA, 20 bp, human
gagcaaggctacctggtgag

SEQ ID NO: 16616 - DNA, 20 bp, human
gtcgggatggcactacggaa

SEQ ID NO: 16617 - DNA, 20 bp, human
ggaacgcgccacggagacac

SEQ ID NO: 16618 - DNA, 20 bp, human
gggggctctcccagacaagt

SEQ ID NO: 16619 - DNA, 20 bp, human
gagagagtgggaacgcgcca

SEQ ID NO: 16620 - DNA, 20 bp, human
gagcagtgcgttgctcggga

SEQ ID NO: 16621 - DNA, 20 bp, human
gctcccagacaagttggata

SEQ ID NO: 16622 - DNA, 20 bp, human
ggacaagttggataggggaa

SEQ ID NO: 16623 - DNA, 20 bp, human
gcggggcgctggaagcgtac

SEQ ID NO: 16624 - DNA, 20 bp, human
gaaacttgctggaaaggctc

SEQ ID NO: 16625 - DNA, 20 bp, human
gagagcccccagtgtctccg

SEQ ID NO: 16626 - DNA, 20 bp, human
gtatttgtgcctgctggagg

SEQ ID NO: 16627 - DNA, 20 bp, human
ggatctctcttgaagagggc

SEQ ID NO: 16628 - DNA, 20 bp, human
ggtatatttgtgcctgctgg

SEQ ID NO: 16629 - DNA, 20 bp, human
gggtggaattaacagtaaga

SEQ ID NO: 16630 - DNA, 20 bp, human
gtgttaattccacctccagc

SEQ ID NO: 16631 - DNA, 20 bp, human
gtctatgctgatctgcacct

SEQ ID NO: 16632 - DNA, 20 bp, human
gattgaatggacttacagga

SEQ ID NO: 16633 - DNA, 20 bp, human
gagggattgaatggacttac

SEQ ID NO: 16634 - DNA, 20 bp, human
ggatatatattccaacacca

SEQ ID NO: 16635 - DNA, 20 bp, human
gctgatctgcaccttggtgt

SEQ ID NO: 16636 - DNA, 20 bp, human
gggcgactgagtgggacccg

SEQ ID NO: 16637 - DNA, 20 bp, human
gtccccgcagcggccaacgt

SEQ ID NO: 16638 - DNA, 20 bp, human
gtcgcggagagccccctccc

SEQ ID NO: 16639 - DNA, 20 bp, human
ggggctagtgcaccgagcag

SEQ ID NO: 16640 - DNA, 20 bp, human
gcgcagcagaaagcccacgt

SEQ ID NO: 16641 - DNA, 20 bp, human
ggatcccgcgaggcgtggag

SEQ ID NO: 16642 - DNA, 20 bp, human
gaagcgagcccgccgagagg

SEQ ID NO: 16643 - DNA, 20 bp, human
gctctccctggcgactgagt

SEQ ID NO: 16644 - DNA, 20 bp, human
ggaggcgggagaccgaattc

SEQ ID NO: 16645 - DNA, 20 bp, human
ggctcgcagaaaggatggga

SEQ ID NO: 16646 - DNA, 20 bp, human
gcggcctcttgtgcgatcca

SEQ ID NO: 16647 - DNA, 20 bp, human
gtcgcacaagaggccgcctc

SEQ ID NO: 16648 - DNA, 20 bp, human
gtaccactctggcgctcccg

SEQ ID NO: 16649 - DNA, 20 bp, human
ggccccagcgcgtaccactc

SEQ ID NO: 16650 - DNA, 20 bp, human
gacaggtccagcatgaacat

SEQ ID NO: 16651 - DNA, 20 bp, human
gcactctggcgctcccgagg

SEQ ID NO: 16652 - DNA, 20 bp, human
gctccagggcaagcacaact

SEQ ID NO: 16653 - DNA, 20 bp, human
ggcgccctggatcgcacaag

SEQ ID NO: 16654 - DNA, 20 bp, human
ggcagccccggcgaacgaaa

SEQ ID NO: 16655 - DNA, 20 bp, human
gcctccggcgcggatagcag

SEQ ID NO: 16656 - DNA, 20 bp, human
gcagccacagccggactggt

SEQ ID NO: 16657 - DNA, 20 bp, human
gaggggcgaccggcgagctc

SEQ ID NO: 16658 - DNA, 20 bp, human
ggccgccgttcccaccagtc

SEQ ID NO: 16659 - DNA, 20 bp, human
gacagccggactggtgggaa

SEQ ID NO: 16660 - DNA, 20 bp, human
gcgcgcgccccggaccgctc

SEQ ID NO: 16661 - DNA, 20 bp, human
gcagaagccagagcggtccg

SEQ ID NO: 16662 - DNA, 20 bp, human
ggcccagcgcgcacaacgtc

SEQ ID NO: 16663 - DNA, 20 bp, human
gagctgagttcggcgagcag

SEQ ID NO: 16664 - DNA, 20 bp, human
gagccggggcaaggactcgc

SEQ ID NO: 16665 - DNA, 20 bp, human
ggcgtccccgggcccagggg

SEQ ID NO: 16666 - DNA, 20 bp, human
gcgagcagcgcaggggcgat

SEQ ID NO: 16667 - DNA, 20 bp, human
gtcgcgggaaccgcaccaag

SEQ ID NO: 16668 - DNA, 20 bp, human
ggccggactggcgggtacgg

SEQ ID NO: 16669 - DNA, 20 bp, human
ggccgccgtacccgccagtc

SEQ ID NO: 16670 - DNA, 20 bp, human
ggggcagggcagggactcgc

SEQ ID NO: 16671 - DNA, 20 bp, human
gcgaggccggggctactctg

SEQ ID NO: 16672 - DNA, 20 bp, human
gccctgcgctgctcggaccg

SEQ ID NO: 16673 - DNA, 20 bp, human
gacagccggactggcgggta

SEQ ID NO: 16674 - DNA, 20 bp, human
gggacgccccgacggcaagg

SEQ ID NO: 16675 - DNA, 20 bp, human
ggcgcggtcatggcaggccg

SEQ ID NO: 16676 - DNA, 20 bp, human
ggctccgccgcaacagacgt

SEQ ID NO: 16677 - DNA, 20 bp, human
ggcgggacctgcagtcgcca

SEQ ID NO: 16678 - DNA, 20 bp, human
gcagagcatcgtcacctgga

SEQ ID NO: 16679 - DNA, 20 bp, human
gcagccggagatagactgag

SEQ ID NO: 16680 - DNA, 20 bp, human
ggcccccagcgggttccggg

SEQ ID NO: 16681 - DNA, 20 bp, human
gcaacagacgtgggctcacc

SEQ ID NO: 16682 - DNA, 20 bp, human
gcgcagctcacagtcgaaaa

SEQ ID NO: 16683 - DNA, 20 bp, human
ggagcgagcgcgctccggga

SEQ ID NO: 16684 - DNA, 20 bp, human
gtgccctgcgctggtcgatg

SEQ ID NO: 16685 - DNA, 20 bp, human
gacagcccccgaaacagtag

SEQ ID NO: 16686 - DNA, 20 bp, human
gccctcctggcaagagtcgg

SEQ ID NO: 16687 - DNA, 20 bp, human
gctcccctcctggcaagagt

SEQ ID NO: 16688 - DNA, 20 bp, human
gtcctggcaagagtcggcgg

SEQ ID NO: 16689 - DNA, 20 bp, human
gcggattccaatctctgcag

SEQ ID NO: 16690 - DNA, 20 bp, human
gccgcccagccagagaccca

SEQ ID NO: 16691 - DNA, 20 bp, human
gccgggcttggcgaaggaga

SEQ ID NO: 16692 - DNA, 20 bp, human
gcggcctgcaacccgcgagt

SEQ ID NO: 16693 - DNA, 20 bp, human
gcgagtgggagacaaaagag

SEQ ID NO: 16694 - DNA, 20 bp, human
ggtgcgcgtgcggaccggag

SEQ ID NO: 16695 - DNA, 20 bp, human
ggtgccgtgggtctctggct

SEQ ID NO: 16696 - DNA, 20 bp, human
gctgcgcaggcgaggagtcg

SEQ ID NO: 16697 - DNA, 20 bp, human
gcgcggcggccagaagttga

SEQ ID NO: 16698 - DNA, 20 bp, human
gccgggcagtgcggagaccg

SEQ ID NO: 16699 - DNA, 20 bp, human
gacacgtgcttcgggctgta

SEQ ID NO: 16700 - DNA, 20 bp, human
gaggcgaggagtcggggcag

SEQ ID NO: 16701 - DNA, 20 bp, human
gggcggcgcgggacgggtag

SEQ ID NO: 16702 - DNA, 20 bp, human
gcggctgcgccgtcaacttc

SEQ ID NO: 16703 - DNA, 20 bp, human
ggcgcgctccgtcctgccta

SEQ ID NO: 16704 - DNA, 20 bp, human
gcccgcgcacaaagccgagg

SEQ ID NO: 16705 - DNA, 20 bp, human
gacctgcgagcggagggatg

SEQ ID NO: 16706 - DNA, 20 bp, human
gctccgggaggcacttccag

SEQ ID NO: 16707 - DNA, 20 bp, human
gcaccctgcgtccctccggg

SEQ ID NO: 16708 - DNA, 20 bp, human
gcggtccgggctccccgaga

SEQ ID NO: 16709 - DNA, 20 bp, human
gccgagacggcaggcggagt

SEQ ID NO: 16710 - DNA, 20 bp, human
ggccgccgggaggactagaa

SEQ ID NO: 16711 - DNA, 20 bp, human
gtgcctcccggagggacgca

SEQ ID NO: 16712 - DNA, 20 bp, human
gagacaccctgcgtccctcc

SEQ ID NO: 16713 - DNA, 20 bp, human
gggcctccccaaccctctca

SEQ ID NO: 16714 - DNA, 20 bp, human
gccccttctagtcctcccgg

SEQ ID NO: 16715 - DNA, 20 bp, human
ggaccgggagcgccgcagac

SEQ ID NO: 16716 - DNA, 20 bp, human
gcggtgtccatgctgacctg

SEQ ID NO: 16717 - DNA, 20 bp, human
gatgctgacctgaggagtcg

SEQ ID NO: 16718 - DNA, 20 bp, human
gatctggcggaggtgtcctg

SEQ ID NO: 16719 - DNA, 20 bp, human
gcctgcagagagcccagacg

SEQ ID NO: 16720 - DNA, 20 bp, human
gtcgcggctgcgagcaggtt

SEQ ID NO: 16721 - DNA, 20 bp, human
ggagttctcgccgaaggcca

SEQ ID NO: 16722 - DNA, 20 bp, human
gtggcgccggttagttagtg

SEQ ID NO: 16723 - DNA, 20 bp, human
gctcgcagccgcgactcctc

SEQ ID NO: 16724 - DNA, 20 bp, human
gttctcgccgaaggccaggg

SEQ ID NO: 16725 - DNA, 20 bp, human
ggaggtgtcctggggtagtt

SEQ ID NO: 16726 - DNA, 20 bp, human
gctggctgccgggtcagaaa

SEQ ID NO: 16727 - DNA, 20 bp, human
gtgttgcaggaacacggccc

SEQ ID NO: 16728 - DNA, 20 bp, human
gaatatgaaaggctatggaa

SEQ ID NO: 16729 - DNA, 20 bp, human
gaggccaatatgaaaggcta

SEQ ID NO: 16730 - DNA, 20 bp, human
gtctggaaacaggacagccg

SEQ ID NO: 16731 - DNA, 20 bp, human
gcaatacctaaagaagcgga

SEQ ID NO: 16732 - DNA, 20 bp, human
gagcagaccaagcaccgcgg

SEQ ID NO: 16733 - DNA, 20 bp, human
gacacaaagctaggtagaac

SEQ ID NO: 16734 - DNA, 20 bp, human
gtgtaggacaataaacgtgt

SEQ ID NO: 16735 - DNA, 20 bp, human
gtgcttgcctgggtccgccg

SEQ ID NO: 16736 - DNA, 20 bp, human
gtagccagctggccctcggg

SEQ ID NO: 16737 - DNA, 20 bp, human
gcggcagagagtggcgtgta

SEQ ID NO: 16738 - DNA, 20 bp, human
gcgcgacccggcgaagtggg

SEQ ID NO: 16739 - DNA, 20 bp, human
gatccacgctccggccgtcg

SEQ ID NO: 16740 - DNA, 20 bp, human
gaatcggcggcggcactcgg

SEQ ID NO: 16741 - DNA, 20 bp, human
gagcctgtggaaatcggcgg

SEQ ID NO: 16742 - DNA, 20 bp, human
ggctgggctccggctcccgt

SEQ ID NO: 16743 - DNA, 20 bp, human
gtcgccgggtcgcgccccga

SEQ ID NO: 16744 - DNA, 20 bp, human
gttgccagctccgggacgtc

SEQ ID NO: 16745 - DNA, 20 bp, human
gggatctgcgggcgcgtcgg

SEQ ID NO: 16746 - DNA, 20 bp, human
gccgctaagaggagaccaag

SEQ ID NO: 16747 - DNA, 20 bp, human
gagaggagaccaagaggcgg

SEQ ID NO: 16748 - DNA, 20 bp, human
gtctgaggcgagctctaggt

SEQ ID NO: 16749 - DNA, 20 bp, human
gggagggtgcacgtgagagg

SEQ ID NO: 16750 - DNA, 20 bp, human
gctggctaggggaggctcca

SEQ ID NO: 16751 - DNA, 20 bp, human
ggcttccgcgcgaaggtgag

SEQ ID NO: 16752 - DNA, 20 bp, human
gagagaaaggccgagacgga

SEQ ID NO: 16753 - DNA, 20 bp, human
gagcgcagcggggatcaggt

SEQ ID NO: 16754 - DNA, 20 bp, human
gccgccggtccctcactcgg

SEQ ID NO: 16755 - DNA, 20 bp, human
gctccggcccgcggcgtgag

SEQ ID NO: 16756 - DNA, 20 bp, human
ggtagccggcgtccccaaca

SEQ ID NO: 16757 - DNA, 20 bp, human
gtccccaagacgtccacgtc

SEQ ID NO: 16758 - DNA, 20 bp, human
gtaggttgtgaggtagtcag

SEQ ID NO: 16759 - DNA, 20 bp, human
ggccggcgtccccaacatgg

SEQ ID NO: 16760 - DNA, 20 bp, human
ggcctcccggacgctaccag

SEQ ID NO: 16761 - DNA, 20 bp, human
ggccaagcagggtgacaggt

SEQ ID NO: 16762 - DNA, 20 bp, human
gaggggcggggcgacgacca

SEQ ID NO: 16763 - DNA, 20 bp, human
ggggtgacaggtaggttgtg

SEQ ID NO: 16764 - DNA, 20 bp, human
gtcctctggtagcgtccggg

SEQ ID NO: 16765 - DNA, 20 bp, human
gttggggagccgccatgttg

SEQ ID NO: 16766 - DNA, 20 bp, human
gcgcagcggtacggcgtcgg

SEQ ID NO: 16767 - DNA, 20 bp, human
gagaccccggcccaatcccc

SEQ ID NO: 16768 - DNA, 20 bp, human
gcggtcggcggtggagaccc

SEQ ID NO: 16769 - DNA, 20 bp, human
gcccaatcccccggccgcag

SEQ ID NO: 16770 - DNA, 20 bp, human
gggccgcagcggtacggcgt

SEQ ID NO: 16771 - DNA, 20 bp, human
gggagcccgctcccctcggt

SEQ ID NO: 16772 - DNA, 20 bp, human
gcaaacaggacccaagccaa

SEQ ID NO: 16773 - DNA, 20 bp, human
gtcggcggcagcagctgacc

SEQ ID NO: 16774 - DNA, 20 bp, human
gcacaccagggtaaaagggt

SEQ ID NO: 16775 - DNA, 20 bp, human
gcgctcccctcggtcggcgg

SEQ ID NO: 16776 - DNA, 20 bp, human
ggcgcggagctggagaatcg

SEQ ID NO: 16777 - DNA, 20 bp, human
gccggccggaggaactcaca

SEQ ID NO: 16778 - DNA, 20 bp, human
ggacccgggtcggaccgcac

SEQ ID NO: 16779 - DNA, 20 bp, human
gctccccggcaacctcccct

SEQ ID NO: 16780 - DNA, 20 bp, human
gtggcgaggccgcgaacccc

SEQ ID NO: 16781 - DNA, 20 bp, human
gtcagtccgggagcgcagct

SEQ ID NO: 16782 - DNA, 20 bp, human
gacgcagattcacctccagg

SEQ ID NO: 16783 - DNA, 20 bp, human
ggcatgcccgcaggaggggt

SEQ ID NO: 16784 - DNA, 20 bp, human
ggagctagaattccacctgg

SEQ ID NO: 16785 - DNA, 20 bp, human
ggagacgcagattcacctcc

SEQ ID NO: 16786 - DNA, 20 bp, human
ggcagcagcaggaccgtctc

SEQ ID NO: 16787 - DNA, 20 bp, human
gggaggagaaggcagctcat

SEQ ID NO: 16788 - DNA, 20 bp, human
gggcggcggctcgactaggt

SEQ ID NO: 16789 - DNA, 20 bp, human
gggaccaccccccgcaccag

SEQ ID NO: 16790 - DNA, 20 bp, human
ggctgcctgagtgccggaga

SEQ ID NO: 16791 - DNA, 20 bp, human
gtgggctcgcggtccgggag

SEQ ID NO: 16792 - DNA, 20 bp, human
gggcgcaggcgcagaaaagg

SEQ ID NO: 16793 - DNA, 20 bp, human
gaggaccgtctccggcactc

SEQ ID NO: 16794 - DNA, 20 bp, human
ggggcggcggcggctcgact

SEQ ID NO: 16795 - DNA, 20 bp, human
ggcaggcgcagaaaaggggg

SEQ ID NO: 16796 - DNA, 20 bp, human
gcaaggagggaggtgtggaa

SEQ ID NO: 16797 - DNA, 20 bp, human
gtgacccagtaagagctggg

SEQ ID NO: 16798 - DNA, 20 bp, human
gcagtaagagctgggtggtg

SEQ ID NO: 16799 - DNA, 20 bp, human
gagaggtaaggaagtgttgg

SEQ ID NO: 16800 - DNA, 20 bp, human
gggattccaggataattccc

SEQ ID NO: 16801 - DNA, 20 bp, human
ggaacacaggcagatttatc

SEQ ID NO: 16802 - DNA, 20 bp, human
ggagaacctggacctaaact

SEQ ID NO: 16803 - DNA, 20 bp, human
ggtagctcttgcctccaagg

SEQ ID NO: 16804 - DNA, 20 bp, human
gaaaagaggtaaggaagtgt

SEQ ID NO: 16805 - DNA, 20 bp, human
ggttgtagctcttgcctcca

SEQ ID NO: 16806 - DNA, 20 bp, human
gcgcacccggtccctccata

SEQ ID NO: 16807 - DNA, 20 bp, human
ggcccgggggccagcgtggt

SEQ ID NO: 16808 - DNA, 20 bp, human
gctcctcgcacggtaatggg

SEQ ID NO: 16809 - DNA, 20 bp, human
gtctgctgcagccggcgcct

SEQ ID NO: 16810 - DNA, 20 bp, human
ggcctgggaagggcgagccg

SEQ ID NO: 16811 - DNA, 20 bp, human
gcaccggggacacacaacac

SEQ ID NO: 16812 - DNA, 20 bp, human
gcgtgcggcgcggcgctgtg

SEQ ID NO: 16813 - DNA, 20 bp, human
gcgcgcgcggcggctgacac

SEQ ID NO: 16814 - DNA, 20 bp, human
gacggtaatgggaggctcct

SEQ ID NO: 16815 - DNA, 20 bp, human
gcaacacgctcggtgacacc

SEQ ID NO: 16816 - DNA, 20 bp, human
gacctctgctgtatcagagg

SEQ ID NO: 16817 - DNA, 20 bp, human
ggcagaggttgtggtggacg

SEQ ID NO: 16818 - DNA, 20 bp, human
ggtggacaccaaggtagctg

SEQ ID NO: 16819 - DNA, 20 bp, human
gctgcgccccgggcccacaa

SEQ ID NO: 16820 - DNA, 20 bp, human
ggatagcttagaaatctcag

SEQ ID NO: 16821 - DNA, 20 bp, human
gcaggcggccgcagctacct

SEQ ID NO: 16822 - DNA, 20 bp, human
gtgagctgcgggtcgccggg

SEQ ID NO: 16823 - DNA, 20 bp, human
ggtggtggacgcggcagaaa

SEQ ID NO: 16824 - DNA, 20 bp, human
gttctgagcgatgcacacgt

SEQ ID NO: 16825 - DNA, 20 bp, human
gccgctccccaacgcccagg

SEQ ID NO: 16826 - DNA, 20 bp, human
gccgcctgagggaagccaac

SEQ ID NO: 16827 - DNA, 20 bp, human
gttccgtaacaacatcccgt

SEQ ID NO: 16828 - DNA, 20 bp, human
gaccggcggacgatcctggg

SEQ ID NO: 16829 - DNA, 20 bp, human
gggcggacgatcctgggagg

SEQ ID NO: 16830 - DNA, 20 bp, human
gggagggcaagggccctgac

SEQ ID NO: 16831 - DNA, 20 bp, human
ggatgttgttacggaaccag

SEQ ID NO: 16832 - DNA, 20 bp, human
gcgacgtggacaccaaggtt

SEQ ID NO: 16833 - DNA, 20 bp, human
gctgaccggcggacgatcct

SEQ ID NO: 16834 - DNA, 20 bp, human
gagccaacgggatgttgtta

SEQ ID NO: 16835 - DNA, 20 bp, human
ggggcaagggccctgaccgg

SEQ ID NO: 16836 - DNA, 20 bp, human
gctgttgaagggacaaaaga

SEQ ID NO: 16837 - DNA, 20 bp, human
gaatttcttcgactggacag

SEQ ID NO: 16838 - DNA, 20 bp, human
ggactctggaggtgaaggac

SEQ ID NO: 16839 - DNA, 20 bp, human
gacagagtgttttgggatca

SEQ ID NO: 16840 - DNA, 20 bp, human
gcgctgaactcttcagactt

SEQ ID NO: 16841 - DNA, 20 bp, human
gaatttttaatttcttcgac

SEQ ID NO: 16842 - DNA, 20 bp, human
gtttaaagaacagagtgttt

SEQ ID NO: 16843 - DNA, 20 bp, human
gctaaataaggatgttcaac

SEQ ID NO: 16844 - DNA, 20 bp, human
gcagctgactctggaggtga

SEQ ID NO: 16845 - DNA, 20 bp, human
gaatctacagctgactctgg

SEQ ID NO: 16846 - DNA, 20 bp, human
gggaggccagctccagaccg

SEQ ID NO: 16847 - DNA, 20 bp, human
gggccagctccagaccgcgg

SEQ ID NO: 16848 - DNA, 20 bp, human
ggcgtcttccacaacctccg

SEQ ID NO: 16849 - DNA, 20 bp, human
ggcgcttggaatccagcagg

SEQ ID NO: 16850 - DNA, 20 bp, human
gcgggactgcaaggctgacg

SEQ ID NO: 16851 - DNA, 20 bp, human
gctccagaccgcggaggttg

SEQ ID NO: 16852 - DNA, 20 bp, human
ggctcatcgctatcatcgtg

SEQ ID NO: 16853 - DNA, 20 bp, human
gccaccgccgccccaaccac

SEQ ID NO: 16854 - DNA, 20 bp, human
gttccacaacctccgcggtc

SEQ ID NO: 16855 - DNA, 20 bp, human
gctggagaagaagctataat

SEQ ID NO: 16856 - DNA, 20 bp, human
gggcttcccgcgctcttggg

SEQ ID NO: 16857 - DNA, 20 bp, human
ggcgactcccagctggcgag

SEQ ID NO: 16858 - DNA, 20 bp, human
gtcccagctggcgagaggct

SEQ ID NO: 16859 - DNA, 20 bp, human
ggaagggtcgaggtcgtcgt

SEQ ID NO: 16860 - DNA, 20 bp, human
ggcagcgcgcgactcccagc

SEQ ID NO: 16861 - DNA, 20 bp, human
gtcgaagacgagtgcgtggg

SEQ ID NO: 16862 - DNA, 20 bp, human
gcagcccagcgcgtccccca

SEQ ID NO: 16863 - DNA, 20 bp, human
ggaggctgccagggaccggt

SEQ ID NO: 16864 - DNA, 20 bp, human
ggtcctggcagtcgccgtgg

SEQ ID NO: 16865 - DNA, 20 bp, human
gcgggagcgccaggtccacg

SEQ ID NO: 16866 - DNA, 20 bp, human
gccagacatgactgaaatca

SEQ ID NO: 16867 - DNA, 20 bp, human
gctttttttgaaaacttggg

SEQ ID NO: 16868 - DNA, 20 bp, human
gctttggtaacagaacggcc

SEQ ID NO: 16869 - DNA, 20 bp, human
gtcaatcttattttgttgcg

SEQ ID NO: 16870 - DNA, 20 bp, human
gagattgaaagagaaccaag

SEQ ID NO: 16871 - DNA, 20 bp, human
ggttttctttggtaacagaa

SEQ ID NO: 16872 - DNA, 20 bp, human
gtgtggctttcggttttctt

SEQ ID NO: 16873 - DNA, 20 bp, human
gtaaaaagagcctttggtct

SEQ ID NO: 16874 - DNA, 20 bp, human
ggtctgcatttatttgcttt

SEQ ID NO: 16875 - DNA, 20 bp, human
gtcgccctaccgggaactgg

SEQ ID NO: 16876 - DNA, 20 bp, human
gtcccagcgtgcctcaggaa

SEQ ID NO: 16877 - DNA, 20 bp, human
gtccggagcgtccagagtcc

SEQ ID NO: 16878 - DNA, 20 bp, human
gagtcctggcgcccttcctg

SEQ ID NO: 16879 - DNA, 20 bp, human
gacgccaggagtgagggtcg

SEQ ID NO: 16880 - DNA, 20 bp, human
gccactgcgattcccgctca

SEQ ID NO: 16881 - DNA, 20 bp, human
gggcgtagcccatgctgagt

SEQ ID NO: 16882 - DNA, 20 bp, human
gctcctggcgtctgagtctc

SEQ ID NO: 16883 - DNA, 20 bp, human
gccggagcaaaatgcagtcc

SEQ ID NO: 16884 - DNA, 20 bp, human
ggtccacaccagctcctata

SEQ ID NO: 16885 - DNA, 20 bp, human
ggcgggaatcgcagtggccg

SEQ ID NO: 16886 - DNA, 20 bp, human
ggcgagggccctggtgagag

SEQ ID NO: 16887 - DNA, 20 bp, human
gaggcctccccctctcacca

SEQ ID NO: 16888 - DNA, 20 bp, human
gacaggagaggggcacgtac

SEQ ID NO: 16889 - DNA, 20 bp, human
ggctctcggggactatccgg

SEQ ID NO: 16890 - DNA, 20 bp, human
gcctgaggaaggtgggactc

SEQ ID NO: 16891 - DNA, 20 bp, human
gtcccctggaccctaggtca

SEQ ID NO: 16892 - DNA, 20 bp, human
ggtgcccctctcctgtctgg

SEQ ID NO: 16893 - DNA, 20 bp, human
gcgccgactggacagcagtc

SEQ ID NO: 16894 - DNA, 20 bp, human
ggggtgtagaagtccgaccg

SEQ ID NO: 16895 - DNA, 20 bp, human
gggaggccttctgtgccggg

SEQ ID NO: 16896 - DNA, 20 bp, human
ggcgagggccctggtgagag

SEQ ID NO: 16897 - DNA, 20 bp, human
gaggcctccccctctcacca

SEQ ID NO: 16898 - DNA, 20 bp, human
gacaggagaggggcacgtac

SEQ ID NO: 16899 - DNA, 20 bp, human
ggctctcggggactatccgg

SEQ ID NO: 16900 - DNA, 20 bp, human
gcctgaggaaggtgggactc

SEQ ID NO: 16901 - DNA, 20 bp, human
gtcccctggaccctaggtca

SEQ ID NO: 16902 - DNA, 20 bp, human
ggtgcccctctcctgtctgg

SEQ ID NO: 16903 - DNA, 20 bp, human
ggggtgtagaagtccgaccg

SEQ ID NO: 16904 - DNA, 20 bp, human
gggaggccttctgtgccggg

SEQ ID NO: 16905 - DNA, 20 bp, human
ggccgtgacctagggtccag

SEQ ID NO: 16906 - DNA, 20 bp, human
gatgcccgaaagacgcggag

SEQ ID NO: 16907 - DNA, 20 bp, human
gggatccgcggggtgagcgt

SEQ ID NO: 16908 - DNA, 20 bp, human
gtagcccagagtcaaggcgt

SEQ ID NO: 16909 - DNA, 20 bp, human
gctcgggcggcgggtcacgt

SEQ ID NO: 16910 - DNA, 20 bp, human
ggcgcggcactggcaatggg

SEQ ID NO: 16911 - DNA, 20 bp, human
gcaccccgcggatcccgcgg

SEQ ID NO: 16912 - DNA, 20 bp, human
gggctccatgcagccatgcc

SEQ ID NO: 16913 - DNA, 20 bp, human
gggtttaccgagcagaagac

SEQ ID NO: 16914 - DNA, 20 bp, human
gggccttgggaaggtcgact

SEQ ID NO: 16915 - DNA, 20 bp, human
gagtcaaggcgtgggtgcga

SEQ ID NO: 16916 - DNA, 20 bp, human
gctcctggcagcggtcgatg

SEQ ID NO: 16917 - DNA, 20 bp, human
gacacccagtccaggccccg

SEQ ID NO: 16918 - DNA, 20 bp, human
gcggcgctcctccccctcca

SEQ ID NO: 16919 - DNA, 20 bp, human
gcgccccctggcggcgaggg

SEQ ID NO: 16920 - DNA, 20 bp, human
gcggactgcgtcgcctcggg

SEQ ID NO: 16921 - DNA, 20 bp, human
gccgccacggggcctggact

SEQ ID NO: 16922 - DNA, 20 bp, human
gagccaccctcgccgccagg

SEQ ID NO: 16923 - DNA, 20 bp, human
gtgctgctggcggatttgtg

SEQ ID NO: 16924 - DNA, 20 bp, human
gcaggcgtggatgtttcggg

SEQ ID NO: 16925 - DNA, 20 bp, human
ggagtccgggccggtgagta

SEQ ID NO: 16926 - DNA, 20 bp, human
gtggggcatggcgggttcgc

SEQ ID NO: 16927 - DNA, 20 bp, human
ggcccggtcgctgtcggaag

SEQ ID NO: 16928 - DNA, 20 bp, human
ggcaggatgcacaaatggaa

SEQ ID NO: 16929 - DNA, 20 bp, human
gtcggaagcggctgtgcggg

SEQ ID NO: 16930 - DNA, 20 bp, human
ggccgcttccgacagcgacc

SEQ ID NO: 16931 - DNA, 20 bp, human
gccgggaagcaaagaaacgg

SEQ ID NO: 16932 - DNA, 20 bp, human
gacaaatggaacggctggag

SEQ ID NO: 16933 - DNA, 20 bp, human
gcacgcggcccggtcgctgt

SEQ ID NO: 16934 - DNA, 20 bp, human
gctgtcggaagcggctgtgc

SEQ ID NO: 16935 - DNA, 20 bp, human
ggtgcccgccgggccctcta

SEQ ID NO: 16936 - DNA, 20 bp, human
gctgtggccctcgtcatcaa

SEQ ID NO: 16937 - DNA, 20 bp, human
gtccggcagtgacagcagtg

SEQ ID NO: 16938 - DNA, 20 bp, human
gatgacgaaggcgacgagga

SEQ ID NO: 16939 - DNA, 20 bp, human
gtttactgcttggaatccag

SEQ ID NO: 16940 - DNA, 20 bp, human
gccccaggtgcagtgaagga

SEQ ID NO: 16941 - DNA, 20 bp, human
gacggagcccttgatgacga

SEQ ID NO: 16942 - DNA, 20 bp, human
gttctgagggacggtggaga

SEQ ID NO: 16943 - DNA, 20 bp, human
ggccggccttggggttctga

SEQ ID NO: 16944 - DNA, 20 bp, human
ggcgaggagagtgtgttctc

SEQ ID NO: 16945 - DNA, 20 bp, human
gaccctcctggcaacaggtt

SEQ ID NO: 16946 - DNA, 20 bp, human
gccaggccagcttccacgac

SEQ ID NO: 16947 - DNA, 20 bp, human
gagcccccagtaccgactcc

SEQ ID NO: 16948 - DNA, 20 bp, human
gcgactccagggagctccgg

SEQ ID NO: 16949 - DNA, 20 bp, human
gtccctggagtcggtactgg

SEQ ID NO: 16950 - DNA, 20 bp, human
gtaccgactccagggagctc

SEQ ID NO: 16951 - DNA, 20 bp, human
gagagaagtatgattgacag

SEQ ID NO: 16952 - DNA, 20 bp, human
gcaatcaaaggaggctacag

SEQ ID NO: 16953 - DNA, 20 bp, human
gacccctcccgggatagaaa

SEQ ID NO: 16954 - DNA, 20 bp, human
gttggaggaaaggggacccc

SEQ ID NO: 16955 - DNA, 20 bp, human
gaaagagtctatgcctgtcg

SEQ ID NO: 16956 - DNA, 20 bp, human
gtagaaaagagcgtcgatgc

SEQ ID NO: 16957 - DNA, 20 bp, human
gtggctctttggcggctcgg

SEQ ID NO: 16958 - DNA, 20 bp, human
gggcagtgatgagtcctagg

SEQ ID NO: 16959 - DNA, 20 bp, human
gcaaagagccagcgcctcct

SEQ ID NO: 16960 - DNA, 20 bp, human
ggatgagtcctaggaggcgc

SEQ ID NO: 16961 - DNA, 20 bp, human
gtagcccctgaaccagacgt

SEQ ID NO: 16962 - DNA, 20 bp, human
gaaaagagcgtcgatgccgg

SEQ ID NO: 16963 - DNA, 20 bp, human
gctgcccacgtctggttcag

SEQ ID NO: 16964 - DNA, 20 bp, human
gcagacgtgggcaggtccta

SEQ ID NO: 16965 - DNA, 20 bp, human
gggaccggggcgataagtga

SEQ ID NO: 16966 - DNA, 20 bp, human
gacgcgacctgtgaccatgg

SEQ ID NO: 16967 - DNA, 20 bp, human
gccatggtggctgtgctggg

SEQ ID NO: 16968 - DNA, 20 bp, human
gccgcaggcgcaacacgccc

SEQ ID NO: 16969 - DNA, 20 bp, human
ggcacagccaccatggtcac

SEQ ID NO: 16970 - DNA, 20 bp, human
gtctggtctgcacactgaag

SEQ ID NO: 16971 - DNA, 20 bp, human
gcgcggcacaaagggcgaca

SEQ ID NO: 16972 - DNA, 20 bp, human
gcccgtgggacgtggatccc

SEQ ID NO: 16973 - DNA, 20 bp, human
ggctacgcgacctgtgacca

SEQ ID NO: 16974 - DNA, 20 bp, human
gtccaggcgggactccggag

SEQ ID NO: 16975 - DNA, 20 bp, human
gcgacgcagcgagggcgcta

SEQ ID NO: 16976 - DNA, 20 bp, human
gagaagggcttataagtcaa

SEQ ID NO: 16977 - DNA, 20 bp, human
gccatcagggacgcccatct

SEQ ID NO: 16978 - DNA, 20 bp, human
gtggaggttacatagaggga

SEQ ID NO: 16979 - DNA, 20 bp, human
ggcacactcatagcacctca

SEQ ID NO: 16980 - DNA, 20 bp, human
gccatctcggcgcgttgcaa

SEQ ID NO: 16981 - DNA, 20 bp, human
gagggcttataagtcaaagg

SEQ ID NO: 16982 - DNA, 20 bp, human
gccctcaggggtctgagcac

SEQ ID NO: 16983 - DNA, 20 bp, human
gaaaggtggaggttacatag

SEQ ID NO: 16984 - DNA, 20 bp, human
gcagggagctataaaagagt

SEQ ID NO: 16985 - DNA, 20 bp, human
gccaggtgctggatctaaag

SEQ ID NO: 16986 - DNA, 20 bp, human
gcctcggcagaagtgagtgg

SEQ ID NO: 16987 - DNA, 20 bp, human
ggccgttaagggtagcagag

SEQ ID NO: 16988 - DNA, 20 bp, human
gtcttacctggacttcttag

SEQ ID NO: 16989 - DNA, 20 bp, human
gagaggggccacagaatgga

SEQ ID NO: 16990 - DNA, 20 bp, human
gactcctcggcagaagtgag

SEQ ID NO: 16991 - DNA, 20 bp, human
ggccagttgtgcccttctta

SEQ ID NO: 16992 - DNA, 20 bp, human
gccttaacggcagggatctc

SEQ ID NO: 16993 - DNA, 20 bp, human
gtgagacctctaagaagtcc

SEQ ID NO: 16994 - DNA, 20 bp, human
ggtaagagccatccattctg

SEQ ID NO: 16995 - DNA, 20 bp, human
ggatcactcactgccccaca

SEQ ID NO: 16996 - DNA, 20 bp, human
ggggctggattcacattcaa

SEQ ID NO: 16997 - DNA, 20 bp, human
ggggctgttagcccagacca

SEQ ID NO: 16998 - DNA, 20 bp, human
gcccagaccatggcccagtt

SEQ ID NO: 16999 - DNA, 20 bp, human
gtccaaactgggccatggtc

SEQ ID NO: 17000 - DNA, 20 bp, human
gcacattcaagggcagggtc

SEQ ID NO: 17001 - DNA, 20 bp, human
gagcctggaggaggtacttc

SEQ ID NO: 17002 - DNA, 20 bp, human
gaagggcagggtctggtcca

SEQ ID NO: 17003 - DNA, 20 bp, human
gtccaagcagtcccccaagg

SEQ ID NO: 17004 - DNA, 20 bp, human
ggggcctcattgtcttctac

SEQ ID NO: 17005 - DNA, 20 bp, human
gcagcccgtagaagacaatg

SEQ ID NO: 17006 - DNA, 20 bp, human
gcacgtgtggtgccactggg

SEQ ID NO: 17007 - DNA, 20 bp, human
gccactcacgcgtttagagg

SEQ ID NO: 17008 - DNA, 20 bp, human
gacaatgcagggtcatgagg

SEQ ID NO: 17009 - DNA, 20 bp, human
gccccactgcacagtctgct

SEQ ID NO: 17010 - DNA, 20 bp, human
gtgaacaatgcagggtcatg

SEQ ID NO: 17011 - DNA, 20 bp, human
gttccaaagaccaccacgtg

SEQ ID NO: 17012 - DNA, 20 bp, human
gccaccacgtgtggtgccac

SEQ ID NO: 17013 - DNA, 20 bp, human
gtcccagcagactgtgcagt

SEQ ID NO: 17014 - DNA, 20 bp, human
gacgccactcacgcgtttag

SEQ ID NO: 17015 - DNA, 20 bp, human
gggtggcggctattatatgg

SEQ ID NO: 17016 - DNA, 20 bp, human
ggaccctggcgctgccacca

SEQ ID NO: 17017 - DNA, 20 bp, human
gaccagggcttgctcacatt

SEQ ID NO: 17018 - DNA, 20 bp, human
ggagcaacatgtggaaccct

SEQ ID NO: 17019 - DNA, 20 bp, human
gtcacccagcgggttagcag

SEQ ID NO: 17020 - DNA, 20 bp, human
gagccctggtggcagcgcca

SEQ ID NO: 17021 - DNA, 20 bp, human
gtagcccccagcatgctgtg

SEQ ID NO: 17022 - DNA, 20 bp, human
gctaacctgaagtcacccag

SEQ ID NO: 17023 - DNA, 20 bp, human
ggggcaaggccagcaacccg

SEQ ID NO: 17024 - DNA, 20 bp, human
gccagagtggacacatcata

SEQ ID NO: 17025 - DNA, 20 bp, human
gtcccaatgtgagcaagccc

SEQ ID NO: 17026 - DNA, 20 bp, human
ggcgtgcccaggtaaaagta

SEQ ID NO: 17027 - DNA, 20 bp, human
gcctcgcccagaggaccaaa

SEQ ID NO: 17028 - DNA, 20 bp, human
gcagacccactgcccgggag

SEQ ID NO: 17029 - DNA, 20 bp, human
gctgggcacgctggagtcct

SEQ ID NO: 17030 - DNA, 20 bp, human
gctggggtgtgcaggatata

SEQ ID NO: 17031 - DNA, 20 bp, human
gatgtccctgggtcttcctt

SEQ ID NO: 17032 - DNA, 20 bp, human
ggtggaggacagtcaaagaa

SEQ ID NO: 17033 - DNA, 20 bp, human
gaccaaagggcagtgacgaa

SEQ ID NO: 17034 - DNA, 20 bp, human
gcaggacaatgtggtgccca

SEQ ID NO: 17035 - DNA, 20 bp, human
gacagtcaaagaagggatcc

SEQ ID NO: 17036 - DNA, 20 bp, human
gctcaggaaccacctgaggt

SEQ ID NO: 17037 - DNA, 20 bp, human
gggcagaggagggctaccct

SEQ ID NO: 17038 - DNA, 20 bp, human
gaggtgaactctcagcccca

SEQ ID NO: 17039 - DNA, 20 bp, human
gcatcaggtgatacagtcct

SEQ ID NO: 17040 - DNA, 20 bp, human
ggccccatgcctacctcagg

SEQ ID NO: 17041 - DNA, 20 bp, human
gaaccacctgaggtaggcat

SEQ ID NO: 17042 - DNA, 20 bp, human
gccaagctggctgtcacacg

SEQ ID NO: 17043 - DNA, 20 bp, human
gctgagagttcacctgtctc

SEQ ID NO: 17044 - DNA, 20 bp, human
gggtagccctcctctgcccg

SEQ ID NO: 17045 - DNA, 20 bp, human
gtgactcagtctggccaaat

SEQ ID NO: 17046 - DNA, 20 bp, human
gaggagctgctagagacggt

SEQ ID NO: 17047 - DNA, 20 bp, human
gtgaggttgaagaggtcgag

SEQ ID NO: 17048 - DNA, 20 bp, human
gcccttaccctagtgatgtg

SEQ ID NO: 17049 - DNA, 20 bp, human
gtgccaggagctgctagaga

SEQ ID NO: 17050 - DNA, 20 bp, human
ggcctataaggagcagaagg

SEQ ID NO: 17051 - DNA, 20 bp, human
gagggtaagggaactgtact

SEQ ID NO: 17052 - DNA, 20 bp, human
ggcctcacatcactagggta

SEQ ID NO: 17053 - DNA, 20 bp, human
gacgctcgctcggattgaca

SEQ ID NO: 17054 - DNA, 20 bp, human
gggttgaagaggtcgagggg

SEQ ID NO: 17055 - DNA, 20 bp, human
ggaggtggactgggtgatat

SEQ ID NO: 17056 - DNA, 20 bp, human
gagcggcagggacctcctag

SEQ ID NO: 17057 - DNA, 20 bp, human
gggacctcctaggggtaagg

SEQ ID NO: 17058 - DNA, 20 bp, human
gggtgcgcctccttacccct

SEQ ID NO: 17059 - DNA, 20 bp, human
ggcgcctccttacccctagg

SEQ ID NO: 17060 - DNA, 20 bp, human
ggccggacactgagtagaca

SEQ ID NO: 17061 - DNA, 20 bp, human
gcagggacctcctaggggta

SEQ ID NO: 17062 - DNA, 20 bp, human
gactcagtgtccggcagggg

SEQ ID NO: 17063 - DNA, 20 bp, human
gctctctggaaagtgaggtt

SEQ ID NO: 17064 - DNA, 20 bp, human
gcaggcctgggaaggtaata

SEQ ID NO: 17065 - DNA, 20 bp, human
gctagtcaggagagcctctt

SEQ ID NO: 17066 - DNA, 20 bp, human
ggagggagacccaggcactc

SEQ ID NO: 17067 - DNA, 20 bp, human
gtcatccatgcggctctcca

SEQ ID NO: 17068 - DNA, 20 bp, human
gtcaaaacaggagctccccc

SEQ ID NO: 17069 - DNA, 20 bp, human
gtgaagttagagcaccatgg

SEQ ID NO: 17070 - DNA, 20 bp, human
ggcctgaagttagagcacca

SEQ ID NO: 17071 - DNA, 20 bp, human
gtgttggtgatgactaagta

SEQ ID NO: 17072 - DNA, 20 bp, human
gaacctggagactgcatgta

SEQ ID NO: 17073 - DNA, 20 bp, human
ggaagttgtttaatgcaaga

SEQ ID NO: 17074 - DNA, 20 bp, human
gagggcaggtctatacagcc

SEQ ID NO: 17075 - DNA, 20 bp, human
gaggaccctggagagccgca

SEQ ID NO: 17076 - DNA, 20 bp, human
ggagaacacatcagcttcaa

SEQ ID NO: 17077 - DNA, 20 bp, human
gcaaaggcagagagaatcga

SEQ ID NO: 17078 - DNA, 20 bp, human
gtgagtcttacctcaagcag

SEQ ID NO: 17079 - DNA, 20 bp, human
ggcgcacctggaggcttctt

SEQ ID NO: 17080 - DNA, 20 bp, human
ggggttcccctctgaaatgg

SEQ ID NO: 17081 - DNA, 20 bp, human
gcagaggaagtgtccaaagc

SEQ ID NO: 17082 - DNA, 20 bp, human
gatcagcatggttaggacta

SEQ ID NO: 17083 - DNA, 20 bp, human
gagagggttgctcagtgatc

SEQ ID NO: 17084 - DNA, 20 bp, human
ggtcacatatgcgcacctgg

SEQ ID NO: 17085 - DNA, 20 bp, human
gtgatgcaaaactaagtagg

SEQ ID NO: 17086 - DNA, 20 bp, human
gtcggtactggacacaacga

SEQ ID NO: 17087 - DNA, 20 bp, human
gcagtgccaaagctcggtac

SEQ ID NO: 17088 - DNA, 20 bp, human
gtggacacaacgagggacct

SEQ ID NO: 17089 - DNA, 20 bp, human
gtgtgtccagtaccgagctt

SEQ ID NO: 17090 - DNA, 20 bp, human
gcatgctcagtagctgaggt

SEQ ID NO: 17091 - DNA, 20 bp, human
ggacactcaagagtccaagt

SEQ ID NO: 17092 - DNA, 20 bp, human
gctgaccggccggagagaaa

SEQ ID NO: 17093 - DNA, 20 bp, human
gagcgcgttatcgtagaccc

SEQ ID NO: 17094 - DNA, 20 bp, human
gagagaaacggtgacaaacc

SEQ ID NO: 17095 - DNA, 20 bp, human
ggttggaccaaagacacttc

SEQ ID NO: 17096 - DNA, 20 bp, human
gggctgaaggcgatccggag

SEQ ID NO: 17097 - DNA, 20 bp, human
gatggcggctgaaggcgatc

SEQ ID NO: 17098 - DNA, 20 bp, human
gcccggccgacggaagcggg

SEQ ID NO: 17099 - DNA, 20 bp, human
gccccagtcaccgagcgaga

SEQ ID NO: 17100 - DNA, 20 bp, human
gtgactgggggaaccgacag

SEQ ID NO: 17101 - DNA, 20 bp, human
ggccgacggaagcgggtgga

SEQ ID NO: 17102 - DNA, 20 bp, human
gccgcctcggctccgacatg

SEQ ID NO: 17103 - DNA, 20 bp, human
gggggcccggccgacggaag

SEQ ID NO: 17104 - DNA, 20 bp, human
ggggggagaaggaaagcgaa

SEQ ID NO: 17105 - DNA, 20 bp, human
gcatcggggggctccgctcg

SEQ ID NO: 17106 - DNA, 20 bp, human
ggacccaggaccatgtgata

SEQ ID NO: 17107 - DNA, 20 bp, human
gtaatatgtgggaaaaaaca

SEQ ID NO: 17108 - DNA, 20 bp, human
gtcaccagtaggcagggatc

SEQ ID NO: 17109 - DNA, 20 bp, human
gatggccgaatgtcaccagt

SEQ ID NO: 17110 - DNA, 20 bp, human
gggctgaataccatatcaca

SEQ ID NO: 17111 - DNA, 20 bp, human
gtatacctaaagaagcacct

SEQ ID NO: 17112 - DNA, 20 bp, human
gaggtaacgtaagtcttgtc

SEQ ID NO: 17113 - DNA, 20 bp, human
gcgaatgtcaccagtaggca

SEQ ID NO: 17114 - DNA, 20 bp, human
ggggggcttgtgaatatctc

SEQ ID NO: 17115 - DNA, 20 bp, human
gtaccatatcacatggtcct

SEQ ID NO: 17116 - DNA, 20 bp, human
ggacccaggaccatgtgata

SEQ ID NO: 17117 - DNA, 20 bp, human
gtaatatgtgggaaaaaaca

SEQ ID NO: 17118 - DNA, 20 bp, human
gtcaccagtaggcagggatc

SEQ ID NO: 17119 - DNA, 20 bp, human
gatggccgaatgtcaccagt

SEQ ID NO: 17120 - DNA, 20 bp, human
gggctgaataccatatcaca

SEQ ID NO: 17121 - DNA, 20 bp, human
gtatacctaaagaagcacct

SEQ ID NO: 17122 - DNA, 20 bp, human
gaggtaacgtaagtcttgtc

SEQ ID NO: 17123 - DNA, 20 bp, human
gcgaatgtcaccagtaggca

SEQ ID NO: 17124 - DNA, 20 bp, human
ggggggcttgtgaatatctc

SEQ ID NO: 17125 - DNA, 20 bp, human
gtaccatatcacatggtcct

SEQ ID NO: 17126 - DNA, 20 bp, human
ggacccaggaccatgtgata

SEQ ID NO: 17127 - DNA, 20 bp, human
gtaatatgtgggaaaaaaca

SEQ ID NO: 17128 - DNA, 20 bp, human
gtcaccagtaggcagggatc

SEQ ID NO: 17129 - DNA, 20 bp, human
gatggccgaatgtcaccagt

SEQ ID NO: 17130 - DNA, 20 bp, human
gggctgaataccatatcaca

SEQ ID NO: 17131 - DNA, 20 bp, human
gtatacctaaagaagcacct

SEQ ID NO: 17132 - DNA, 20 bp, human
gaggtaacgtaagtcttgtc

SEQ ID NO: 17133 - DNA, 20 bp, human
gcgaatgtcaccagtaggca

SEQ ID NO: 17134 - DNA, 20 bp, human
ggggggcttgtgaatatctc

SEQ ID NO: 17135 - DNA, 20 bp, human
gtaccatatcacatggtcct

SEQ ID NO: 17136 - DNA, 20 bp, human
gccatcttataaccgagagc

SEQ ID NO: 17137 - DNA, 20 bp, human
gagggcgcctgggccacctc

SEQ ID NO: 17138 - DNA, 20 bp, human
ggcgggaggctatcaatagg

SEQ ID NO: 17139 - DNA, 20 bp, human
gccgagcctgaggggattgg

SEQ ID NO: 17140 - DNA, 20 bp, human
ggggcgcagccgagcctgag

SEQ ID NO: 17141 - DNA, 20 bp, human
gcgcgggccggtacctgagg

SEQ ID NO: 17142 - DNA, 20 bp, human
gggtccgagaaggtcacgat

SEQ ID NO: 17143 - DNA, 20 bp, human
gggccgcgggccggtacctg

SEQ ID NO: 17144 - DNA, 20 bp, human
gcaatagggggcgaaactca

SEQ ID NO: 17145 - DNA, 20 bp, human
gtggcccccaccccagatgt

SEQ ID NO: 17146 - DNA, 20 bp, human
gaaacgggaaggcctctcaa

SEQ ID NO: 17147 - DNA, 20 bp, human
ggcacagggagggaggttcg

SEQ ID NO: 17148 - DNA, 20 bp, human
gtggctccgagggctgttcg

SEQ ID NO: 17149 - DNA, 20 bp, human
ggaggttgttgtggctccga

SEQ ID NO: 17150 - DNA, 20 bp, human
gcctgagataacaaacggga

SEQ ID NO: 17151 - DNA, 20 bp, human
gggcggcaactgcattgagg

SEQ ID NO: 17152 - DNA, 20 bp, human
gcagctcctcgaacagccct

SEQ ID NO: 17153 - DNA, 20 bp, human
gaggcctctcaaaggcggat

SEQ ID NO: 17154 - DNA, 20 bp, human
ggcggaagtggaggttgttg

SEQ ID NO: 17155 - DNA, 20 bp, human
gggcggcggcaactgcattg

SEQ ID NO: 17156 - DNA, 20 bp, human
gggcggaggacgcaaccgag

SEQ ID NO: 17157 - DNA, 20 bp, human
gggtcgaggtcgtggtagtg

SEQ ID NO: 17158 - DNA, 20 bp, human
gctgtccctcccaggattag

SEQ ID NO: 17159 - DNA, 20 bp, human
gtgcagccaccactaatcct

SEQ ID NO: 17160 - DNA, 20 bp, human
gaccgagcggtgaggcgcgt

SEQ ID NO: 17161 - DNA, 20 bp, human
gtccctcccaggattagtgg

SEQ ID NO: 17162 - DNA, 20 bp, human
ggccaccactaatcctggga

SEQ ID NO: 17163 - DNA, 20 bp, human
gacctggtcctgggagagac

SEQ ID NO: 17164 - DNA, 20 bp, human
ggcggggtgcggaaaggaag

SEQ ID NO: 17165 - DNA, 20 bp, human
gaggcccgagagtccagaag

SEQ ID NO: 17166 - DNA, 20 bp, human
gtcgctgagacttcctggac

SEQ ID NO: 17167 - DNA, 20 bp, human
ggaaggcctcctgagcgcag

SEQ ID NO: 17168 - DNA, 20 bp, human
gcacagcctgtcccccgtcc

SEQ ID NO: 17169 - DNA, 20 bp, human
gactggaatatgccttgagg

SEQ ID NO: 17170 - DNA, 20 bp, human
ggcgctgaggatcaggaagg

SEQ ID NO: 17171 - DNA, 20 bp, human
gtacccagagcagagggtga

SEQ ID NO: 17172 - DNA, 20 bp, human
gagacatagtgtccccctca

SEQ ID NO: 17173 - DNA, 20 bp, human
ggctggagcggcaccacgcc

SEQ ID NO: 17174 - DNA, 20 bp, human
ggcgttgtgaaccctgggga

SEQ ID NO: 17175 - DNA, 20 bp, human
gtatcacgaggattccccca

SEQ ID NO: 17176 - DNA, 20 bp, human
gggcgcgagcttctgaaact

SEQ ID NO: 17177 - DNA, 20 bp, human
ggaggggacagatttgtgac

SEQ ID NO: 17178 - DNA, 20 bp, human
ggacacccgaggcgcagcag

SEQ ID NO: 17179 - DNA, 20 bp, human
ggcgagcttctgaaactagg

SEQ ID NO: 17180 - DNA, 20 bp, human
gccgccgcaaaagacacccg

SEQ ID NO: 17181 - DNA, 20 bp, human
gggcagaggcggagccgctg

SEQ ID NO: 17182 - DNA, 20 bp, human
gcccctcacgcttctcccgg

SEQ ID NO: 17183 - DNA, 20 bp, human
gttctgaaactaggcggcag

SEQ ID NO: 17184 - DNA, 20 bp, human
gagctgaaggcggagcccaa

SEQ ID NO: 17185 - DNA, 20 bp, human
ggccgccgggagaagcgtga

SEQ ID NO: 17186 - DNA, 20 bp, human
gcccgaggcggacgtgagaa

SEQ ID NO: 17187 - DNA, 20 bp, human
gccccaggctacaggagaaa

SEQ ID NO: 17188 - DNA, 20 bp, human
gggaccaagtgggcccgagg

SEQ ID NO: 17189 - DNA, 20 bp, human
gtgggtgccggcagctccca

SEQ ID NO: 17190 - DNA, 20 bp, human
ggagaagggtcgggccaaga

SEQ ID NO: 17191 - DNA, 20 bp, human
gagcgtggttgagacaaacg

SEQ ID NO: 17192 - DNA, 20 bp, human
gcggcgcgcgggttcctagg

SEQ ID NO: 17193 - DNA, 20 bp, human
gtcaggaccaagtgggcccg

SEQ ID NO: 17194 - DNA, 20 bp, human
gccgcgacagagctatgtaa

SEQ ID NO: 17195 - DNA, 20 bp, human
gccggttgaccaaaactgca

SEQ ID NO: 17196 - DNA, 20 bp, human
gcccagcgaagcaaacaatg

SEQ ID NO: 17197 - DNA, 20 bp, human
gtcggcaccacaaccccgag

SEQ ID NO: 17198 - DNA, 20 bp, human
gggggctggctcggactcca

SEQ ID NO: 17199 - DNA, 20 bp, human
gccgccgccaaacatggcgt

SEQ ID NO: 17200 - DNA, 20 bp, human
gctggctcggactccagggc

SEQ ID NO: 17201 - DNA, 20 bp, human
ggcctcggcccggcctctcg

SEQ ID NO: 17202 - DNA, 20 bp, human
ggcggcggccgcggactctc

SEQ ID NO: 17203 - DNA, 20 bp, human
ggccgctgcccgagagtccg

SEQ ID NO: 17204 - DNA, 20 bp, human
gcgccccgaaggtgagtggg

SEQ ID NO: 17205 - DNA, 20 bp, human
ggcggcgccccgaaggtgag

SEQ ID NO: 17206 - DNA, 20 bp, human
gcgactcgaaggctctgtat

SEQ ID NO: 17207 - DNA, 20 bp, human
gtcgaaggctctgtatcggt

SEQ ID NO: 17208 - DNA, 20 bp, human
gcagctgaggcgggcaacta

SEQ ID NO: 17209 - DNA, 20 bp, human
ggcggccccggacgactcga

SEQ ID NO: 17210 - DNA, 20 bp, human
gtgaggcgggcaactaagga

SEQ ID NO: 17211 - DNA, 20 bp, human
gtggcgcgctctgcagacgg

SEQ ID NO: 17212 - DNA, 20 bp, human
gatggcggcggcctcagctg

SEQ ID NO: 17213 - DNA, 20 bp, human
gagcctctagaacgagctgg

SEQ ID NO: 17214 - DNA, 20 bp, human
gagcagcctctagaacgagc

SEQ ID NO: 17215 - DNA, 20 bp, human
gcagcgggctatattgacga

SEQ ID NO: 17216 - DNA, 20 bp, human
gcacggagcggctggtccat

SEQ ID NO: 17217 - DNA, 20 bp, human
ggaggactccggaccctggt

SEQ ID NO: 17218 - DNA, 20 bp, human
gggtccatcggtcagcgcca

SEQ ID NO: 17219 - DNA, 20 bp, human
gcctccctggcgctgaccga

SEQ ID NO: 17220 - DNA, 20 bp, human
gtctcaggggccctccgcca

SEQ ID NO: 17221 - DNA, 20 bp, human
ggaccagccgctccgtgggg

SEQ ID NO: 17222 - DNA, 20 bp, human
gcaggggccctccgccacgg

SEQ ID NO: 17223 - DNA, 20 bp, human
ggtccgagctcgcctggagg

SEQ ID NO: 17224 - DNA, 20 bp, human
gactccggaccctggtgggg

SEQ ID NO: 17225 - DNA, 20 bp, human
gcctcggcaaccctaaaagt

SEQ ID NO: 17226 - DNA, 20 bp, human
gcggggccggcgagccaaag

SEQ ID NO: 17227 - DNA, 20 bp, human
gcggcgagccaaagaggagc

SEQ ID NO: 17228 - DNA, 20 bp, human
ggcgcgccctccctcacgga

SEQ ID NO: 17229 - DNA, 20 bp, human
gcttggcctcgcggctccgg

SEQ ID NO: 17230 - DNA, 20 bp, human
gtccggcggccgtcccctcc

SEQ ID NO: 17231 - DNA, 20 bp, human
gaagatggcgggcggaggaa

SEQ ID NO: 17232 - DNA, 20 bp, human
gtcgtggccgcgcacaaagg

SEQ ID NO: 17233 - DNA, 20 bp, human
gcgcgcggccggctcctctt

SEQ ID NO: 17234 - DNA, 20 bp, human
gtcccccttcgaaagatggc

SEQ ID NO: 17235 - DNA, 20 bp, human
gtggccgcgcacaaaggcgg

SEQ ID NO: 17236 - DNA, 20 bp, human
gggtagaaagacgccaggga

SEQ ID NO: 17237 - DNA, 20 bp, human
gtgatgggtacagcaaagtg

SEQ ID NO: 17238 - DNA, 20 bp, human
ggaagcagtcgccaagacga

SEQ ID NO: 17239 - DNA, 20 bp, human
gcacaggtagaaagacgcca

SEQ ID NO: 17240 - DNA, 20 bp, human
gcctagaagagctccacagg

SEQ ID NO: 17241 - DNA, 20 bp, human
gaggcccagtcatcctacac

SEQ ID NO: 17242 - DNA, 20 bp, human
gctaaagtgatggagcacac

SEQ ID NO: 17243 - DNA, 20 bp, human
gcagtggcaacacccacaag

SEQ ID NO: 17244 - DNA, 20 bp, human
ggtgcaggtctgtgtgatga

SEQ ID NO: 17245 - DNA, 20 bp, human
ggggcctagaagagctccac

SEQ ID NO: 17246 - DNA, 20 bp, human
ggggcccgccgcccgcaccc

SEQ ID NO: 17247 - DNA, 20 bp, human
gcccctcctcaccctcgtag

SEQ ID NO: 17248 - DNA, 20 bp, human
ggatgcccctctcgagaaga

SEQ ID NO: 17249 - DNA, 20 bp, human
gcagagacccaccggaccag

SEQ ID NO: 17250 - DNA, 20 bp, human
gaggcccaggccggcgaagg

SEQ ID NO: 17251 - DNA, 20 bp, human
gaatgccgcggccgcacggg

SEQ ID NO: 17252 - DNA, 20 bp, human
gcgcgccgtcttctcgagag

SEQ ID NO: 17253 - DNA, 20 bp, human
gggccgcgctgccccccgtg

SEQ ID NO: 17254 - DNA, 20 bp, human
gacggcgcgcgagacccggc

SEQ ID NO: 17255 - DNA, 20 bp, human
gcaccggaccagggggaccc

SEQ ID NO: 17256 - DNA, 20 bp, human
ggaccgtctctcctcagggt

SEQ ID NO: 17257 - DNA, 20 bp, human
gcctagcctcggatctacaa

SEQ ID NO: 17258 - DNA, 20 bp, human
ggccaagatggcgacgggaa

SEQ ID NO: 17259 - DNA, 20 bp, human
gtccagaccgtctctcctca

SEQ ID NO: 17260 - DNA, 20 bp, human
gatgagccagacggagtaac

SEQ ID NO: 17261 - DNA, 20 bp, human
gctcagggttggagacttcg

SEQ ID NO: 17262 - DNA, 20 bp, human
gtcggggccaagatggcgac

SEQ ID NO: 17263 - DNA, 20 bp, human
gaaaggcctttgtagatccg

SEQ ID NO: 17264 - DNA, 20 bp, human
gcgagatgcaatttcctgag

SEQ ID NO: 17265 - DNA, 20 bp, human
gtttctcagggagagagcgg

SEQ ID NO: 17266 - DNA, 20 bp, human
gccagcgagctcggcaacct

SEQ ID NO: 17267 - DNA, 20 bp, human
gctccccacgggctcctcgt

SEQ ID NO: 17268 - DNA, 20 bp, human
gaccccggtcctggagacta

SEQ ID NO: 17269 - DNA, 20 bp, human
gctccaggaccggggtgagt

SEQ ID NO: 17270 - DNA, 20 bp, human
gctgcccacgaggagcccgt

SEQ ID NO: 17271 - DNA, 20 bp, human
ggctgcaagcccactcaccc

SEQ ID NO: 17272 - DNA, 20 bp, human
gtgagaactgcgaggggatt

SEQ ID NO: 17273 - DNA, 20 bp, human
gtccctagtctccaggaccg

SEQ ID NO: 17274 - DNA, 20 bp, human
gcatgaggaggatctcggag

SEQ ID NO: 17275 - DNA, 20 bp, human
gccagcagggaaagacggaa

SEQ ID NO: 17276 - DNA, 20 bp, human
gagcgactggcaactcacct

SEQ ID NO: 17277 - DNA, 20 bp, human
gccattacaacaaaaactgg

SEQ ID NO: 17278 - DNA, 20 bp, human
gcacaaaatgaagcggtgca

SEQ ID NO: 17279 - DNA, 20 bp, human
gcctaaggcagcaccccctg

SEQ ID NO: 17280 - DNA, 20 bp, human
gggtaatgtaccctccacag

SEQ ID NO: 17281 - DNA, 20 bp, human
gaggggcaatcacataaggt

SEQ ID NO: 17282 - DNA, 20 bp, human
gcaacatcgtgcgacagtcc

SEQ ID NO: 17283 - DNA, 20 bp, human
gaaggccaaagggaagcgac

SEQ ID NO: 17284 - DNA, 20 bp, human
gtcaggctcgttgcccccaa

SEQ ID NO: 17285 - DNA, 20 bp, human
ggaggaggcagttggacaac

SEQ ID NO: 17286 - DNA, 20 bp, human
ggactcgcctcctcttccta

SEQ ID NO: 17287 - DNA, 20 bp, human
gacttagtccgatcggtaac

SEQ ID NO: 17288 - DNA, 20 bp, human
gcggtaaccggcgactacgt

SEQ ID NO: 17289 - DNA, 20 bp, human
ggaatgaccaccccactcta

SEQ ID NO: 17290 - DNA, 20 bp, human
gaggtcggtgcgtctgtcgg

SEQ ID NO: 17291 - DNA, 20 bp, human
gcacgagggaagttacactg

SEQ ID NO: 17292 - DNA, 20 bp, human
gtaagacgtcccctagagtg

SEQ ID NO: 17293 - DNA, 20 bp, human
gcaggtggcgtggagaactg

SEQ ID NO: 17294 - DNA, 20 bp, human
gcggcgactacgtggggtac

SEQ ID NO: 17295 - DNA, 20 bp, human
ggtagtcgccggttaccgat

SEQ ID NO: 17296 - DNA, 20 bp, human
gtcaccggtaggccccgctc

SEQ ID NO: 17297 - DNA, 20 bp, human
ggcccccaagcgccagtcct

SEQ ID NO: 17298 - DNA, 20 bp, human
ggaacccgagcggggcctac

SEQ ID NO: 17299 - DNA, 20 bp, human
gggtgagcgcagccgaggac

SEQ ID NO: 17300 - DNA, 20 bp, human
gctcggctgcgctcaccggt

SEQ ID NO: 17301 - DNA, 20 bp, human
gtcggaggggcgacctgcgg

SEQ ID NO: 17302 - DNA, 20 bp, human
gggcgcgcgcggcgaatctg

SEQ ID NO: 17303 - DNA, 20 bp, human
gggcttcggcggaacccgag

SEQ ID NO: 17304 - DNA, 20 bp, human
gacgcggtgtgcaccgcctg

SEQ ID NO: 17305 - DNA, 20 bp, human
ggcgcggtcgccggcatgac

SEQ ID NO: 17306 - DNA, 20 bp, human
ggtctgcaacagcaaccgtg

SEQ ID NO: 17307 - DNA, 20 bp, human
gccgtgaggcagcaagaagt

SEQ ID NO: 17308 - DNA, 20 bp, human
ggcgacgagggcaatctccg

SEQ ID NO: 17309 - DNA, 20 bp, human
gccctcgtcgctgaaggtag

SEQ ID NO: 17310 - DNA, 20 bp, human
ggaggcagcaagaagtagga

SEQ ID NO: 17311 - DNA, 20 bp, human
gctgcctggcatctcacaac

SEQ ID NO: 17312 - DNA, 20 bp, human
gctccgtggagccgcagtcc

SEQ ID NO: 17313 - DNA, 20 bp, human
ggggccggttgtgagatgcc

SEQ ID NO: 17314 - DNA, 20 bp, human
gcggctgcgtggtcaccgag

SEQ ID NO: 17315 - DNA, 20 bp, human
gtaggaggggacacttcaaa

SEQ ID NO: 17316 - DNA, 20 bp, human
gccgaggactagagccccgg

SEQ ID NO: 17317 - DNA, 20 bp, human
gtacgggcccacctgtgacg

SEQ ID NO: 17318 - DNA, 20 bp, human
gagctccaggaaggaccccc

SEQ ID NO: 17319 - DNA, 20 bp, human
gcctcgggcccgtcgtaacc

SEQ ID NO: 17320 - DNA, 20 bp, human
gggccccgccgggttacgac

SEQ ID NO: 17321 - DNA, 20 bp, human
gcgggcccgtcgtaacccgg

SEQ ID NO: 17322 - DNA, 20 bp, human
gagccgccggcggggaaagt

SEQ ID NO: 17323 - DNA, 20 bp, human
gcccctacctcgtcacaggt

SEQ ID NO: 17324 - DNA, 20 bp, human
ggtcacgaggcgctcgctgt

SEQ ID NO: 17325 - DNA, 20 bp, human
ggagggccagcctccccccc

SEQ ID NO: 17326 - DNA, 20 bp, human
ggctccggctagggcaaggt

SEQ ID NO: 17327 - DNA, 20 bp, human
gcggcggcggctgtgggtaa

SEQ ID NO: 17328 - DNA, 20 bp, human
gccgcagcgggctccggcta

SEQ ID NO: 17329 - DNA, 20 bp, human
gtgcgcgccgctcagaaggt

SEQ ID NO: 17330 - DNA, 20 bp, human
ggcgggctccggctagggca

SEQ ID NO: 17331 - DNA, 20 bp, human
gccgcaggcggcaggccccg

SEQ ID NO: 17332 - DNA, 20 bp, human
gctaccggggccgacctggg

SEQ ID NO: 17333 - DNA, 20 bp, human
gcactggtcaggcccggcgg

SEQ ID NO: 17334 - DNA, 20 bp, human
gtgaccagtgcgggtctggg

SEQ ID NO: 17335 - DNA, 20 bp, human
gaccggggcaaggtgaccgc

SEQ ID NO: 17336 - DNA, 20 bp, human
gatcggcacattgtgagcag

SEQ ID NO: 17337 - DNA, 20 bp, human
gctccagcagagcaagggtg

SEQ ID NO: 17338 - DNA, 20 bp, human
gggtggaagggcccactcag

SEQ ID NO: 17339 - DNA, 20 bp, human
gcctaggagcagacagccag

SEQ ID NO: 17340 - DNA, 20 bp, human
ggggaggcactcacccctgt

SEQ ID NO: 17341 - DNA, 20 bp, human
gccccaaacctgggcctaca

SEQ ID NO: 17342 - DNA, 20 bp, human
gttgctgcaggagtaacggg

SEQ ID NO: 17343 - DNA, 20 bp, human
gagaccaagccctcctgcgg

SEQ ID NO: 17344 - DNA, 20 bp, human
ggactcctgacacccctgag

SEQ ID NO: 17345 - DNA, 20 bp, human
ggtccttgctgcaggagtaa

SEQ ID NO: 17346 - DNA, 20 bp, human
ggcctcgctcccggacccca

SEQ ID NO: 17347 - DNA, 20 bp, human
gaggcggctggcgaatggag

SEQ ID NO: 17348 - DNA, 20 bp, human
gccacggctgcaaactgatc

SEQ ID NO: 17349 - DNA, 20 bp, human
gcggacattgactccaggta

SEQ ID NO: 17350 - DNA, 20 bp, human
gggcccggggccgggtccaa

SEQ ID NO: 17351 - DNA, 20 bp, human
gggacaagggtgccggtagg

SEQ ID NO: 17352 - DNA, 20 bp, human
gcgaggacaggcatgaatcc

SEQ ID NO: 17353 - DNA, 20 bp, human
gacattgactccaggtaagg

SEQ ID NO: 17354 - DNA, 20 bp, human
ggagcgaggcggctggcgaa

SEQ ID NO: 17355 - DNA, 20 bp, human
gccaggtgaagagcggacaa

SEQ ID NO: 17356 - DNA, 20 bp, human
gaggtgacactgcttaggta

SEQ ID NO: 17357 - DNA, 20 bp, human
gtaggtacggagcgcggagt

SEQ ID NO: 17358 - DNA, 20 bp, human
gccgtgcgctccgaggtcag

SEQ ID NO: 17359 - DNA, 20 bp, human
gacggagcgcggagtcggag

SEQ ID NO: 17360 - DNA, 20 bp, human
ggaagtgcaagacccaactg

SEQ ID NO: 17361 - DNA, 20 bp, human
gacgcggggtgggagaggta

SEQ ID NO: 17362 - DNA, 20 bp, human
gttcgggtgagagagcgggt

SEQ ID NO: 17363 - DNA, 20 bp, human
gtctgcaggtgacactgctt

SEQ ID NO: 17364 - DNA, 20 bp, human
ggtaagcgctgccagcgcag

SEQ ID NO: 17365 - DNA, 20 bp, human
gcaggcaagtggtctaacgt

SEQ ID NO: 17366 - DNA, 20 bp, human
gtagtgagctgcagggtagt

SEQ ID NO: 17367 - DNA, 20 bp, human
gggtaaagtagtgagctgca

SEQ ID NO: 17368 - DNA, 20 bp, human
gacttaccagaggaaatttc

SEQ ID NO: 17369 - DNA, 20 bp, human
gctgtgagaaaaatacatcc

SEQ ID NO: 17370 - DNA, 20 bp, human
gtgcacatccccatacagtg

SEQ ID NO: 17371 - DNA, 20 bp, human
gaccttgatttggaagatca

SEQ ID NO: 17372 - DNA, 20 bp, human
gtattccacctcctgttctc

SEQ ID NO: 17373 - DNA, 20 bp, human
gtcgtggctctctgtgtaac

SEQ ID NO: 17374 - DNA, 20 bp, human
gtacttggttacatgccacc

SEQ ID NO: 17375 - DNA, 20 bp, human
ggaaaatgctttatatgggg

SEQ ID NO: 17376 - DNA, 20 bp, human
gcccaagagttgaaccggag

SEQ ID NO: 17377 - DNA, 20 bp, human
gtagtccccaagagttgaac

SEQ ID NO: 17378 - DNA, 20 bp, human
gtgcaaagtaaaagcctctc

SEQ ID NO: 17379 - DNA, 20 bp, human
gtggaaccagcagtaaccag

SEQ ID NO: 17380 - DNA, 20 bp, human
gtcatgcagttaagcaggta

SEQ ID NO: 17381 - DNA, 20 bp, human
ggcctctccggttcaactct

SEQ ID NO: 17382 - DNA, 20 bp, human
ggctgatcacgttctcgacc

SEQ ID NO: 17383 - DNA, 20 bp, human
gagctgtgtaaaatgcccac

SEQ ID NO: 17384 - DNA, 20 bp, human
gtaaactctctgtcactgtt

SEQ ID NO: 17385 - DNA, 20 bp, human
gcttggccgctggttactgc

SEQ ID NO: 17386 - DNA, 20 bp, human
gcggagggaagtccacggaa

SEQ ID NO: 17387 - DNA, 20 bp, human
gtgaggggtctggtgggtcg

SEQ ID NO: 17388 - DNA, 20 bp, human
gggccttgtgtgcaggactg

SEQ ID NO: 17389 - DNA, 20 bp, human
gggtctggtgggtcgaggaa

SEQ ID NO: 17390 - DNA, 20 bp, human
gggtcgaggaaaggtaacgg

SEQ ID NO: 17391 - DNA, 20 bp, human
gcaagtcggagggaagtcca

SEQ ID NO: 17392 - DNA, 20 bp, human
ggctcaaaggaggtaaggat

SEQ ID NO: 17393 - DNA, 20 bp, human
gcagcgcccgggctaagaac

SEQ ID NO: 17394 - DNA, 20 bp, human
gacaggcctgcgctcaaagg

SEQ ID NO: 17395 - DNA, 20 bp, human
gggccccagtcctgcacaca

SEQ ID NO: 17396 - DNA, 20 bp, human
gcgcgggcggcgaggcaaga

SEQ ID NO: 17397 - DNA, 20 bp, human
gcaaccaagaggaaacggcg

SEQ ID NO: 17398 - DNA, 20 bp, human
gccaagaggaaacggcgtgg

SEQ ID NO: 17399 - DNA, 20 bp, human
gcacggggaagcgacttaca

SEQ ID NO: 17400 - DNA, 20 bp, human
gaggaggccaagagcgcggg

SEQ ID NO: 17401 - DNA, 20 bp, human
gcacgtggccgtcttcctgg

SEQ ID NO: 17402 - DNA, 20 bp, human
gtgcggagccgccagctaag

SEQ ID NO: 17403 - DNA, 20 bp, human
gggagggccggtctgaagag

SEQ ID NO: 17404 - DNA, 20 bp, human
gtgtccccgggctacacctg

SEQ ID NO: 17405 - DNA, 20 bp, human
ggaaaggaggccaagagcgc

SEQ ID NO: 17406 - DNA, 20 bp, human
ggaaccacggagcgaggatg

SEQ ID NO: 17407 - DNA, 20 bp, human
ggtgcagcgggagattcacc

SEQ ID NO: 17408 - DNA, 20 bp, human
gtggatgcagagtacaaagg

SEQ ID NO: 17409 - DNA, 20 bp, human
gacaggaggatccggtgcag

SEQ ID NO: 17410 - DNA, 20 bp, human
gcgggagattcaccaggact

SEQ ID NO: 17411 - DNA, 20 bp, human
ggcagtcgctcttcctcagg

SEQ ID NO: 17412 - DNA, 20 bp, human
ggaatggatgcagagtacaa

SEQ ID NO: 17413 - DNA, 20 bp, human
gctcccggttagcccagtcc

SEQ ID NO: 17414 - DNA, 20 bp, human
gtgcgcagtcgctcttcctc

SEQ ID NO: 17415 - DNA, 20 bp, human
ggtcgctcttcctcaggcgg

SEQ ID NO: 17416 - DNA, 20 bp, human
gagccggtaccggcaaccac

SEQ ID NO: 17417 - DNA, 20 bp, human
ggctgccgccggactcccgt

SEQ ID NO: 17418 - DNA, 20 bp, human
gcagaatggcagctcctccg

SEQ ID NO: 17419 - DNA, 20 bp, human
gcgcagcgcctacgggagtc

SEQ ID NO: 17420 - DNA, 20 bp, human
gggagccgcgcagcgcctac

SEQ ID NO: 17421 - DNA, 20 bp, human
gcgcacacggaagcaccgat

SEQ ID NO: 17422 - DNA, 20 bp, human
gctctgcctcccgaagaaaa

SEQ ID NO: 17423 - DNA, 20 bp, human
ggagcgggccggaatatcac

SEQ ID NO: 17424 - DNA, 20 bp, human
ggtgttgaggagctcacagg

SEQ ID NO: 17425 - DNA, 20 bp, human
gcggggcaggcccctaggga

SEQ ID NO: 17426 - DNA, 20 bp, human
ggcaagctcggtggctgggt

SEQ ID NO: 17427 - DNA, 20 bp, human
gagggggcgagcaagctcgg

SEQ ID NO: 17428 - DNA, 20 bp, human
gcccgccgccgggacccatc

SEQ ID NO: 17429 - DNA, 20 bp, human
gccaccgccgcttcaatgaa

SEQ ID NO: 17430 - DNA, 20 bp, human
gagcgcccagcgaccggtca

SEQ ID NO: 17431 - DNA, 20 bp, human
ggcgctgtctggctcctgat

SEQ ID NO: 17432 - DNA, 20 bp, human
gggctcctgatgggtcccgg

SEQ ID NO: 17433 - DNA, 20 bp, human
gccggtcagggtgcagccca

SEQ ID NO: 17434 - DNA, 20 bp, human
gggactacgccgaaaatgag

SEQ ID NO: 17435 - DNA, 20 bp, human
ggcgagcaagctcggtggct

SEQ ID NO: 17436 - DNA, 20 bp, human
gccctcggctccggaggtag

SEQ ID NO: 17437 - DNA, 20 bp, human
gggtagtgcgcgcagctcag

SEQ ID NO: 17438 - DNA, 20 bp, human
gtgagactccggggaagtag

SEQ ID NO: 17439 - DNA, 20 bp, human
ggaagagttgcccctacctc

SEQ ID NO: 17440 - DNA, 20 bp, human
ggccatgatagctaccgagg

SEQ ID NO: 17441 - DNA, 20 bp, human
gaaccgagactacagaacca

SEQ ID NO: 17442 - DNA, 20 bp, human
gctattgcggcattctccct

SEQ ID NO: 17443 - DNA, 20 bp, human
ggactccggggaagtagcgg

SEQ ID NO: 17444 - DNA, 20 bp, human
ggactgggcacgggaggaag

SEQ ID NO: 17445 - DNA, 20 bp, human
gtggagactaatgtaaaagg

SEQ ID NO: 17446 - DNA, 20 bp, human
gggcagcgcgaggacagcgg

SEQ ID NO: 17447 - DNA, 20 bp, human
ggcggcggcggagaccgtgg

SEQ ID NO: 17448 - DNA, 20 bp, human
gacagcggcggcggagaccg

SEQ ID NO: 17449 - DNA, 20 bp, human
ggcggagaccgtggcggcaa

SEQ ID NO: 17450 - DNA, 20 bp, human
gccgggcgctgctggaacaa

SEQ ID NO: 17451 - DNA, 20 bp, human
ggagtgcgggcctgggacca

SEQ ID NO: 17452 - DNA, 20 bp, human
gggagtggccggcagggaag

SEQ ID NO: 17453 - DNA, 20 bp, human
gcgtggcccgggaacctctc

SEQ ID NO: 17454 - DNA, 20 bp, human
gcgacggagttgagacccca

SEQ ID NO: 17455 - DNA, 20 bp, human
ggagccgggaccaaagcgtg

SEQ ID NO: 17456 - DNA, 20 bp, human
gcggagaggcgagaacccat

SEQ ID NO: 17457 - DNA, 20 bp, human
gtctcctggagcgagggcgg

SEQ ID NO: 17458 - DNA, 20 bp, human
ggagggacccaggggaccta

SEQ ID NO: 17459 - DNA, 20 bp, human
gcaattggaaggcgtggcgg

SEQ ID NO: 17460 - DNA, 20 bp, human
gccaggggccccgaacggtg

SEQ ID NO: 17461 - DNA, 20 bp, human
gacatctcctcagaggggag

SEQ ID NO: 17462 - DNA, 20 bp, human
ggagggtcggactccacgtc

SEQ ID NO: 17463 - DNA, 20 bp, human
gaagctctctcctggagcga

SEQ ID NO: 17464 - DNA, 20 bp, human
gttgacccctcggagaagaa

SEQ ID NO: 17465 - DNA, 20 bp, human
gcggagcccggccgagggga

SEQ ID NO: 17466 - DNA, 20 bp, human
gccatctcgttactagacgt

SEQ ID NO: 17467 - DNA, 20 bp, human
gggtagtgagttgcatccac

SEQ ID NO: 17468 - DNA, 20 bp, human
gactgaagcaaaggagtatc

SEQ ID NO: 17469 - DNA, 20 bp, human
gctagtaacgagatggtatt

SEQ ID NO: 17470 - DNA, 20 bp, human
gcgttactagacgtaggcat

SEQ ID NO: 17471 - DNA, 20 bp, human
gaaggagtatctggatgtct

SEQ ID NO: 17472 - DNA, 20 bp, human
gacacacagaactgaagcaa

SEQ ID NO: 17473 - DNA, 20 bp, human
gagatctccaaaagccaggc

SEQ ID NO: 17474 - DNA, 20 bp, human
gttcagaagaaatggctcaa

SEQ ID NO: 17475 - DNA, 20 bp, human
gttcggaagaattggttgta

SEQ ID NO: 17476 - DNA, 20 bp, human
gccggagagaaaggacgagg

SEQ ID NO: 17477 - DNA, 20 bp, human
ggtgccggagagaaaggacg

SEQ ID NO: 17478 - DNA, 20 bp, human
gccggtcgggccgggaccaa

SEQ ID NO: 17479 - DNA, 20 bp, human
gggcccccaccggagagacg

SEQ ID NO: 17480 - DNA, 20 bp, human
ggtcagcgtgccggagagaa

SEQ ID NO: 17481 - DNA, 20 bp, human
gtagcagaaggggacacctg

SEQ ID NO: 17482 - DNA, 20 bp, human
gtgtcgtccggggccaagga

SEQ ID NO: 17483 - DNA, 20 bp, human
ggagagaaaggacgaggtgg

SEQ ID NO: 17484 - DNA, 20 bp, human
gccaatatgtgggcccctat

SEQ ID NO: 17485 - DNA, 20 bp, human
gtcgccccgtctctccggtg

SEQ ID NO: 17486 - DNA, 20 bp, human
gcccagcgcacgcccgtcag

SEQ ID NO: 17487 - DNA, 20 bp, human
ggcagtatgttgggccctac

SEQ ID NO: 17488 - DNA, 20 bp, human
gtgacatcgacggggaagga

SEQ ID NO: 17489 - DNA, 20 bp, human
gcatcgacggggaaggacgg

SEQ ID NO: 17490 - DNA, 20 bp, human
gccgcctcgtcgagaggaca

SEQ ID NO: 17491 - DNA, 20 bp, human
gaagcggcctgcgggatccg

SEQ ID NO: 17492 - DNA, 20 bp, human
gcccagagcgatgacatcga

SEQ ID NO: 17493 - DNA, 20 bp, human
ggcagcacgcgcagtatgtt

SEQ ID NO: 17494 - DNA, 20 bp, human
gcggcgcggacggcactcgg

SEQ ID NO: 17495 - DNA, 20 bp, human
gtcggctgcgcggccgctga

SEQ ID NO: 17496 - DNA, 20 bp, human
gggcgcgcgcctgagaagag

SEQ ID NO: 17497 - DNA, 20 bp, human
gggcggcgcgcacggtatgg

SEQ ID NO: 17498 - DNA, 20 bp, human
gccaggcggcgcgcacggta

SEQ ID NO: 17499 - DNA, 20 bp, human
gcaccacccgcgacccccgg

SEQ ID NO: 17500 - DNA, 20 bp, human
ggaagcagccgggagcgcca

SEQ ID NO: 17501 - DNA, 20 bp, human
ggctggcgtcccctcttctc

SEQ ID NO: 17502 - DNA, 20 bp, human
ggcggaggcgtcggtccagg

SEQ ID NO: 17503 - DNA, 20 bp, human
ggcgagcgagcggagcgtgt

SEQ ID NO: 17504 - DNA, 20 bp, human
gacagctctgcgggaagaca

SEQ ID NO: 17505 - DNA, 20 bp, human
gggcgcgcacggtatggcgg

SEQ ID NO: 17506 - DNA, 20 bp, human
gcacctacccagatcgaagc

SEQ ID NO: 17507 - DNA, 20 bp, human
gtttgggggcttcgctccgg

SEQ ID NO: 17508 - DNA, 20 bp, human
ggccgaagtggcgaagaggt

SEQ ID NO: 17509 - DNA, 20 bp, human
gtattctagcccaagagctg

SEQ ID NO: 17510 - DNA, 20 bp, human
gtacccagatcgaagccggt

SEQ ID NO: 17511 - DNA, 20 bp, human
gatcaggtaatacagctctg

SEQ ID NO: 17512 - DNA, 20 bp, human
gcttgggctagaatatctat

SEQ ID NO: 17513 - DNA, 20 bp, human
gagagagcgaaactaggacg

SEQ ID NO: 17514 - DNA, 20 bp, human
ggggggtgctaagggaatgg

SEQ ID NO: 17515 - DNA, 20 bp, human
gtacccaccggcttcgatct

SEQ ID NO: 17516 - DNA, 20 bp, human
ggcgtggggtgtagccgtgt

SEQ ID NO: 17517 - DNA, 20 bp, human
gtttccatggttgcacgatt

SEQ ID NO: 17518 - DNA, 20 bp, human
gaggcggagaggagaaactc

SEQ ID NO: 17519 - DNA, 20 bp, human
gtggttgcacgattaggtag

SEQ ID NO: 17520 - DNA, 20 bp, human
gaccatggaaaccagcccgc

SEQ ID NO: 17521 - DNA, 20 bp, human
gagcaattgtggctactcta

SEQ ID NO: 17522 - DNA, 20 bp, human
ggagcgagctctgctcgagg

SEQ ID NO: 17523 - DNA, 20 bp, human
ggccggcgggctggtttcca

SEQ ID NO: 17524 - DNA, 20 bp, human
gctgtgaatgagaatcaagg

SEQ ID NO: 17525 - DNA, 20 bp, human
gagccggaagtcccgtctca

SEQ ID NO: 17526 - DNA, 20 bp, human
ggagtgcagtcgtacagcag

SEQ ID NO: 17527 - DNA, 20 bp, human
ggtacagcagaggaactctt

SEQ ID NO: 17528 - DNA, 20 bp, human
gcagcagaggaactcttagg

SEQ ID NO: 17529 - DNA, 20 bp, human
ggtaaacaggccgaagaggg

SEQ ID NO: 17530 - DNA, 20 bp, human
gtgtctgagcaggtcaccga

SEQ ID NO: 17531 - DNA, 20 bp, human
ggaggaactcttaggagggt

SEQ ID NO: 17532 - DNA, 20 bp, human
gctcacctggagctactggg

SEQ ID NO: 17533 - DNA, 20 bp, human
gccgaagaggggggatttag

SEQ ID NO: 17534 - DNA, 20 bp, human
gacctgctcagacaatggag

SEQ ID NO: 17535 - DNA, 20 bp, human
gcaaggatcggagatcagag

SEQ ID NO: 17536 - DNA, 20 bp, human
gtgcaggcaagatggcggaa

SEQ ID NO: 17537 - DNA, 20 bp, human
ggtgccgtgtcggaagtcaa

SEQ ID NO: 17538 - DNA, 20 bp, human
gtgatgtcatgcaggcaaga

SEQ ID NO: 17539 - DNA, 20 bp, human
ggtcaaaggtcagtaaatag

SEQ ID NO: 17540 - DNA, 20 bp, human
gggaccaggttgcattgagg

SEQ ID NO: 17541 - DNA, 20 bp, human
ggcgctaagtctcaaggatg

SEQ ID NO: 17542 - DNA, 20 bp, human
gcgcccagcaccccaaccct

SEQ ID NO: 17543 - DNA, 20 bp, human
gaattcaggccccaacgcct

SEQ ID NO: 17544 - DNA, 20 bp, human
gccggtagaggctaaaagaa

SEQ ID NO: 17545 - DNA, 20 bp, human
gtggggcctgaattctccca

SEQ ID NO: 17546 - DNA, 20 bp, human
gcggttggaggttgtaggac

SEQ ID NO: 17547 - DNA, 20 bp, human
gccagccccggaggctccgt

SEQ ID NO: 17548 - DNA, 20 bp, human
gtgtaggaccggcgaggaat

SEQ ID NO: 17549 - DNA, 20 bp, human
gggccggtcttggtcagggg

SEQ ID NO: 17550 - DNA, 20 bp, human
gccaggccggtcttggtcag

SEQ ID NO: 17551 - DNA, 20 bp, human
gggaggttgtaggaccggcg

SEQ ID NO: 17552 - DNA, 20 bp, human
gccgcggccgctataaaaag

SEQ ID NO: 17553 - DNA, 20 bp, human
ggcttcacgcccacacacag

SEQ ID NO: 17554 - DNA, 20 bp, human
gcgtgaagctccctgcttgg

SEQ ID NO: 17555 - DNA, 20 bp, human
gctggcgcgggaagcccccg

SEQ ID NO: 17556 - DNA, 20 bp, human
gtccggcagggttcagagtg

SEQ ID NO: 17557 - DNA, 20 bp, human
gcgggcggtgctcacactct

SEQ ID NO: 17558 - DNA, 20 bp, human
ggggcctgactgctcaggag

SEQ ID NO: 17559 - DNA, 20 bp, human
gcactagatcgcgggatcct

SEQ ID NO: 17560 - DNA, 20 bp, human
gcgctgtccacactagatcg

SEQ ID NO: 17561 - DNA, 20 bp, human
gatcctgccacgccaaggcg

SEQ ID NO: 17562 - DNA, 20 bp, human
gggagcagcgcggtcgaccg

SEQ ID NO: 17563 - DNA, 20 bp, human
gacgagcgcagggtcagtcg

SEQ ID NO: 17564 - DNA, 20 bp, human
ggacagcgaggttcgacgtc

SEQ ID NO: 17565 - DNA, 20 bp, human
gatcgcgggatcctgggccc

SEQ ID NO: 17566 - DNA, 20 bp, human
ggcagcgtcatggtgatcgg

SEQ ID NO: 17567 - DNA, 20 bp, human
gtgggcccaccagttcaaca

SEQ ID NO: 17568 - DNA, 20 bp, human
gcaggccagccgggcccaga

SEQ ID NO: 17569 - DNA, 20 bp, human
gagaaggtgccgtagacctg

SEQ ID NO: 17570 - DNA, 20 bp, human
gctgcaactcaaggcttcaa

SEQ ID NO: 17571 - DNA, 20 bp, human
gcccactaccacctaccttg

SEQ ID NO: 17572 - DNA, 20 bp, human
gacggcaccttctatgccat

SEQ ID NO: 17573 - DNA, 20 bp, human
gacgctgcccatggcataga

SEQ ID NO: 17574 - DNA, 20 bp, human
ggtagacctggggccgatca

SEQ ID NO: 17575 - DNA, 20 bp, human
gaccccaaggtaggtggtag

SEQ ID NO: 17576 - DNA, 20 bp, human
gccagggctcaagaatcccc

SEQ ID NO: 17577 - DNA, 20 bp, human
ggccctggctgacaaagacc

SEQ ID NO: 17578 - DNA, 20 bp, human
gaatcccctggagaggccca

SEQ ID NO: 17579 - DNA, 20 bp, human
gtcctggtctttgtcagcca

SEQ ID NO: 17580 - DNA, 20 bp, human
ggaagcctgtgactgcccat

SEQ ID NO: 17581 - DNA, 20 bp, human
gggagcccatgggcagtcac

SEQ ID NO: 17582 - DNA, 20 bp, human
gagcagagtgagagcaagga

SEQ ID NO: 17583 - DNA, 20 bp, human
gcaggaagatctgagatacc

SEQ ID NO: 17584 - DNA, 20 bp, human
gtaagctatctaccttgcat

SEQ ID NO: 17585 - DNA, 20 bp, human
gaaggtagatagcttaactt

SEQ ID NO: 17586 - DNA, 20 bp, human
ggactaggcggttaagggtg

SEQ ID NO: 17587 - DNA, 20 bp, human
gtgtgggcgccggaaggcga

SEQ ID NO: 17588 - DNA, 20 bp, human
gtgcgacaggtggagcgcac

SEQ ID NO: 17589 - DNA, 20 bp, human
ggcccgccgccacctgcgac

SEQ ID NO: 17590 - DNA, 20 bp, human
gtgtaggactaggcggttaa

SEQ ID NO: 17591 - DNA, 20 bp, human
gtggctttggctgtaggact

SEQ ID NO: 17592 - DNA, 20 bp, human
gcgcacggccatgtccgccg

SEQ ID NO: 17593 - DNA, 20 bp, human
gcaaagccaccgaggagcct

SEQ ID NO: 17594 - DNA, 20 bp, human
gcagagttacgtgactcaca

SEQ ID NO: 17595 - DNA, 20 bp, human
gcgccgccacctgcgacagg

SEQ ID NO: 17596 - DNA, 20 bp, human
gagtggaggaagcacgggac

SEQ ID NO: 17597 - DNA, 20 bp, human
gggaggaagcacgggactgg

SEQ ID NO: 17598 - DNA, 20 bp, human
gcacccctgggccgccatcg

SEQ ID NO: 17599 - DNA, 20 bp, human
gtgagtcccgagcagcggtg

SEQ ID NO: 17600 - DNA, 20 bp, human
gcaatgagagaggccttgag

SEQ ID NO: 17601 - DNA, 20 bp, human
ggaccaaagttccccgatgg

SEQ ID NO: 17602 - DNA, 20 bp, human
gttccccgatggcggcccag

SEQ ID NO: 17603 - DNA, 20 bp, human
ggccttggtagaaggagaga

SEQ ID NO: 17604 - DNA, 20 bp, human
gcgatggtcctgaacgatgg

SEQ ID NO: 17605 - DNA, 20 bp, human
gggccgccatcggggaactt

SEQ ID NO: 17606 - DNA, 20 bp, human
gtccaggccagactctaaag

SEQ ID NO: 17607 - DNA, 20 bp, human
gagactctaaaggggagatc

SEQ ID NO: 17608 - DNA, 20 bp, human
gcagaaatctgacccagggt

SEQ ID NO: 17609 - DNA, 20 bp, human
gcactgcccgaaggccgtcc

SEQ ID NO: 17610 - DNA, 20 bp, human
gtgatggtgaagataatcaa

SEQ ID NO: 17611 - DNA, 20 bp, human
gggcccacaaaccctggtag

SEQ ID NO: 17612 - DNA, 20 bp, human
gctccagggagatgcagggg

SEQ ID NO: 17613 - DNA, 20 bp, human
gtggatggcctagtactagg

SEQ ID NO: 17614 - DNA, 20 bp, human
ggcttatccccgtcttccat

SEQ ID NO: 17615 - DNA, 20 bp, human
ggggcccctaacccagtcca

SEQ ID NO: 17616 - DNA, 20 bp, human
gagccggcaaccaccctccg

SEQ ID NO: 17617 - DNA, 20 bp, human
gaacaggaacctcaaggtat

SEQ ID NO: 17618 - DNA, 20 bp, human
ggtaagtaacaggaacctca

SEQ ID NO: 17619 - DNA, 20 bp, human
gccgaggtggtgaggaaata

SEQ ID NO: 17620 - DNA, 20 bp, human
gggtagccatagtctagcag

SEQ ID NO: 17621 - DNA, 20 bp, human
gcggagattcgagcctcgga

SEQ ID NO: 17622 - DNA, 20 bp, human
gagattcgagcctcggaggg

SEQ ID NO: 17623 - DNA, 20 bp, human
gaccacctcgggtaagtaac

SEQ ID NO: 17624 - DNA, 20 bp, human
gggcaagaagacaagctcct

SEQ ID NO: 17625 - DNA, 20 bp, human
gtcccgggcctgggctaccc

SEQ ID NO: 17626 - DNA, 20 bp, human
gtccaagacggtagcggagg

SEQ ID NO: 17627 - DNA, 20 bp, human
ggacccgcacgacttcaaac

SEQ ID NO: 17628 - DNA, 20 bp, human
gcaggggtccaagacggtag

SEQ ID NO: 17629 - DNA, 20 bp, human
gcgcggcggccggtaagcag

SEQ ID NO: 17630 - DNA, 20 bp, human
ggagcggagctgagggtacc

SEQ ID NO: 17631 - DNA, 20 bp, human
ggggtccaagacggtagcgg

SEQ ID NO: 17632 - DNA, 20 bp, human
gcagcaaagagcggagctga

SEQ ID NO: 17633 - DNA, 20 bp, human
gcccaggccgcggagcacag

SEQ ID NO: 17634 - DNA, 20 bp, human
gcgcccgcgtcagcaaagag

SEQ ID NO: 17635 - DNA, 20 bp, human
gtcggagttcgccccgtggt

SEQ ID NO: 17636 - DNA, 20 bp, human
gaggcagcgccggcctccgg

SEQ ID NO: 17637 - DNA, 20 bp, human
gtcgcccaggccgcctccgg

SEQ ID NO: 17638 - DNA, 20 bp, human
ggctgcggcaggcccgagtg

SEQ ID NO: 17639 - DNA, 20 bp, human
ggccgccagcacgaagcggt

SEQ ID NO: 17640 - DNA, 20 bp, human
gccagagaggacggtgaggg

SEQ ID NO: 17641 - DNA, 20 bp, human
gtacaactggcaggcgacca

SEQ ID NO: 17642 - DNA, 20 bp, human
gcctttcccggaaggcaggg

SEQ ID NO: 17643 - DNA, 20 bp, human
gtcgatctcggccgacgtgg

SEQ ID NO: 17644 - DNA, 20 bp, human
ggccccagagaggacggtga

SEQ ID NO: 17645 - DNA, 20 bp, human
gacgtccggcagctcgatct

SEQ ID NO: 17646 - DNA, 20 bp, human
gctgccctggaaagggatga

SEQ ID NO: 17647 - DNA, 20 bp, human
gctacgcgcagccgcctcag

SEQ ID NO: 17648 - DNA, 20 bp, human
gcggccacgagcacccaatt

SEQ ID NO: 17649 - DNA, 20 bp, human
ggaccctgctcgggtaccgt

SEQ ID NO: 17650 - DNA, 20 bp, human
gagccagatccctccggagg

SEQ ID NO: 17651 - DNA, 20 bp, human
gcctccacagccacctccgg

SEQ ID NO: 17652 - DNA, 20 bp, human
gagccacctccggagggatc

SEQ ID NO: 17653 - DNA, 20 bp, human
gggcctgcaacctgccgggg

SEQ ID NO: 17654 - DNA, 20 bp, human
ggccggcctgcaacctgccg

SEQ ID NO: 17655 - DNA, 20 bp, human
gggaaggcgcatcacaatag

SEQ ID NO: 17656 - DNA, 20 bp, human
gcagacactgactcagccgt

SEQ ID NO: 17657 - DNA, 20 bp, human
gaagccaggtcagcatcctt

SEQ ID NO: 17658 - DNA, 20 bp, human
gggaagtctatggacaggtg

SEQ ID NO: 17659 - DNA, 20 bp, human
gtctatggacaggtgaggta

SEQ ID NO: 17660 - DNA, 20 bp, human
gctaccttggcatatactaa

SEQ ID NO: 17661 - DNA, 20 bp, human
gattattacacagtagaggg

SEQ ID NO: 17662 - DNA, 20 bp, human
gagcatccttgggcattact

SEQ ID NO: 17663 - DNA, 20 bp, human
gctgaattaatatgtagagg

SEQ ID NO: 17664 - DNA, 20 bp, human
gaatgatcataatgaaacaa

SEQ ID NO: 17665 - DNA, 20 bp, human
gaaactgaattaatatgtag

SEQ ID NO: 17666 - DNA, 20 bp, human
ggcgccagcctgccctgcac

SEQ ID NO: 17667 - DNA, 20 bp, human
ggctggcgccgagcgaacca

SEQ ID NO: 17668 - DNA, 20 bp, human
gctgcaccggagcgcagcag

SEQ ID NO: 17669 - DNA, 20 bp, human
gcagcggcggcagttccggg

SEQ ID NO: 17670 - DNA, 20 bp, human
gcacggccgctgctgcgctc

SEQ ID NO: 17671 - DNA, 20 bp, human
gcgcctgggagccaaaggga

SEQ ID NO: 17672 - DNA, 20 bp, human
gaggcggctgcagcatgaag

SEQ ID NO: 17673 - DNA, 20 bp, human
ggcgcagcgatggccaggag

SEQ ID NO: 17674 - DNA, 20 bp, human
gtactaacagttggtagcag

SEQ ID NO: 17675 - DNA, 20 bp, human
gcgaaccagggccgggaact

SEQ ID NO: 17676 - DNA, 20 bp, human
gcccggatccactccatcag

SEQ ID NO: 17677 - DNA, 20 bp, human
gggatccactccatcagcgg

SEQ ID NO: 17678 - DNA, 20 bp, human
ggcggcggcagcacgaggaa

SEQ ID NO: 17679 - DNA, 20 bp, human
ggtccatggagaagctgcgg

SEQ ID NO: 17680 - DNA, 20 bp, human
gcatcagcggcggcagcacg

SEQ ID NO: 17681 - DNA, 20 bp, human
gacgaggaagggcctgcggt

SEQ ID NO: 17682 - DNA, 20 bp, human
gagcggggctctgattggag

SEQ ID NO: 17683 - DNA, 20 bp, human
gcggtggccggcgtgcgcca

SEQ ID NO: 17684 - DNA, 20 bp, human
gcatggagaagctgcggcgg

SEQ ID NO: 17685 - DNA, 20 bp, human
ggagccgcgccagctcaggt

SEQ ID NO: 17686 - DNA, 20 bp, human
ggaagcgctcatcacatctg

SEQ ID NO: 17687 - DNA, 20 bp, human
gggccaaggtgctttgacag

SEQ ID NO: 17688 - DNA, 20 bp, human
gtccctgccaagtagaccag

SEQ ID NO: 17689 - DNA, 20 bp, human
gggcccataagaagaaaagg

SEQ ID NO: 17690 - DNA, 20 bp, human
gggagctgagagaccattgt

SEQ ID NO: 17691 - DNA, 20 bp, human
ggctctcaaaacacacgaag

SEQ ID NO: 17692 - DNA, 20 bp, human
gcctgtgccaaggtccctgt

SEQ ID NO: 17693 - DNA, 20 bp, human
gtgggtggttgtgagcacca

SEQ ID NO: 17694 - DNA, 20 bp, human
ggttgtgagcaccacggcaa

SEQ ID NO: 17695 - DNA, 20 bp, human
gctgtaaacacgcctgtggt

SEQ ID NO: 17696 - DNA, 20 bp, human
gagggaggccgagggacaaa

SEQ ID NO: 17697 - DNA, 20 bp, human
ggcttggagtagcctctcct

SEQ ID NO: 17698 - DNA, 20 bp, human
ggatgtgagcagagtggtct

SEQ ID NO: 17699 - DNA, 20 bp, human
gttgtgccggatcctatata

SEQ ID NO: 17700 - DNA, 20 bp, human
gcggatcctatataaggaag

SEQ ID NO: 17701 - DNA, 20 bp, human
gaggatccggcacaagggga

SEQ ID NO: 17702 - DNA, 20 bp, human
gtcctgggcagaggctgaat

SEQ ID NO: 17703 - DNA, 20 bp, human
gcgtccctccagtggacttg

SEQ ID NO: 17704 - DNA, 20 bp, human
gtcaaagtgacagctgggga

SEQ ID NO: 17705 - DNA, 20 bp, human
gtgaaggacctgaatgctga

SEQ ID NO: 17706 - DNA, 20 bp, human
gtgtagcagttgagtctcag

SEQ ID NO: 17707 - DNA, 20 bp, human
gtggctgtataatctcacac

SEQ ID NO: 17708 - DNA, 20 bp, human
gtatcatagtggttacatgt

SEQ ID NO: 17709 - DNA, 20 bp, human
gtatccttggcacaatttct

SEQ ID NO: 17710 - DNA, 20 bp, human
gcagcccagaaattgtgcca

SEQ ID NO: 17711 - DNA, 20 bp, human
ggagataatagtatgagttg

SEQ ID NO: 17712 - DNA, 20 bp, human
gagattatacctgtggagct

SEQ ID NO: 17713 - DNA, 20 bp, human
gtcagagataagcctaggtt

SEQ ID NO: 17714 - DNA, 20 bp, human
gtaagcctaggtttgggtct

SEQ ID NO: 17715 - DNA, 20 bp, human
gagttgagtctcagtggtaa

SEQ ID NO: 17716 - DNA, 20 bp, human
gagctaacctgaggaaccgg

SEQ ID NO: 17717 - DNA, 20 bp, human
ggttcagagccagagggtaa

SEQ ID NO: 17718 - DNA, 20 bp, human
gctgcagaaaagctaacctg

SEQ ID NO: 17719 - DNA, 20 bp, human
gaatagtttacagtggtcat

SEQ ID NO: 17720 - DNA, 20 bp, human
gtatccttggcacaatttct

SEQ ID NO: 17721 - DNA, 20 bp, human
gcagaaggtaagagagtggt

SEQ ID NO: 17722 - DNA, 20 bp, human
ggagataatagtatgagttg

SEQ ID NO: 17723 - DNA, 20 bp, human
gcagcccagaaattgtgcca

SEQ ID NO: 17724 - DNA, 20 bp, human
ggaaccgggggttcctgtat

SEQ ID NO: 17725 - DNA, 20 bp, human
gcagtcccaaaatcctatac

SEQ ID NO: 17726 - DNA, 20 bp, human
gagcttcttcccaggaccat

SEQ ID NO: 17727 - DNA, 20 bp, human
ggagaggcccaagctcctga

SEQ ID NO: 17728 - DNA, 20 bp, human
gtggagtggcctatggtcct

SEQ ID NO: 17729 - DNA, 20 bp, human
ggaagctggctggctggcgg

SEQ ID NO: 17730 - DNA, 20 bp, human
gcatgcacgaccagtcccaa

SEQ ID NO: 17731 - DNA, 20 bp, human
ggggccccaggactctaagg

SEQ ID NO: 17732 - DNA, 20 bp, human
gcaacccgcgatacaggtga

SEQ ID NO: 17733 - DNA, 20 bp, human
ggggcctccttagagtcctg

SEQ ID NO: 17734 - DNA, 20 bp, human
ggggctccatgagtgagaag

SEQ ID NO: 17735 - DNA, 20 bp, human
gggagaagcagggacttggg

SEQ ID NO: 17736 - DNA, 20 bp, human
gccacgccgcagccacaaaa

SEQ ID NO: 17737 - DNA, 20 bp, human
ggcgacgtgcacttcctggt

SEQ ID NO: 17738 - DNA, 20 bp, human
gccacaaaatggcggcgggt

SEQ ID NO: 17739 - DNA, 20 bp, human
gcgcatccccgcgcacaggt

SEQ ID NO: 17740 - DNA, 20 bp, human
ggtggagtctagggatggaa

SEQ ID NO: 17741 - DNA, 20 bp, human
gcagcaggctgggtgggtcg

SEQ ID NO: 17742 - DNA, 20 bp, human
gacctcgttgttgaagagga

SEQ ID NO: 17743 - DNA, 20 bp, human
ggggaactgggtggagtcta

SEQ ID NO: 17744 - DNA, 20 bp, human
gtgcagggctcggggatgga

SEQ ID NO: 17745 - DNA, 20 bp, human
gcgaagcgctcctgcacggt

SEQ ID NO: 17746 - DNA, 20 bp, human
gtcggcgggcacccgcacgc

SEQ ID NO: 17747 - DNA, 20 bp, human
gctcggacccacgggaccag

SEQ ID NO: 17748 - DNA, 20 bp, human
gggccgagcgaagcgaggag

SEQ ID NO: 17749 - DNA, 20 bp, human
ggcagagcgtgccctgcgtg

SEQ ID NO: 17750 - DNA, 20 bp, human
gtctccgagtgccccggccg

SEQ ID NO: 17751 - DNA, 20 bp, human
gcgcctcagccgaaagaccg

SEQ ID NO: 17752 - DNA, 20 bp, human
gggcctgaggagcgggcaca

SEQ ID NO: 17753 - DNA, 20 bp, human
gcgctcctcaggccccggcc

SEQ ID NO: 17754 - DNA, 20 bp, human
ggagcgctggcggtgagtga

SEQ ID NO: 17755 - DNA, 20 bp, human
gcacagggcaaggcggcgga

SEQ ID NO: 17756 - DNA, 20 bp, human
ggccccgcccgcgaagatgg

SEQ ID NO: 17757 - DNA, 20 bp, human
gggtgcgtcacgctgcgtca

SEQ ID NO: 17758 - DNA, 20 bp, human
gccgcggcgggtacgggctc

SEQ ID NO: 17759 - DNA, 20 bp, human
gcctctcgcgcagcgtgggg

SEQ ID NO: 17760 - DNA, 20 bp, human
gggttgttgccgagtgtggg

SEQ ID NO: 17761 - DNA, 20 bp, human
ggctaggctgggctcgggca

SEQ ID NO: 17762 - DNA, 20 bp, human
gaccggcgccgcggcgggta

SEQ ID NO: 17763 - DNA, 20 bp, human
gcggccgtgcaggcaggcta

SEQ ID NO: 17764 - DNA, 20 bp, human
gccgccagccggggctctcc

SEQ ID NO: 17765 - DNA, 20 bp, human
gtgacgcaccggcgccgcgg

SEQ ID NO: 17766 - DNA, 20 bp, human
gagcccctcctgctccgtct

SEQ ID NO: 17767 - DNA, 20 bp, human
gctcctagacggagcaggag

SEQ ID NO: 17768 - DNA, 20 bp, human
ggcgacggcagcggtcccag

SEQ ID NO: 17769 - DNA, 20 bp, human
gcctcggagcgcacagagac

SEQ ID NO: 17770 - DNA, 20 bp, human
gcaagggacactcaccccgg

SEQ ID NO: 17771 - DNA, 20 bp, human
ggagtcaaaatggcggcgag

SEQ ID NO: 17772 - DNA, 20 bp, human
gaatggcggcgaggggaacc

SEQ ID NO: 17773 - DNA, 20 bp, human
ggagcaggaggggctcggtt

SEQ ID NO: 17774 - DNA, 20 bp, human
gggggccagtcgtccgtctg

SEQ ID NO: 17775 - DNA, 20 bp, human
gctctgtgcgctccgagggg

SEQ ID NO: 17776 - DNA, 20 bp, human
gagcgagccatgtctcacag

SEQ ID NO: 17777 - DNA, 20 bp, human
ggagaagccggaccgcggtg

SEQ ID NO: 17778 - DNA, 20 bp, human
ggatttgctcaggtaggagg

SEQ ID NO: 17779 - DNA, 20 bp, human
ggctcggttctgggattctg

SEQ ID NO: 17780 - DNA, 20 bp, human
ggcctgcgcacgctcttcct

SEQ ID NO: 17781 - DNA, 20 bp, human
gccgagccggctcttgaccc

SEQ ID NO: 17782 - DNA, 20 bp, human
ggaccccagaagtaccatgg

SEQ ID NO: 17783 - DNA, 20 bp, human
gtcccagagaagccggaccg

SEQ ID NO: 17784 - DNA, 20 bp, human
ggagaaccaagtgctgaggg

SEQ ID NO: 17785 - DNA, 20 bp, human
gcacctccgccccgaagctg

SEQ ID NO: 17786 - DNA, 20 bp, human
gtggggcctggccgcacctg

SEQ ID NO: 17787 - DNA, 20 bp, human
gcgagactgctagggaacct

SEQ ID NO: 17788 - DNA, 20 bp, human
gagagaggagttcgaatcag

SEQ ID NO: 17789 - DNA, 20 bp, human
gcagtccacgaaggtgtagt

SEQ ID NO: 17790 - DNA, 20 bp, human
gacgcgcgccgcagcagccg

SEQ ID NO: 17791 - DNA, 20 bp, human
gtctcagaggagcatcgctg

SEQ ID NO: 17792 - DNA, 20 bp, human
gtcgtggactgcgaacggga

SEQ ID NO: 17793 - DNA, 20 bp, human
gcccggaaaaagcggcggag

SEQ ID NO: 17794 - DNA, 20 bp, human
gacaggatacgagactgcta

SEQ ID NO: 17795 - DNA, 20 bp, human
gccgcccccggaaaaagcgg

SEQ ID NO: 17796 - DNA, 20 bp, human
ggcctggaaactaatcccgg

SEQ ID NO: 17797 - DNA, 20 bp, human
gggctggcaccctggctaca

SEQ ID NO: 17798 - DNA, 20 bp, human
ggacgcgtgagaaggcccga

SEQ ID NO: 17799 - DNA, 20 bp, human
ggcaccctggctacaaggca

SEQ ID NO: 17800 - DNA, 20 bp, human
gtctggcaattgggcacctg

SEQ ID NO: 17801 - DNA, 20 bp, human
gggtgcctggaaactaatcc

SEQ ID NO: 17802 - DNA, 20 bp, human
ggagcgcgaggttaaagatc

SEQ ID NO: 17803 - DNA, 20 bp, human
gctcctcccggcgacattca

SEQ ID NO: 17804 - DNA, 20 bp, human
gggaaacgaaactacttccc

SEQ ID NO: 17805 - DNA, 20 bp, human
ggcgggttggagaactttga

SEQ ID NO: 17806 - DNA, 20 bp, human
gcgcccagttggacttgggg

SEQ ID NO: 17807 - DNA, 20 bp, human
gaaacaggattcaggatctc

SEQ ID NO: 17808 - DNA, 20 bp, human
gctggccgactcggagacaa

SEQ ID NO: 17809 - DNA, 20 bp, human
gggtaagaagccgaactctg

SEQ ID NO: 17810 - DNA, 20 bp, human
gagagggtctaatgactcca

SEQ ID NO: 17811 - DNA, 20 bp, human
gcaatggctgaatagtgggt

SEQ ID NO: 17812 - DNA, 20 bp, human
gactcggagacaatggcgag

SEQ ID NO: 17813 - DNA, 20 bp, human
gacgctccagctggccgact

SEQ ID NO: 17814 - DNA, 20 bp, human
gtgacccaatggctgaatag

SEQ ID NO: 17815 - DNA, 20 bp, human
gggcgcgctaagagcaggta

SEQ ID NO: 17816 - DNA, 20 bp, human
gcggacaggcgcacccgctc

SEQ ID NO: 17817 - DNA, 20 bp, human
ggattaggcgcacacacgcg

SEQ ID NO: 17818 - DNA, 20 bp, human
gacgcaagatggcagctaaa

SEQ ID NO: 17819 - DNA, 20 bp, human
gcgtgtgtgcgcctaatctc

SEQ ID NO: 17820 - DNA, 20 bp, human
gcgctcaggctgactctcgg

SEQ ID NO: 17821 - DNA, 20 bp, human
gcttggcaggcccggatgaa

SEQ ID NO: 17822 - DNA, 20 bp, human
ggtgctcaaggggtctcggg

SEQ ID NO: 17823 - DNA, 20 bp, human
ggcaagcctcgcggtacctg

SEQ ID NO: 17824 - DNA, 20 bp, human
ggcaggccctggctaggccg

SEQ ID NO: 17825 - DNA, 20 bp, human
gcgcggcggaacccgaggac

SEQ ID NO: 17826 - DNA, 20 bp, human
gagacagagaaagacgacgg

SEQ ID NO: 17827 - DNA, 20 bp, human
gctgcttcaggtgagacccc

SEQ ID NO: 17828 - DNA, 20 bp, human
gttcggttccctggactcaa

SEQ ID NO: 17829 - DNA, 20 bp, human
ggcaaggagtaatggaacag

SEQ ID NO: 17830 - DNA, 20 bp, human
gtgctcccagtctacagata

SEQ ID NO: 17831 - DNA, 20 bp, human
ggctgggggtcggcacctgt

SEQ ID NO: 17832 - DNA, 20 bp, human
gcagagaaagacgacggcgg

SEQ ID NO: 17833 - DNA, 20 bp, human
gcccgctcgccgcaccacgg

SEQ ID NO: 17834 - DNA, 20 bp, human
ggtgctggggaccttcccac

SEQ ID NO: 17835 - DNA, 20 bp, human
gcagggtctgggcggcaaca

SEQ ID NO: 17836 - DNA, 20 bp, human
gaatgctgcggagctggagg

SEQ ID NO: 17837 - DNA, 20 bp, human
gtcgaatgctgcggagctgg

SEQ ID NO: 17838 - DNA, 20 bp, human
gacgcgggccccacatccct

SEQ ID NO: 17839 - DNA, 20 bp, human
gtggcaggtgagcagggcga

SEQ ID NO: 17840 - DNA, 20 bp, human
ggctcgtgagccccttggtg

SEQ ID NO: 17841 - DNA, 20 bp, human
gcaccgggcggaaggctgag

SEQ ID NO: 17842 - DNA, 20 bp, human
gttggagatgaaggacacgg

SEQ ID NO: 17843 - DNA, 20 bp, human
gctgcatttccagctccgag

SEQ ID NO: 17844 - DNA, 20 bp, human
gcccttggtgcggagaaact

SEQ ID NO: 17845 - DNA, 20 bp, human
ggcagggcgagggcgtcgga

SEQ ID NO: 17846 - DNA, 20 bp, human
gtcagtgagaggtctcgggt

SEQ ID NO: 17847 - DNA, 20 bp, human
gcgctgcccggggaaagtcc

SEQ ID NO: 17848 - DNA, 20 bp, human
gcggccgagacccgagcaca

SEQ ID NO: 17849 - DNA, 20 bp, human
gctgcggcagggtgacccac

SEQ ID NO: 17850 - DNA, 20 bp, human
ggggctgcgtgagcgagcag

SEQ ID NO: 17851 - DNA, 20 bp, human
gcgcctccgagagcgtagag

SEQ ID NO: 17852 - DNA, 20 bp, human
ggactgagagctctgaaagg

SEQ ID NO: 17853 - DNA, 20 bp, human
gggccgtggcggttctgatg

SEQ ID NO: 17854 - DNA, 20 bp, human
gctctgcccggactttcccc

SEQ ID NO: 17855 - DNA, 20 bp, human
gcgcccctctacgctctcgg

SEQ ID NO: 17856 - DNA, 20 bp, human
gtaacgcgctgtgggaaacg

SEQ ID NO: 17857 - DNA, 20 bp, human
ggagcgcagcgagcctcgtc

SEQ ID NO: 17858 - DNA, 20 bp, human
gaagcgcgcgttgagaggac

SEQ ID NO: 17859 - DNA, 20 bp, human
gcggctcccgcgtcgtcggg

SEQ ID NO: 17860 - DNA, 20 bp, human
ggagcctcgtccggcgcgtg

SEQ ID NO: 17861 - DNA, 20 bp, human
ggcttggccgcccgacgacg

SEQ ID NO: 17862 - DNA, 20 bp, human
gggaaaaagacgccgcctca

SEQ ID NO: 17863 - DNA, 20 bp, human
gcagcggcggtgaggagacc

SEQ ID NO: 17864 - DNA, 20 bp, human
gcggccaagcgcgcgttgag

SEQ ID NO: 17865 - DNA, 20 bp, human
ggagccgcacgcgccggacg

SEQ ID NO: 17866 - DNA, 20 bp, human
ggtccctgaagggcctccaa

SEQ ID NO: 17867 - DNA, 20 bp, human
ggctgtgggcggtccctgaa

SEQ ID NO: 17868 - DNA, 20 bp, human
gggctgagagaaagcgctgt

SEQ ID NO: 17869 - DNA, 20 bp, human
gatctgggcctccatcttct

SEQ ID NO: 17870 - DNA, 20 bp, human
gaagggagacgcctagaaga

SEQ ID NO: 17871 - DNA, 20 bp, human
gctcccttggaggcccttca

SEQ ID NO: 17872 - DNA, 20 bp, human
gttctaggcgtctcccttgg

SEQ ID NO: 17873 - DNA, 20 bp, human
gagaaacgtctcaagaatct

SEQ ID NO: 17874 - DNA, 20 bp, human
ggtagcctctgacatatggg

SEQ ID NO: 17875 - DNA, 20 bp, human
gcgtggtcctcttgagatca

SEQ ID NO: 17876 - DNA, 20 bp, human
gactcgatcgcagcagacac

SEQ ID NO: 17877 - DNA, 20 bp, human
gatgccaggacttggaaggt

SEQ ID NO: 17878 - DNA, 20 bp, human
gagtggaggaggctgacgga

SEQ ID NO: 17879 - DNA, 20 bp, human
gtgagtggctgtgaaagggt

SEQ ID NO: 17880 - DNA, 20 bp, human
gtccgacaagggctgagggt

SEQ ID NO: 17881 - DNA, 20 bp, human
gggtagcaaatgttagaaag

SEQ ID NO: 17882 - DNA, 20 bp, human
gtcagactgtccttcctctc

SEQ ID NO: 17883 - DNA, 20 bp, human
ggaggaggctgacggagggt

SEQ ID NO: 17884 - DNA, 20 bp, human
gtgttagaaaggggtacctc

SEQ ID NO: 17885 - DNA, 20 bp, human
gatgaggtgaccatccgaac

SEQ ID NO: 17886 - DNA, 20 bp, human
ggtcagtttacctaccccag

SEQ ID NO: 17887 - DNA, 20 bp, human
gtgatgcgatgcctatgatt

SEQ ID NO: 17888 - DNA, 20 bp, human
gtattcacctgcctaatcat

SEQ ID NO: 17889 - DNA, 20 bp, human
ggaaaaactgctcaagtaga

SEQ ID NO: 17890 - DNA, 20 bp, human
gaggcatcgcatcaatagct

SEQ ID NO: 17891 - DNA, 20 bp, human
ggaggagagtaggaagagcc

SEQ ID NO: 17892 - DNA, 20 bp, human
ggttccagatgtccagatat

SEQ ID NO: 17893 - DNA, 20 bp, human
gtggacatctggaacatcca

SEQ ID NO: 17894 - DNA, 20 bp, human
gttaaaaacatgttgatggt

SEQ ID NO: 17895 - DNA, 20 bp, human
gtcccttgctgaacttagta

SEQ ID NO: 17896 - DNA, 20 bp, human
gcgttcggagacaggcgaca

SEQ ID NO: 17897 - DNA, 20 bp, human
gctaggctgaagctcctgag

SEQ ID NO: 17898 - DNA, 20 bp, human
ggatccagtggaggtctcca

SEQ ID NO: 17899 - DNA, 20 bp, human
gcacccacaacggccaggat

SEQ ID NO: 17900 - DNA, 20 bp, human
gcttgctgctccagaagggt

SEQ ID NO: 17901 - DNA, 20 bp, human
gtcggcgtcctcacccacaa

SEQ ID NO: 17902 - DNA, 20 bp, human
gatggacaggagacaactac

SEQ ID NO: 17903 - DNA, 20 bp, human
ggcctaggagatgaatggac

SEQ ID NO: 17904 - DNA, 20 bp, human
gacggccaggatgggctccg

SEQ ID NO: 17905 - DNA, 20 bp, human
gagcccatcctggccgttgt

SEQ ID NO: 17906 - DNA, 20 bp, human
ggctccggggtgggcacagt

SEQ ID NO: 17907 - DNA, 20 bp, human
gacacaaaccttcccaaaag

SEQ ID NO: 17908 - DNA, 20 bp, human
gtctccaaacatggcgacct

SEQ ID NO: 17909 - DNA, 20 bp, human
gtctcctaggtcgccatgtt

SEQ ID NO: 17910 - DNA, 20 bp, human
gttctctccaatctgcccag

SEQ ID NO: 17911 - DNA, 20 bp, human
gctgctgtggacacgagacg

SEQ ID NO: 17912 - DNA, 20 bp, human
gctcaggtatgtcccgagag

SEQ ID NO: 17913 - DNA, 20 bp, human
gagatgcaggaaacgaaatc

SEQ ID NO: 17914 - DNA, 20 bp, human
gaaggtaggaaacggagggg

SEQ ID NO: 17915 - DNA, 20 bp, human
gtagggaactcttgggactg

SEQ ID NO: 17916 - DNA, 20 bp, human
gggactgtggcccgagaagt

SEQ ID NO: 17917 - DNA, 20 bp, human
ggagggtgtgaaagaatcca

SEQ ID NO: 17918 - DNA, 20 bp, human
gccctccccgagacccaggt

SEQ ID NO: 17919 - DNA, 20 bp, human
gagacaggaagcctactggt

SEQ ID NO: 17920 - DNA, 20 bp, human
gtgtcccgacctgggtctcg

SEQ ID NO: 17921 - DNA, 20 bp, human
gacccaggtcgggacactcg

SEQ ID NO: 17922 - DNA, 20 bp, human
gtccgatacaactcacccat

SEQ ID NO: 17923 - DNA, 20 bp, human
gccatcaatgcagagatcaa

SEQ ID NO: 17924 - DNA, 20 bp, human
gaaacatcgcgattaatagg

SEQ ID NO: 17925 - DNA, 20 bp, human
ggggggaagtggagggacga

SEQ ID NO: 17926 - DNA, 20 bp, human
gagactgtcgggtcatcgtg

SEQ ID NO: 17927 - DNA, 20 bp, human
gaaagaaagcagagactgtc

SEQ ID NO: 17928 - DNA, 20 bp, human
gctatggttaaatctccttc

SEQ ID NO: 17929 - DNA, 20 bp, human
gaatgctaagaggtgagtgg

SEQ ID NO: 17930 - DNA, 20 bp, human
gtgtgcgtgcgcaccccctc

SEQ ID NO: 17931 - DNA, 20 bp, human
gtctaagagattctaaaaag

SEQ ID NO: 17932 - DNA, 20 bp, human
gaaggggtgtgtgcctgagg

SEQ ID NO: 17933 - DNA, 20 bp, human
gagcctggttcacaatgcct

SEQ ID NO: 17934 - DNA, 20 bp, human
gttcagaggggaatgctaag

SEQ ID NO: 17935 - DNA, 20 bp, human
gctcccaggcattgtgaacc

SEQ ID NO: 17936 - DNA, 20 bp, human
gttcctttcttccggatgag

SEQ ID NO: 17937 - DNA, 20 bp, human
gagcctgggctacaacgcat

SEQ ID NO: 17938 - DNA, 20 bp, human
gaaagtataaggaactgcag

SEQ ID NO: 17939 - DNA, 20 bp, human
gtatgggcacgtgggaagac

SEQ ID NO: 17940 - DNA, 20 bp, human
gctgggctacaacgcatggg

SEQ ID NO: 17941 - DNA, 20 bp, human
gtaccccttggtattcccat

SEQ ID NO: 17942 - DNA, 20 bp, human
ggaggttgggatttagtgga

SEQ ID NO: 17943 - DNA, 20 bp, human
gctccaatgggaataccaag

SEQ ID NO: 17944 - DNA, 20 bp, human
gcatgcacatatgggcacgt

SEQ ID NO: 17945 - DNA, 20 bp, human
gcactcgcacatgcacatat

SEQ ID NO: 17946 - DNA, 20 bp, human
gagtctctcattccgaagaa

SEQ ID NO: 17947 - DNA, 20 bp, human
gcagggagagtacttgccca

SEQ ID NO: 17948 - DNA, 20 bp, human
gagcctgggctacaatgcct

SEQ ID NO: 17949 - DNA, 20 bp, human
gacctgcagatattgggatt

SEQ ID NO: 17950 - DNA, 20 bp, human
gagagtacttgcccagggaa

SEQ ID NO: 17951 - DNA, 20 bp, human
gtagaatagatggcttgtgt

SEQ ID NO: 17952 - DNA, 20 bp, human
gtgcagatattgggatttgg

SEQ ID NO: 17953 - DNA, 20 bp, human
ggatattgggatttggtgga

SEQ ID NO: 17954 - DNA, 20 bp, human
gtgttcttaagaacttattg

SEQ ID NO: 17955 - DNA, 20 bp, human
gataaagacctgcagatatt

SEQ ID NO: 17956 - DNA, 20 bp, human
gtgggaggcagtgtaacagg

SEQ ID NO: 17957 - DNA, 20 bp, human
gtgaaggcagagccaaatcc

SEQ ID NO: 17958 - DNA, 20 bp, human
gggatataaatgtaagtggg

SEQ ID NO: 17959 - DNA, 20 bp, human
ggccgtctcaccccagttga

SEQ ID NO: 17960 - DNA, 20 bp, human
gaagtgggaggcagtgtaac

SEQ ID NO: 17961 - DNA, 20 bp, human
ggtgggatataaatgtaagt

SEQ ID NO: 17962 - DNA, 20 bp, human
gtcacagggcctccgggatt

SEQ ID NO: 17963 - DNA, 20 bp, human
ggtggatgaagatacatctg

SEQ ID NO: 17964 - DNA, 20 bp, human
gttggctctgccttcaactg

SEQ ID NO: 17965 - DNA, 20 bp, human
ggattacagagtaggacata

SEQ ID NO: 17966 - DNA, 20 bp, human
gaggtcaggccagctgtctc

SEQ ID NO: 17967 - DNA, 20 bp, human
ggaattgaggaagactcctt

SEQ ID NO: 17968 - DNA, 20 bp, human
gcatgtttagggaggctcta

SEQ ID NO: 17969 - DNA, 20 bp, human
gcacagtagctcagaataat

SEQ ID NO: 17970 - DNA, 20 bp, human
ggaacacattgagaacgcca

SEQ ID NO: 17971 - DNA, 20 bp, human
gggctgtttctcaaggactt

SEQ ID NO: 17972 - DNA, 20 bp, human
gaaacagatgacagcagggg

SEQ ID NO: 17973 - DNA, 20 bp, human
gggccagctgtctcaggcgc

SEQ ID NO: 17974 - DNA, 20 bp, human
gcacattgttctccccaggt

SEQ ID NO: 17975 - DNA, 20 bp, human
gcaacccacaggaatatcca

SEQ ID NO: 17976 - DNA, 20 bp, human
gaggtgcggaagccacggag

SEQ ID NO: 17977 - DNA, 20 bp, human
gtggcctaatgctcaaggtg

SEQ ID NO: 17978 - DNA, 20 bp, human
ggctcaaggtgcggaagcca

SEQ ID NO: 17979 - DNA, 20 bp, human
ggtgtccccgtcaacgatca

SEQ ID NO: 17980 - DNA, 20 bp, human
gttctcccagatgggctgag

SEQ ID NO: 17981 - DNA, 20 bp, human
gccccaaataatggaaacac

SEQ ID NO: 17982 - DNA, 20 bp, human
gagaggctctgcgtgagcgg

SEQ ID NO: 17983 - DNA, 20 bp, human
gtgacaggagaggtgacgga

SEQ ID NO: 17984 - DNA, 20 bp, human
gcggatgacaggagaggtga

SEQ ID NO: 17985 - DNA, 20 bp, human
gtggaaacggatgacaggag

SEQ ID NO: 17986 - DNA, 20 bp, human
gagatggactgccccaagaa

SEQ ID NO: 17987 - DNA, 20 bp, human
gcaagaagggaaccgcaatg

SEQ ID NO: 17988 - DNA, 20 bp, human
gagattccctagacgtggac

SEQ ID NO: 17989 - DNA, 20 bp, human
gagctgccagtccacgtcta

SEQ ID NO: 17990 - DNA, 20 bp, human
gaggtgggccgcatctcagg

SEQ ID NO: 17991 - DNA, 20 bp, human
gtgggaaggcgtacaattag

SEQ ID NO: 17992 - DNA, 20 bp, human
gtccttagagactaagaggg

SEQ ID NO: 17993 - DNA, 20 bp, human
gaaggtgggaggctttggga

SEQ ID NO: 17994 - DNA, 20 bp, human
gagatgcggcccacctaaac

SEQ ID NO: 17995 - DNA, 20 bp, human
gtgctaagattccctagacg

SEQ ID NO: 17996 - DNA, 20 bp, human
gagcaggcggagaagagaca

SEQ ID NO: 17997 - DNA, 20 bp, human
gcctcccgcgggaccttctc

SEQ ID NO: 17998 - DNA, 20 bp, human
ggcgcccggagaaggtcccg

SEQ ID NO: 17999 - DNA, 20 bp, human
gggtcccgcgggaggtttcc

SEQ ID NO: 18000 - DNA, 20 bp, human
ggtgccgggaaacctcccgc

SEQ ID NO: 18001 - DNA, 20 bp, human
ggagcaccgagaggcgagac

SEQ ID NO: 18002 - DNA, 20 bp, human
gtccacgcccgtttcccagg

SEQ ID NO: 18003 - DNA, 20 bp, human
ggtttcccaggcggctgcgg

SEQ ID NO: 18004 - DNA, 20 bp, human
gggcgcctccccccaggacg

SEQ ID NO: 18005 - DNA, 20 bp, human
gctcgcctctcggtgctcag

SEQ ID NO: 18006 - DNA, 20 bp, human
gcggcggagagcggacccag

SEQ ID NO: 18007 - DNA, 20 bp, human
gctgcggcctggcaccaaag

SEQ ID NO: 18008 - DNA, 20 bp, human
ggacagcgggagcttaatcg

SEQ ID NO: 18009 - DNA, 20 bp, human
ggaccgggcagcgggaccct

SEQ ID NO: 18010 - DNA, 20 bp, human
gtaccggtaaggcccgggag

SEQ ID NO: 18011 - DNA, 20 bp, human
ggactgttactgaaaagcgg

SEQ ID NO: 18012 - DNA, 20 bp, human
ggccgggtccataatcgccg

SEQ ID NO: 18013 - DNA, 20 bp, human
ggggagcttaatcgaggagg

SEQ ID NO: 18014 - DNA, 20 bp, human
gggggactgttactgaaaag

SEQ ID NO: 18015 - DNA, 20 bp, human
gcataatcgccgaggccact

SEQ ID NO: 18016 - DNA, 20 bp, human
ggaatgtgtcccacccagca

SEQ ID NO: 18017 - DNA, 20 bp, human
gctgcgcggggtattcgaat

SEQ ID NO: 18018 - DNA, 20 bp, human
gcgcggggtattcgaatcgg

SEQ ID NO: 18019 - DNA, 20 bp, human
ggacaagcgccgggcctcag

SEQ ID NO: 18020 - DNA, 20 bp, human
gtaggttgaactgtcaggag

SEQ ID NO: 18021 - DNA, 20 bp, human
ggcttccccaccccaccaga

SEQ ID NO: 18022 - DNA, 20 bp, human
gtcccacccagcaaggccgt

SEQ ID NO: 18023 - DNA, 20 bp, human
gaaggtgccggagccctccc

SEQ ID NO: 18024 - DNA, 20 bp, human
gtaacaattcgactacagta

SEQ ID NO: 18025 - DNA, 20 bp, human
gcgggcctcagcggaaccca

SEQ ID NO: 18026 - DNA, 20 bp, human
gcaggaatgcaggatggcgg

SEQ ID NO: 18027 - DNA, 20 bp, human
ggggtgctctgaggtaggta

SEQ ID NO: 18028 - DNA, 20 bp, human
gtgaggtggccggtttgtta

SEQ ID NO: 18029 - DNA, 20 bp, human
gacttggcggctaggggtgt

SEQ ID NO: 18030 - DNA, 20 bp, human
gtgaaaacgcagtggactga

SEQ ID NO: 18031 - DNA, 20 bp, human
gggtggaggtgaaaacgcag

SEQ ID NO: 18032 - DNA, 20 bp, human
gccgtcagaacagaccccac

SEQ ID NO: 18033 - DNA, 20 bp, human
ggtcgcttctgtagctccga

SEQ ID NO: 18034 - DNA, 20 bp, human
gttcaaagcgaagaaggctg

SEQ ID NO: 18035 - DNA, 20 bp, human
gcggcctggtaggtaataga

SEQ ID NO: 18036 - DNA, 20 bp, human
gcgcagcgagtggcgagtag

SEQ ID NO: 18037 - DNA, 20 bp, human
gcgcctcgcctccctacctt

SEQ ID NO: 18038 - DNA, 20 bp, human
gtagcctgcgagtgttctga

SEQ ID NO: 18039 - DNA, 20 bp, human
ggagtgttctgagggaagca

SEQ ID NO: 18040 - DNA, 20 bp, human
gacactcgcaggctaggcga

SEQ ID NO: 18041 - DNA, 20 bp, human
gctaggcgaaggaggcggag

SEQ ID NO: 18042 - DNA, 20 bp, human
gctcgcaggctaggcgaagg

SEQ ID NO: 18043 - DNA, 20 bp, human
gctgaggggagcccaaggta

SEQ ID NO: 18044 - DNA, 20 bp, human
gcaagcgcagagtctcctcg

SEQ ID NO: 18045 - DNA, 20 bp, human
gtggaaacgttgcttctgag

SEQ ID NO: 18046 - DNA, 20 bp, human
gactcggccttggaaagcgg

SEQ ID NO: 18047 - DNA, 20 bp, human
ggatactcggccttggaaag

SEQ ID NO: 18048 - DNA, 20 bp, human
gcgggggcagagagacgggt

SEQ ID NO: 18049 - DNA, 20 bp, human
ggcagctccgccgctttcca

SEQ ID NO: 18050 - DNA, 20 bp, human
gggacggaagtctaccaagg

SEQ ID NO: 18051 - DNA, 20 bp, human
gccgagggcggagttgggaa

SEQ ID NO: 18052 - DNA, 20 bp, human
gcaagagggaaggaactgcc

SEQ ID NO: 18053 - DNA, 20 bp, human
gagcggcggagctgccgcca

SEQ ID NO: 18054 - DNA, 20 bp, human
ggggccctgagcatgagcag

SEQ ID NO: 18055 - DNA, 20 bp, human
gtgcctcgagaataatggag

SEQ ID NO: 18056 - DNA, 20 bp, human
ggtagctgcttctcgacaga

SEQ ID NO: 18057 - DNA, 20 bp, human
ggccggagagagctcccgag

SEQ ID NO: 18058 - DNA, 20 bp, human
gccggaagctcctggagctt

SEQ ID NO: 18059 - DNA, 20 bp, human
gccaaggtaatcgagaacag

SEQ ID NO: 18060 - DNA, 20 bp, human
gggagagagctcccgagagg

SEQ ID NO: 18061 - DNA, 20 bp, human
gagaagaaagatgtgccggg

SEQ ID NO: 18062 - DNA, 20 bp, human
gggaggtgtaagagagattg

SEQ ID NO: 18063 - DNA, 20 bp, human
ggtaggcggtaaccagatcg

SEQ ID NO: 18064 - DNA, 20 bp, human
gaggagaaagaggacgtagg

SEQ ID NO: 18065 - DNA, 20 bp, human
ggctcttcaggcgatctcta

SEQ ID NO: 18066 - DNA, 20 bp, human
gggagaagggcggcctccaa

SEQ ID NO: 18067 - DNA, 20 bp, human
gggaccagccgggtaaggat

SEQ ID NO: 18068 - DNA, 20 bp, human
gcgctggccgcgccctcgag

SEQ ID NO: 18069 - DNA, 20 bp, human
gcggccacagagaccctcaa

SEQ ID NO: 18070 - DNA, 20 bp, human
gcgccgaccaaagttcggag

SEQ ID NO: 18071 - DNA, 20 bp, human
gcagccgctttgactaaaat

SEQ ID NO: 18072 - DNA, 20 bp, human
gggcagcgccgaccaaagtt

SEQ ID NO: 18073 - DNA, 20 bp, human
gataggcatcgcgacggcgg

SEQ ID NO: 18074 - DNA, 20 bp, human
gtgaccgttgagggtctctg

SEQ ID NO: 18075 - DNA, 20 bp, human
ggacaaagttgctccccgag

SEQ ID NO: 18076 - DNA, 20 bp, human
gacgcggagggctctagaca

SEQ ID NO: 18077 - DNA, 20 bp, human
gtgaggtccgaggaagacag

SEQ ID NO: 18078 - DNA, 20 bp, human
ggccgggaaggatcgcacgt

SEQ ID NO: 18079 - DNA, 20 bp, human
ggcacgtggggactgaagaa

SEQ ID NO: 18080 - DNA, 20 bp, human
gccccacgtgcgatccttcc

SEQ ID NO: 18081 - DNA, 20 bp, human
ggaagacagtggccagtagt

SEQ ID NO: 18082 - DNA, 20 bp, human
gcacgggccgccttgaattt

SEQ ID NO: 18083 - DNA, 20 bp, human
gcaagcacggcagcaacagg

SEQ ID NO: 18084 - DNA, 20 bp, human
ggagtgcctaaaactaggag

SEQ ID NO: 18085 - DNA, 20 bp, human
gcagcaacaggaggaactcg

SEQ ID NO: 18086 - DNA, 20 bp, human
gccaggagcctcgagatggt

SEQ ID NO: 18087 - DNA, 20 bp, human
gctcggagcccaccatctcg

SEQ ID NO: 18088 - DNA, 20 bp, human
gcgaggctcctggactgtaa

SEQ ID NO: 18089 - DNA, 20 bp, human
gcagtccaggagcctcgaga

SEQ ID NO: 18090 - DNA, 20 bp, human
gcctcaacacacagaagtgg

SEQ ID NO: 18091 - DNA, 20 bp, human
gcaggggtcccttacagtcc

SEQ ID NO: 18092 - DNA, 20 bp, human
gacccccccacccaattctg

SEQ ID NO: 18093 - DNA, 20 bp, human
gtaaggaggcctgggtcgat

SEQ ID NO: 18094 - DNA, 20 bp, human
gtgacctgcacggacagacc

SEQ ID NO: 18095 - DNA, 20 bp, human
gcggagataaaggaccacag

SEQ ID NO: 18096 - DNA, 20 bp, human
gcccgatgtaccggcaactg

SEQ ID NO: 18097 - DNA, 20 bp, human
ggatgtaccggcaactgcgg

SEQ ID NO: 18098 - DNA, 20 bp, human
ggcgttagttccggtcgcag

SEQ ID NO: 18099 - DNA, 20 bp, human
gcgccctccagcgaaagcag

SEQ ID NO: 18100 - DNA, 20 bp, human
gtgaggccgggccggatcta

SEQ ID NO: 18101 - DNA, 20 bp, human
gaccggaagtcgaagcccga

SEQ ID NO: 18102 - DNA, 20 bp, human
gcacacaacagaggccgcgg

SEQ ID NO: 18103 - DNA, 20 bp, human
gcggaactaacgccaggagg

SEQ ID NO: 18104 - DNA, 20 bp, human
gcctccagcgaaagcagcgg

SEQ ID NO: 18105 - DNA, 20 bp, human
ggccggcggcgagggactcc

SEQ ID NO: 18106 - DNA, 20 bp, human
gcagcagtggcggcagacaa

SEQ ID NO: 18107 - DNA, 20 bp, human
gcagtggcggcagacaatgg

SEQ ID NO: 18108 - DNA, 20 bp, human
ggcagacaatggaggagtga

SEQ ID NO: 18109 - DNA, 20 bp, human
gtgcgtggcaccgccagatg

SEQ ID NO: 18110 - DNA, 20 bp, human
ggcggtcccagggtctcccg

SEQ ID NO: 18111 - DNA, 20 bp, human
gcggggctctgggctaggta

SEQ ID NO: 18112 - DNA, 20 bp, human
ggtgcacatggtctcgtgcg

SEQ ID NO: 18113 - DNA, 20 bp, human
gccacgcggtgggaagtggc

SEQ ID NO: 18114 - DNA, 20 bp, human
gcctccccgggagccgcatc

SEQ ID NO: 18115 - DNA, 20 bp, human
gtcctgcccgatggaaaccc

SEQ ID NO: 18116 - DNA, 20 bp, human
gctcagggaagagcctgcta

SEQ ID NO: 18117 - DNA, 20 bp, human
gggcaagaccaccgcaggat

SEQ ID NO: 18118 - DNA, 20 bp, human
gagggaagagcctgctacgg

SEQ ID NO: 18119 - DNA, 20 bp, human
gtcggccacgcactgaccat

SEQ ID NO: 18120 - DNA, 20 bp, human
gtggtctctaacccataggg

SEQ ID NO: 18121 - DNA, 20 bp, human
gtatcagccatgggcagtgt

SEQ ID NO: 18122 - DNA, 20 bp, human
gccttgtccagcacagaggt

SEQ ID NO: 18123 - DNA, 20 bp, human
gcctacaacatcccggccag

SEQ ID NO: 18124 - DNA, 20 bp, human
gggtccacagtatcagccat

SEQ ID NO: 18125 - DNA, 20 bp, human
gggtccagcgtggggtcgct

SEQ ID NO: 18126 - DNA, 20 bp, human
gtgctggccaggctgaccga

SEQ ID NO: 18127 - DNA, 20 bp, human
gaggctgaccgagggctgca

SEQ ID NO: 18128 - DNA, 20 bp, human
gaggccaggaatcatctgga

SEQ ID NO: 18129 - DNA, 20 bp, human
ggaactccaagggaagagga

SEQ ID NO: 18130 - DNA, 20 bp, human
gagggaggcccaaggagccc

SEQ ID NO: 18131 - DNA, 20 bp, human
gctgctctgtggaactccaa

SEQ ID NO: 18132 - DNA, 20 bp, human
gtgagggtatgctcagacct

SEQ ID NO: 18133 - DNA, 20 bp, human
ggtccagctggggagtgacg

SEQ ID NO: 18134 - DNA, 20 bp, human
gggccagctagtactgggag

SEQ ID NO: 18135 - DNA, 20 bp, human
gccagccgtccggagctccg

SEQ ID NO: 18136 - DNA, 20 bp, human
gcagttgcctaggtgacgag

SEQ ID NO: 18137 - DNA, 20 bp, human
gcaatctcggccgagagaag

SEQ ID NO: 18138 - DNA, 20 bp, human
gccgccggggtcggccccca

SEQ ID NO: 18139 - DNA, 20 bp, human
gggaaccacgcccgaatcgg

SEQ ID NO: 18140 - DNA, 20 bp, human
gtcgcaggggacgactccct

SEQ ID NO: 18141 - DNA, 20 bp, human
gtgggcacggagccgtccaa

SEQ ID NO: 18142 - DNA, 20 bp, human
ggattgcggcgatgtcgcag

SEQ ID NO: 18143 - DNA, 20 bp, human
ggggcggtgtacctccgatt

SEQ ID NO: 18144 - DNA, 20 bp, human
gtagaagcgcgtggttatga

SEQ ID NO: 18145 - DNA, 20 bp, human
gaggtctctggtaccggcac

SEQ ID NO: 18146 - DNA, 20 bp, human
gctgttgaagaaagaggatc

SEQ ID NO: 18147 - DNA, 20 bp, human
gcagtgaagagtaaattggt

SEQ ID NO: 18148 - DNA, 20 bp, human
ggcacgccggcgctggctaa

SEQ ID NO: 18149 - DNA, 20 bp, human
gtgctgactgttgaagaaag

SEQ ID NO: 18150 - DNA, 20 bp, human
gtcatgcctcttgccaacag

SEQ ID NO: 18151 - DNA, 20 bp, human
ggagaacctttagccagcgc

SEQ ID NO: 18152 - DNA, 20 bp, human
gggacccttaatcaaagagt

SEQ ID NO: 18153 - DNA, 20 bp, human
gaaaagtatttgtcactcag

SEQ ID NO: 18154 - DNA, 20 bp, human
gaattaatatgcagtatcct

SEQ ID NO: 18155 - DNA, 20 bp, human
gtttgattaagggtcctgtc

SEQ ID NO: 18156 - DNA, 20 bp, human
gcggcgctgcaatccagcag

SEQ ID NO: 18157 - DNA, 20 bp, human
gaggagccggactagaaacg

SEQ ID NO: 18158 - DNA, 20 bp, human
gctccggagtgacctaacac

SEQ ID NO: 18159 - DNA, 20 bp, human
gggcgcgcggggcccacgta

SEQ ID NO: 18160 - DNA, 20 bp, human
gctagaaacgcggaagctct

SEQ ID NO: 18161 - DNA, 20 bp, human
gctgggcggcccaaccggga

SEQ ID NO: 18162 - DNA, 20 bp, human
ggttaggtcactccggagag

SEQ ID NO: 18163 - DNA, 20 bp, human
gatcctgtgttaggtcactc

SEQ ID NO: 18164 - DNA, 20 bp, human
gcgcccggcccgggactggg

SEQ ID NO: 18165 - DNA, 20 bp, human
gcagacgcgacgggccgggg

SEQ ID NO: 18166 - DNA, 20 bp, human
ggtcctgtctggctgaaagt

SEQ ID NO: 18167 - DNA, 20 bp, human
gtactgaggcacacactctg

SEQ ID NO: 18168 - DNA, 20 bp, human
gtgcaagagcttatctactg

SEQ ID NO: 18169 - DNA, 20 bp, human
gagaaggaaagtatgcatcc

SEQ ID NO: 18170 - DNA, 20 bp, human
gggacagccacagttattgc

SEQ ID NO: 18171 - DNA, 20 bp, human
ggcccaactttcagccagac

SEQ ID NO: 18172 - DNA, 20 bp, human
ggagctcagtacataacaag

SEQ ID NO: 18173 - DNA, 20 bp, human
gatactgagaacacgctcct

SEQ ID NO: 18174 - DNA, 20 bp, human
gctgtggttctcacaacact

SEQ ID NO: 18175 - DNA, 20 bp, human
gacactgggaacttgtctca

SEQ ID NO: 18176 - DNA, 20 bp, human
gtgagccaggcaccatgaat

SEQ ID NO: 18177 - DNA, 20 bp, human
ggcatgggtgtgctgagaca

SEQ ID NO: 18178 - DNA, 20 bp, human
gctgcgtcgctgcttaatct

SEQ ID NO: 18179 - DNA, 20 bp, human
gtttctgataatgcaggagt

SEQ ID NO: 18180 - DNA, 20 bp, human
gaggtcagtgataactgcaa

SEQ ID NO: 18181 - DNA, 20 bp, human
ggaacaggtagagtatgtgt

SEQ ID NO: 18182 - DNA, 20 bp, human
gatctactctatggaaagca

SEQ ID NO: 18183 - DNA, 20 bp, human
gcaggtagagtatgtgttgg

SEQ ID NO: 18184 - DNA, 20 bp, human
gacacgtgcagctgtaagag

SEQ ID NO: 18185 - DNA, 20 bp, human
gtctctctcatataagctag

SEQ ID NO: 18186 - DNA, 20 bp, human
gtgatgtgtcagctccgcag

SEQ ID NO: 18187 - DNA, 20 bp, human
gcagccgacgcctcactcag

SEQ ID NO: 18188 - DNA, 20 bp, human
gggtccaaccagccaagagt

SEQ ID NO: 18189 - DNA, 20 bp, human
ggagtgggaggaaaagaccg

SEQ ID NO: 18190 - DNA, 20 bp, human
gcggccgctgagtgaggcgt

SEQ ID NO: 18191 - DNA, 20 bp, human
ggggaaacggccgctgagtg

SEQ ID NO: 18192 - DNA, 20 bp, human
gaggggtactcggggcacac

SEQ ID NO: 18193 - DNA, 20 bp, human
gtccaaggtcccggaaccga

SEQ ID NO: 18194 - DNA, 20 bp, human
gccttggaggtggcaaagag

SEQ ID NO: 18195 - DNA, 20 bp, human
ggcacaccggtgagtcgcgg

SEQ ID NO: 18196 - DNA, 20 bp, human
gcacgtcatcaaagtaaagt

SEQ ID NO: 18197 - DNA, 20 bp, human
gtaacactgagaaattggac

SEQ ID NO: 18198 - DNA, 20 bp, human
gtaaagaacagggcaaattt

SEQ ID NO: 18199 - DNA, 20 bp, human
gaatgcaataacagttaatg

SEQ ID NO: 18200 - DNA, 20 bp, human
gcaggtccaaactaacttgc

SEQ ID NO: 18201 - DNA, 20 bp, human
gaaaaaatgcttaaagaaca

SEQ ID NO: 18202 - DNA, 20 bp, human
gagtgacctgcaagttagtt

SEQ ID NO: 18203 - DNA, 20 bp, human
gtttacatattaaatggggt

SEQ ID NO: 18204 - DNA, 20 bp, human
gtcataatcaccaaatattc

SEQ ID NO: 18205 - DNA, 20 bp, human
gcattatttacatattaaat

SEQ ID NO: 18206 - DNA, 20 bp, human
gcatccctaaaatcttggag

SEQ ID NO: 18207 - DNA, 20 bp, human
gtcttggaggggcagaccac

SEQ ID NO: 18208 - DNA, 20 bp, human
gatggcagctgagaatagtg

SEQ ID NO: 18209 - DNA, 20 bp, human
gcactctctgggaagaaata

SEQ ID NO: 18210 - DNA, 20 bp, human
gatgccagctgtacacaaag

SEQ ID NO: 18211 - DNA, 20 bp, human
gcaagattttagggatgtgg

SEQ ID NO: 18212 - DNA, 20 bp, human
ggggcctaaccaaccatctt

SEQ ID NO: 18213 - DNA, 20 bp, human
gtagatgcagtgaggtatcc

SEQ ID NO: 18214 - DNA, 20 bp, human
gcagctgagaatagtgagga

SEQ ID NO: 18215 - DNA, 20 bp, human
gtgtacagctggcatagggc

SEQ ID NO: 18216 - DNA, 20 bp, human
gagtggagaagcctacccag

SEQ ID NO: 18217 - DNA, 20 bp, human
gggcaataagctaggacggg

SEQ ID NO: 18218 - DNA, 20 bp, human
gtccggcaataagctaggac

SEQ ID NO: 18219 - DNA, 20 bp, human
gccggagtatgatcagagaa

SEQ ID NO: 18220 - DNA, 20 bp, human
gcagagggctagtgacacaa

SEQ ID NO: 18221 - DNA, 20 bp, human
ggagtgggaaggctcataaa

SEQ ID NO: 18222 - DNA, 20 bp, human
gctgaggccgccatgagcag

SEQ ID NO: 18223 - DNA, 20 bp, human
gtttcccaagggcaatccgt

SEQ ID NO: 18224 - DNA, 20 bp, human
gcaatgtgatgagggcccga

SEQ ID NO: 18225 - DNA, 20 bp, human
gcatactccggcaataagct

SEQ ID NO: 18226 - DNA, 20 bp, human
gacgagtggcttgagagaca

SEQ ID NO: 18227 - DNA, 20 bp, human
ggctgagagctgtaaaacac

SEQ ID NO: 18228 - DNA, 20 bp, human
ggccaagcgtaagtacagat

SEQ ID NO: 18229 - DNA, 20 bp, human
gtgcacacattatctcctta

SEQ ID NO: 18230 - DNA, 20 bp, human
gcaaaatgaataagaagctg

SEQ ID NO: 18231 - DNA, 20 bp, human
gtgtaaaacacaggcaagat

SEQ ID NO: 18232 - DNA, 20 bp, human
gagaatgatgttcactcaaa

SEQ ID NO: 18233 - DNA, 20 bp, human
gtccaatctgtacttacgct

SEQ ID NO: 18234 - DNA, 20 bp, human
gcttctaagagcttaccatg

SEQ ID NO: 18235 - DNA, 20 bp, human
gtgagctcgcgtctgccaca

SEQ ID NO: 18236 - DNA, 20 bp, human
gagcgccagcatgaacttgg

SEQ ID NO: 18237 - DNA, 20 bp, human
gctcagtgggcaggaaactg

SEQ ID NO: 18238 - DNA, 20 bp, human
gtcctggctgctggcagcgc

SEQ ID NO: 18239 - DNA, 20 bp, human
gcatgtaggcatgtagatac

SEQ ID NO: 18240 - DNA, 20 bp, human
gtgcccactgaggctccccc

SEQ ID NO: 18241 - DNA, 20 bp, human
gcatgctggcgctctgctct

SEQ ID NO: 18242 - DNA, 20 bp, human
gcttgggggtcagcatgctg

SEQ ID NO: 18243 - DNA, 20 bp, human
gtcattggttcagaaagtta

SEQ ID NO: 18244 - DNA, 20 bp, human
gcagtccccacttacccagg

SEQ ID NO: 18245 - DNA, 20 bp, human
gcaatgagccatgtgaccca

SEQ ID NO: 18246 - DNA, 20 bp, human
ggccttggccaaagtttcca

SEQ ID NO: 18247 - DNA, 20 bp, human
gaaaggatgtgttggatcag

SEQ ID NO: 18248 - DNA, 20 bp, human
gtccaagaggagtttctatg

SEQ ID NO: 18249 - DNA, 20 bp, human
gctgagaaactgcttggact

SEQ ID NO: 18250 - DNA, 20 bp, human
gccggcaactaaactataag

SEQ ID NO: 18251 - DNA, 20 bp, human
gactaggcacctggagtcag

SEQ ID NO: 18252 - DNA, 20 bp, human
gggtaagtatctgtgctcat

SEQ ID NO: 18253 - DNA, 20 bp, human
gcccccatagaaactcctct

SEQ ID NO: 18254 - DNA, 20 bp, human
gaactccggaccaaggagaa

SEQ ID NO: 18255 - DNA, 20 bp, human
ggggggcttcagatgtttgg

SEQ ID NO: 18256 - DNA, 20 bp, human
ggcccgcgggctgcaagtag

SEQ ID NO: 18257 - DNA, 20 bp, human
gagggcgcaccatctaccgc

SEQ ID NO: 18258 - DNA, 20 bp, human
ggcagcccgcgggcgccgta

SEQ ID NO: 18259 - DNA, 20 bp, human
gtggtgatcatcctagcctg

SEQ ID NO: 18260 - DNA, 20 bp, human
gaatgtgaagatcaggacta

SEQ ID NO: 18261 - DNA, 20 bp, human
gccagccctacggcgcccgc

SEQ ID NO: 18262 - DNA, 20 bp, human
gcggcagcgcgcatgctcct

SEQ ID NO: 18263 - DNA, 20 bp, human
gcatcctagcctgcggtaga

SEQ ID NO: 18264 - DNA, 20 bp, human
gtgcatgggcagaactagct

SEQ ID NO: 18265 - DNA, 20 bp, human
ggcaccatctaccgcaggct

SEQ ID NO: 18266 - DNA, 20 bp, human
gagggcaggcgatacgacgg

SEQ ID NO: 18267 - DNA, 20 bp, human
ggcaacgcaggcccaaagca

SEQ ID NO: 18268 - DNA, 20 bp, human
gtccagggcaggcgatacga

SEQ ID NO: 18269 - DNA, 20 bp, human
gcgatacgacgggggagcgg

SEQ ID NO: 18270 - DNA, 20 bp, human
gctggcagagaccggaagtg

SEQ ID NO: 18271 - DNA, 20 bp, human
gaggcgatacgacgggggag

SEQ ID NO: 18272 - DNA, 20 bp, human
gttctcggcgagtcactacc

SEQ ID NO: 18273 - DNA, 20 bp, human
gcccccatcacttcgatcca

SEQ ID NO: 18274 - DNA, 20 bp, human
gctgtcccagggagaatccg

SEQ ID NO: 18275 - DNA, 20 bp, human
ggaaccgtggcatccctccc

SEQ ID NO: 18276 - DNA, 20 bp, human
gactctgcagagctcactct

SEQ ID NO: 18277 - DNA, 20 bp, human
gggggtaacaagatacggag

SEQ ID NO: 18278 - DNA, 20 bp, human
gctcacgttgccggcgaagt

SEQ ID NO: 18279 - DNA, 20 bp, human
gatagagggtcatagaggtg

SEQ ID NO: 18280 - DNA, 20 bp, human
gcctcactgggacctcaaca

SEQ ID NO: 18281 - DNA, 20 bp, human
gactgtatagagggtcatag

SEQ ID NO: 18282 - DNA, 20 bp, human
gtcaaggcgagtagcatgtg

SEQ ID NO: 18283 - DNA, 20 bp, human
gggagctcggagtagtagag

SEQ ID NO: 18284 - DNA, 20 bp, human
gactaactaacggaccatag

SEQ ID NO: 18285 - DNA, 20 bp, human
ggcggagagaaactaactaa

SEQ ID NO: 18286 - DNA, 20 bp, human
gacagctcttgaggtcccgg

SEQ ID NO: 18287 - DNA, 20 bp, human
ggcccagcgagccagagtgg

SEQ ID NO: 18288 - DNA, 20 bp, human
gggacgccttccgagttggg

SEQ ID NO: 18289 - DNA, 20 bp, human
gagggagtgggggaacacgg

SEQ ID NO: 18290 - DNA, 20 bp, human
gaaggcggaggagctcccca

SEQ ID NO: 18291 - DNA, 20 bp, human
ggaaggcgtcctgtgacccc

SEQ ID NO: 18292 - DNA, 20 bp, human
gtgactgagcacggccagga

SEQ ID NO: 18293 - DNA, 20 bp, human
gcccagggagtgggggaaca

SEQ ID NO: 18294 - DNA, 20 bp, human
gcagcatgcagcaatagcat

SEQ ID NO: 18295 - DNA, 20 bp, human
gctcctccccccaactcgga

SEQ ID NO: 18296 - DNA, 20 bp, human
gaaaggctcccggagctccg

SEQ ID NO: 18297 - DNA, 20 bp, human
gcggttcggtcagtccgtga

SEQ ID NO: 18298 - DNA, 20 bp, human
gcgaaccgcgcttgagactc

SEQ ID NO: 18299 - DNA, 20 bp, human
gcggagaaggtgaccacctg

SEQ ID NO: 18300 - DNA, 20 bp, human
gtccgtgaaggggcttctca

SEQ ID NO: 18301 - DNA, 20 bp, human
gaacgccagagtctcaagcg

SEQ ID NO: 18302 - DNA, 20 bp, human
gcgttcgctaactgaaatga

SEQ ID NO: 18303 - DNA, 20 bp, human
gaacggttgcgcactgacga

SEQ ID NO: 18304 - DNA, 20 bp, human
gctcccggcctgatagtccg

SEQ ID NO: 18305 - DNA, 20 bp, human
gtgcgactccccggactatc

SEQ ID NO: 18306 - DNA, 20 bp, human
gcctcggcggcgtccactcc

SEQ ID NO: 18307 - DNA, 20 bp, human
gagcctctggagcccgacac

SEQ ID NO: 18308 - DNA, 20 bp, human
gggctacgggcaagaccaca

SEQ ID NO: 18309 - DNA, 20 bp, human
gatgcgctccctccccggcg

SEQ ID NO: 18310 - DNA, 20 bp, human
gccagtgctatctggaatgt

SEQ ID NO: 18311 - DNA, 20 bp, human
gtgctgcggtggccctcgaa

SEQ ID NO: 18312 - DNA, 20 bp, human
ggtgagtcgccgcgccgggg

SEQ ID NO: 18313 - DNA, 20 bp, human
gcggctccaagtcccggccc

SEQ ID NO: 18314 - DNA, 20 bp, human
gcaggtgagtcgccgcgccg

SEQ ID NO: 18315 - DNA, 20 bp, human
gctcgaaaggctccactccg

SEQ ID NO: 18316 - DNA, 20 bp, human
ggcgatgcccaagaacgcag

SEQ ID NO: 18317 - DNA, 20 bp, human
gggatgaccactgcgttctt

SEQ ID NO: 18318 - DNA, 20 bp, human
gttctcccttgcctctgcgg

SEQ ID NO: 18319 - DNA, 20 bp, human
gcgcgcccgggccggaagag

SEQ ID NO: 18320 - DNA, 20 bp, human
gctccgccgccgcagaggca

SEQ ID NO: 18321 - DNA, 20 bp, human
gggtgtggtgctccaccggt

SEQ ID NO: 18322 - DNA, 20 bp, human
gcgctatgggccctacagcg

SEQ ID NO: 18323 - DNA, 20 bp, human
gtacagcgcggcaggcctac

SEQ ID NO: 18324 - DNA, 20 bp, human
ggagaggtggcgcttcgtgg

SEQ ID NO: 18325 - DNA, 20 bp, human
gagcgcggcaggcctaccgg

SEQ ID NO: 18326 - DNA, 20 bp, human
ggctcgcactcagtcgcggg

SEQ ID NO: 18327 - DNA, 20 bp, human
gtgtgcccgatgcctagctg

SEQ ID NO: 18328 - DNA, 20 bp, human
gtgacagctgcccaagtggc

SEQ ID NO: 18329 - DNA, 20 bp, human
gactcgctcgcactcagtcg

SEQ ID NO: 18330 - DNA, 20 bp, human
gagcttctgcaaagaaggag

SEQ ID NO: 18331 - DNA, 20 bp, human
ggcgcgtccgacggcgacat

SEQ ID NO: 18332 - DNA, 20 bp, human
gacagccctgcctgccactt

SEQ ID NO: 18333 - DNA, 20 bp, human
ggctggacaggcagccctca

SEQ ID NO: 18334 - DNA, 20 bp, human
gctggctgcgtccctaggta

SEQ ID NO: 18335 - DNA, 20 bp, human
gtgcgagcgagtgagcgctg

SEQ ID NO: 18336 - DNA, 20 bp, human
gagccagctcccccgacggt

SEQ ID NO: 18337 - DNA, 20 bp, human
gttgcctgtgccacccacca

SEQ ID NO: 18338 - DNA, 20 bp, human
gtgtcgttcgccctggtggg

SEQ ID NO: 18339 - DNA, 20 bp, human
gaagaagagactgggaagat

SEQ ID NO: 18340 - DNA, 20 bp, human
gtattgtcgttcgccctggt

SEQ ID NO: 18341 - DNA, 20 bp, human
gcacaaatgcccaccgtcgg

SEQ ID NO: 18342 - DNA, 20 bp, human
gcgacaatagctttaccctc

SEQ ID NO: 18343 - DNA, 20 bp, human
gtcagctgtaagaagagact

SEQ ID NO: 18344 - DNA, 20 bp, human
gagagacactaacgacttca

SEQ ID NO: 18345 - DNA, 20 bp, human
ggcaggagttaaaaagggca

SEQ ID NO: 18346 - DNA, 20 bp, human
gcacgctgggtgatctctgg

SEQ ID NO: 18347 - DNA, 20 bp, human
gtgaaagggcaggctcccca

SEQ ID NO: 18348 - DNA, 20 bp, human
gccacgaggcacggagaagt

SEQ ID NO: 18349 - DNA, 20 bp, human
ggtctccaggaccctacacc

SEQ ID NO: 18350 - DNA, 20 bp, human
gcagcaggcagaagacatct

SEQ ID NO: 18351 - DNA, 20 bp, human
gggcagagctaagagcacgc

SEQ ID NO: 18352 - DNA, 20 bp, human
ggtatgattcatgcttgaaa

SEQ ID NO: 18353 - DNA, 20 bp, human
gaaggattcccggtgcagag

SEQ ID NO: 18354 - DNA, 20 bp, human
gccaggaccctacaccaggc

SEQ ID NO: 18355 - DNA, 20 bp, human
gcctgcctgtcagacatcct

SEQ ID NO: 18356 - DNA, 20 bp, human
gcagcagacccgcagctcgg

SEQ ID NO: 18357 - DNA, 20 bp, human
gggctgctgcgataccccag

SEQ ID NO: 18358 - DNA, 20 bp, human
gcgtaggaagcgagaagctc

SEQ ID NO: 18359 - DNA, 20 bp, human
gatgcgcgggtccacgaggt

SEQ ID NO: 18360 - DNA, 20 bp, human
gaggctgtgggagtcttgtg

SEQ ID NO: 18361 - DNA, 20 bp, human
ggtgccaaaggtccccctca

SEQ ID NO: 18362 - DNA, 20 bp, human
gggaccaaggccatcataag

SEQ ID NO: 18363 - DNA, 20 bp, human
ggcaaatgcgcgggtccacg

SEQ ID NO: 18364 - DNA, 20 bp, human
ggagctccgcgcctgggtag

SEQ ID NO: 18365 - DNA, 20 bp, human
gtggacccgcgcatttgcgg

SEQ ID NO: 18366 - DNA, 20 bp, human
gccagaagccggccagacac

SEQ ID NO: 18367 - DNA, 20 bp, human
gtaaatagagacccagccgg

SEQ ID NO: 18368 - DNA, 20 bp, human
gaggagccagacaagtgtct

SEQ ID NO: 18369 - DNA, 20 bp, human
ggtgtgtgccgggagcccat

SEQ ID NO: 18370 - DNA, 20 bp, human
gtccgggtacgtggtccccg

SEQ ID NO: 18371 - DNA, 20 bp, human
gcagctggacacgcagagag

SEQ ID NO: 18372 - DNA, 20 bp, human
gtcacaaacctacccacctg

SEQ ID NO: 18373 - DNA, 20 bp, human
gaagatcagtgaccagaagc

SEQ ID NO: 18374 - DNA, 20 bp, human
gccagccgggggaaaccaaa

SEQ ID NO: 18375 - DNA, 20 bp, human
gcccaacaccaatgggctcc

SEQ ID NO: 18376 - DNA, 20 bp, human
ggcaggagaggaagctctcg

SEQ ID NO: 18377 - DNA, 20 bp, human
ggggcagctggcggggtcaa

SEQ ID NO: 18378 - DNA, 20 bp, human
gggaacggcgcgggtggtag

SEQ ID NO: 18379 - DNA, 20 bp, human
ggccgctgctccgggctcac

SEQ ID NO: 18380 - DNA, 20 bp, human
gacggcgcgggtggtagagg

SEQ ID NO: 18381 - DNA, 20 bp, human
gcggtggcgtcgagagcgag

SEQ ID NO: 18382 - DNA, 20 bp, human
ggacacgggaagggtcgggg

SEQ ID NO: 18383 - DNA, 20 bp, human
gccgcgggctcggtaagcgg

SEQ ID NO: 18384 - DNA, 20 bp, human
gagcgggcccgggaacggcg

SEQ ID NO: 18385 - DNA, 20 bp, human
ggtcctggggtgcgggcgta

SEQ ID NO: 18386 - DNA, 20 bp, human
gcagccaggggaaggatatg

SEQ ID NO: 18387 - DNA, 20 bp, human
gggccgggcagaggccaagt

SEQ ID NO: 18388 - DNA, 20 bp, human
gcccaggtgagcgctgaggt

SEQ ID NO: 18389 - DNA, 20 bp, human
gggagggctctaagtcaaag

SEQ ID NO: 18390 - DNA, 20 bp, human
gccaggggaaggatatgcgg

SEQ ID NO: 18391 - DNA, 20 bp, human
gaggcggtgtcctgagaaag

SEQ ID NO: 18392 - DNA, 20 bp, human
gcccgcccaggtgagcgctg

SEQ ID NO: 18393 - DNA, 20 bp, human
gtttgcgggtgtagacactg

SEQ ID NO: 18394 - DNA, 20 bp, human
gtggaagagggtggctagga

SEQ ID NO: 18395 - DNA, 20 bp, human
gctcacccggtggagcacaa

SEQ ID NO: 18396 - DNA, 20 bp, human
ggccggtacagcgtggaaat

SEQ ID NO: 18397 - DNA, 20 bp, human
gtacttgaagcggagtgagc

SEQ ID NO: 18398 - DNA, 20 bp, human
ggctgggctggcctgactga

SEQ ID NO: 18399 - DNA, 20 bp, human
gcaggcgtgatagcccctca

SEQ ID NO: 18400 - DNA, 20 bp, human
gcccacgctggcctcttctt

SEQ ID NO: 18401 - DNA, 20 bp, human
gctgactgaaggcggcggaa

SEQ ID NO: 18402 - DNA, 20 bp, human
gcgaggctcctgggcgtgag

SEQ ID NO: 18403 - DNA, 20 bp, human
gggagctgcgaggtcgtccg

SEQ ID NO: 18404 - DNA, 20 bp, human
gggaatggagacgcggaccg

SEQ ID NO: 18405 - DNA, 20 bp, human
gccggcggaaattcaagcac

SEQ ID NO: 18406 - DNA, 20 bp, human
gtagccacagaggtaaactc

SEQ ID NO: 18407 - DNA, 20 bp, human
ggctaggctcagaatgagtc

SEQ ID NO: 18408 - DNA, 20 bp, human
ggtactgtatgaggccccag

SEQ ID NO: 18409 - DNA, 20 bp, human
gtgtccggagtttacctctg

SEQ ID NO: 18410 - DNA, 20 bp, human
gattctgagcctagccacag

SEQ ID NO: 18411 - DNA, 20 bp, human
ggcacggtagcgcctgttgg

SEQ ID NO: 18412 - DNA, 20 bp, human
gctgggcccagtactgtatg

SEQ ID NO: 18413 - DNA, 20 bp, human
gccaggtctttagagatacc

SEQ ID NO: 18414 - DNA, 20 bp, human
ggcccagaagatactcagcg

SEQ ID NO: 18415 - DNA, 20 bp, human
gtaaagacctgggccaactt

SEQ ID NO: 18416 - DNA, 20 bp, human
gcaggtgggcagagctccag

SEQ ID NO: 18417 - DNA, 20 bp, human
gcccagtcctggcagatcct

SEQ ID NO: 18418 - DNA, 20 bp, human
gtaagacgcctccttcccat

SEQ ID NO: 18419 - DNA, 20 bp, human
ggtccctgtggtctacgggg

SEQ ID NO: 18420 - DNA, 20 bp, human
gagctgcaggaggaccgaag

SEQ ID NO: 18421 - DNA, 20 bp, human
gcaggtccctgtggtctacg

SEQ ID NO: 18422 - DNA, 20 bp, human
ggcaccagcctaggaaatga

SEQ ID NO: 18423 - DNA, 20 bp, human
gccttcccataggcacccac

SEQ ID NO: 18424 - DNA, 20 bp, human
gtgcagacccaccctcctag

SEQ ID NO: 18425 - DNA, 20 bp, human
gtcagccttgaggccagaga

SEQ ID NO: 18426 - DNA, 20 bp, human
ggctggccgccgcccaaaca

SEQ ID NO: 18427 - DNA, 20 bp, human
gacatggtcggccccccagg

SEQ ID NO: 18428 - DNA, 20 bp, human
gggccagctgtacacataca

SEQ ID NO: 18429 - DNA, 20 bp, human
ggccggcgggatccagagcg

SEQ ID NO: 18430 - DNA, 20 bp, human
gcggctgctgttcttactgg

SEQ ID NO: 18431 - DNA, 20 bp, human
ggcaacgcagctacaaagtg

SEQ ID NO: 18432 - DNA, 20 bp, human
gtcctgcggatccagacctg

SEQ ID NO: 18433 - DNA, 20 bp, human
ggcagctacaaagtgcggag

SEQ ID NO: 18434 - DNA, 20 bp, human
ggtagctcctggccagctca

SEQ ID NO: 18435 - DNA, 20 bp, human
gagcctcttgtcccaaggtc

SEQ ID NO: 18436 - DNA, 20 bp, human
gatgtccaaggtggccccaa

SEQ ID NO: 18437 - DNA, 20 bp, human
ggaaaggactagaagcctca

SEQ ID NO: 18438 - DNA, 20 bp, human
gtcctgagccccggaaagat

SEQ ID NO: 18439 - DNA, 20 bp, human
gggctccagaaattctagat

SEQ ID NO: 18440 - DNA, 20 bp, human
gtgacacaagtacaagagaa

SEQ ID NO: 18441 - DNA, 20 bp, human
ggcacagtaatctagctgag

SEQ ID NO: 18442 - DNA, 20 bp, human
ggattttcacgtcctgggaa

SEQ ID NO: 18443 - DNA, 20 bp, human
ggaacccccaagccacctgc

SEQ ID NO: 18444 - DNA, 20 bp, human
gccagaaattctagataggt

SEQ ID NO: 18445 - DNA, 20 bp, human
gtgccaaggcctgcccgcca

SEQ ID NO: 18446 - DNA, 20 bp, human
gtgagtcaagaggcgtgaag

SEQ ID NO: 18447 - DNA, 20 bp, human
gcaactcggccgggcgctgg

SEQ ID NO: 18448 - DNA, 20 bp, human
gctagtgacgggagaagacg

SEQ ID NO: 18449 - DNA, 20 bp, human
gtttgagcagcagagacact

SEQ ID NO: 18450 - DNA, 20 bp, human
gaggcactgcagattctccc

SEQ ID NO: 18451 - DNA, 20 bp, human
ggccgctctgagcgaaaccc

SEQ ID NO: 18452 - DNA, 20 bp, human
gcggccggcgcgtcccaaag

SEQ ID NO: 18453 - DNA, 20 bp, human
gagttgagtgctctgatcca

SEQ ID NO: 18454 - DNA, 20 bp, human
gaccaacaggaggcgccgag

SEQ ID NO: 18455 - DNA, 20 bp, human
gtccagggtttcgctcagag

SEQ ID NO: 18456 - DNA, 20 bp, human
gcggcgtggcaaccaggagt

SEQ ID NO: 18457 - DNA, 20 bp, human
gccactcaggaaacagggaa

SEQ ID NO: 18458 - DNA, 20 bp, human
gccacaggtctgaccccaca

SEQ ID NO: 18459 - DNA, 20 bp, human
gctgtgggtaagtccttgtg

SEQ ID NO: 18460 - DNA, 20 bp, human
gaacctccactcaggaaaca

SEQ ID NO: 18461 - DNA, 20 bp, human
ggggtcagacctgtggactt

SEQ ID NO: 18462 - DNA, 20 bp, human
gtggcaaccaggagtcggtt

SEQ ID NO: 18463 - DNA, 20 bp, human
gcaaggcaggtgactcaaag

SEQ ID NO: 18464 - DNA, 20 bp, human
gaccctcacggggctctggt

SEQ ID NO: 18465 - DNA, 20 bp, human
ggcccaccagagccccgtga

SEQ ID NO: 18466 - DNA, 20 bp, human
gctctcagcgccgtcctcag

SEQ ID NO: 18467 - DNA, 20 bp, human
gagcccagcccaagacacca

SEQ ID NO: 18468 - DNA, 20 bp, human
gaacgaggccatgtcttcct

SEQ ID NO: 18469 - DNA, 20 bp, human
gctgagagggggaaagtcat

SEQ ID NO: 18470 - DNA, 20 bp, human
gagtggccacaccaagaacg

SEQ ID NO: 18471 - DNA, 20 bp, human
ggagccgtgtaattacgtat

SEQ ID NO: 18472 - DNA, 20 bp, human
gggaaaccctgcctgtactg

SEQ ID NO: 18473 - DNA, 20 bp, human
ggcctcgctcacactcacgt

SEQ ID NO: 18474 - DNA, 20 bp, human
gttacaaagcctccccctgg

SEQ ID NO: 18475 - DNA, 20 bp, human
ggaagacatggcctcgttct

SEQ ID NO: 18476 - DNA, 20 bp, human
gctggtggccctcggacagt

SEQ ID NO: 18477 - DNA, 20 bp, human
gtggccctcggacagtagga

SEQ ID NO: 18478 - DNA, 20 bp, human
gggccggcttgtcccattgt

SEQ ID NO: 18479 - DNA, 20 bp, human
ggtggccggcagcgcaaccc

SEQ ID NO: 18480 - DNA, 20 bp, human
gctgacagcagctacccgga

SEQ ID NO: 18481 - DNA, 20 bp, human
ggaatggggacactctggaa

SEQ ID NO: 18482 - DNA, 20 bp, human
gggggcccagactggagaag

SEQ ID NO: 18483 - DNA, 20 bp, human
gcccattgtgggagcagaat

SEQ ID NO: 18484 - DNA, 20 bp, human
ggctccttcctactgtccga

SEQ ID NO: 18485 - DNA, 20 bp, human
gggactgagagacagaggtt

SEQ ID NO: 18486 - DNA, 20 bp, human
gcccgaaaggccgggcaggt

SEQ ID NO: 18487 - DNA, 20 bp, human
gccgcgcgcggccagtcggg

SEQ ID NO: 18488 - DNA, 20 bp, human
gcgccatcttgccccttcag

SEQ ID NO: 18489 - DNA, 20 bp, human
gggctcctccgccaagacta

SEQ ID NO: 18490 - DNA, 20 bp, human
ggccaagactaggggacacc

SEQ ID NO: 18491 - DNA, 20 bp, human
gactaggggacaccaggaat

SEQ ID NO: 18492 - DNA, 20 bp, human
gtgtcccctagtcttggcgg

SEQ ID NO: 18493 - DNA, 20 bp, human
ggtttgcggtgcctctgaag

SEQ ID NO: 18494 - DNA, 20 bp, human
gaagatggcgacaggtaaca

SEQ ID NO: 18495 - DNA, 20 bp, human
gagatgagccccgaaaggcc

SEQ ID NO: 18496 - DNA, 20 bp, human
gccccgcgggaggaagcgta

SEQ ID NO: 18497 - DNA, 20 bp, human
gacccgacgaagccccggag

SEQ ID NO: 18498 - DNA, 20 bp, human
gagaatgcagcgggactggt

SEQ ID NO: 18499 - DNA, 20 bp, human
gacgtgggtgaaagggacgt

SEQ ID NO: 18500 - DNA, 20 bp, human
gtaggcgccatggctccccg

SEQ ID NO: 18501 - DNA, 20 bp, human
gtcggctacggcgaccaccg

SEQ ID NO: 18502 - DNA, 20 bp, human
gcggacggcagcagtaagtg

SEQ ID NO: 18503 - DNA, 20 bp, human
gtgacgctgctgcgcccgga

SEQ ID NO: 18504 - DNA, 20 bp, human
gcgccatggctccccgcggg

SEQ ID NO: 18505 - DNA, 20 bp, human
gcgaccactgagcggaaact

SEQ ID NO: 18506 - DNA, 20 bp, human
gctgggactcagtgaatctg

SEQ ID NO: 18507 - DNA, 20 bp, human
gatgtcatggaagactgcca

SEQ ID NO: 18508 - DNA, 20 bp, human
gccttgtgaactcaagccac

SEQ ID NO: 18509 - DNA, 20 bp, human
gcccagcaagagcacacttg

SEQ ID NO: 18510 - DNA, 20 bp, human
ggtgctactgtaccttataa

SEQ ID NO: 18511 - DNA, 20 bp, human
gctactgtaccttataaagg

SEQ ID NO: 18512 - DNA, 20 bp, human
ggccatggtctcagtctgtt

SEQ ID NO: 18513 - DNA, 20 bp, human
gtggggctttctcgctcctg

SEQ ID NO: 18514 - DNA, 20 bp, human
gactcagtgaatctggggtt

SEQ ID NO: 18515 - DNA, 20 bp, human
gaccataaccctagacatca

SEQ ID NO: 18516 - DNA, 20 bp, human
gccgccccccccgagactac

SEQ ID NO: 18517 - DNA, 20 bp, human
gggccctgggcgggacagta

SEQ ID NO: 18518 - DNA, 20 bp, human
gggcccgcgggcaggcgtcg

SEQ ID NO: 18519 - DNA, 20 bp, human
gctggcactgggtccaaaag

SEQ ID NO: 18520 - DNA, 20 bp, human
ggaggaagtcggcccaggag

SEQ ID NO: 18521 - DNA, 20 bp, human
gtgggcgggacagtagggta

SEQ ID NO: 18522 - DNA, 20 bp, human
gcagctgcggtaggccccaa

SEQ ID NO: 18523 - DNA, 20 bp, human
ggggaacccgccacactaga

SEQ ID NO: 18524 - DNA, 20 bp, human
gagaaggctgctgaggaagt

SEQ ID NO: 18525 - DNA, 20 bp, human
gctgctgaggaagtcggccc

SEQ ID NO: 18526 - DNA, 20 bp, human
gagatgggtgtcagatccta

SEQ ID NO: 18527 - DNA, 20 bp, human
gttcaagggggggatctgtg

SEQ ID NO: 18528 - DNA, 20 bp, human
ggctacacagtttacagctg

SEQ ID NO: 18529 - DNA, 20 bp, human
gtgcatagccggctcaccct

SEQ ID NO: 18530 - DNA, 20 bp, human
gctcaacatggctctagtgc

SEQ ID NO: 18531 - DNA, 20 bp, human
gtgatagctcccagcttatg

SEQ ID NO: 18532 - DNA, 20 bp, human
gatctgattagtcttctgag

SEQ ID NO: 18533 - DNA, 20 bp, human
gaccagtgtgagctgtgttg

SEQ ID NO: 18534 - DNA, 20 bp, human
gcactcgggggtccatatgc

SEQ ID NO: 18535 - DNA, 20 bp, human
gatgcctgcagctgcatagc

SEQ ID NO: 18536 - DNA, 20 bp, human
ggtgagacaggagatcagga

SEQ ID NO: 18537 - DNA, 20 bp, human
gaggagatacgctaagtcag

SEQ ID NO: 18538 - DNA, 20 bp, human
gcccagggaggtgagacctg

SEQ ID NO: 18539 - DNA, 20 bp, human
gaacatggtggggtatggga

SEQ ID NO: 18540 - DNA, 20 bp, human
gtccagtgtcagcaggttgg

SEQ ID NO: 18541 - DNA, 20 bp, human
gcttgtgagtaggaaggggt

SEQ ID NO: 18542 - DNA, 20 bp, human
gaggggtgagacaggagatc

SEQ ID NO: 18543 - DNA, 20 bp, human
ggctaagtcaggggtgagac

SEQ ID NO: 18544 - DNA, 20 bp, human
gagcagcttgtgagtaggaa

SEQ ID NO: 18545 - DNA, 20 bp, human
gtattcacacaaagagggag

SEQ ID NO: 18546 - DNA, 20 bp, human
gccagtgaccccagcccgag

SEQ ID NO: 18547 - DNA, 20 bp, human
gagcttggctgccacccctc

SEQ ID NO: 18548 - DNA, 20 bp, human
ggagctgggccagaatggag

SEQ ID NO: 18549 - DNA, 20 bp, human
gggttgggggaacaagggta

SEQ ID NO: 18550 - DNA, 20 bp, human
gactcacaaggacaagtgag

SEQ ID NO: 18551 - DNA, 20 bp, human
gaagcctgcgaggctgcatg

SEQ ID NO: 18552 - DNA, 20 bp, human
gctggggcatggcccaccag

SEQ ID NO: 18553 - DNA, 20 bp, human
ggaatggagaggccgctggt

SEQ ID NO: 18554 - DNA, 20 bp, human
gtccacctgagctcacagga

SEQ ID NO: 18555 - DNA, 20 bp, human
ggggacacacccagcatggt

SEQ ID NO: 18556 - DNA, 20 bp, human
gaggtcgactcacacttcac

SEQ ID NO: 18557 - DNA, 20 bp, human
gcctgtgctttcccttcctg

SEQ ID NO: 18558 - DNA, 20 bp, human
ggcgtccagtgagcagggtg

SEQ ID NO: 18559 - DNA, 20 bp, human
gcggcttcttagcaaaaccg

SEQ ID NO: 18560 - DNA, 20 bp, human
gcggacagagaacgcatcaa

SEQ ID NO: 18561 - DNA, 20 bp, human
gggtctggtggggagtacac

SEQ ID NO: 18562 - DNA, 20 bp, human
ggggtgggcgaggaagagtc

SEQ ID NO: 18563 - DNA, 20 bp, human
gtttagccagatccccagga

SEQ ID NO: 18564 - DNA, 20 bp, human
gcagggtgcagtcctgaatt

SEQ ID NO: 18565 - DNA, 20 bp, human
gggaaggcgtccagtgagca

SEQ ID NO: 18566 - DNA, 20 bp, human
ggccccagcgcggcaggaac

SEQ ID NO: 18567 - DNA, 20 bp, human
gcacgatgctgacacaccgt

SEQ ID NO: 18568 - DNA, 20 bp, human
ggcatcgtgctcccactccc

SEQ ID NO: 18569 - DNA, 20 bp, human
gccggatcgtgcgagagaag

SEQ ID NO: 18570 - DNA, 20 bp, human
gagcaagtcccgagttccta

SEQ ID NO: 18571 - DNA, 20 bp, human
gcagcagctgctctagatga

SEQ ID NO: 18572 - DNA, 20 bp, human
gttcaaacgccttgaggata

SEQ ID NO: 18573 - DNA, 20 bp, human
gatgcctctctcccgggagt

SEQ ID NO: 18574 - DNA, 20 bp, human
ggatcgtgcgagagaagggg

SEQ ID NO: 18575 - DNA, 20 bp, human
gaggcgtgggagggacgaaa

SEQ ID NO: 18576 - DNA, 20 bp, human
gcgactatgggagctccggg

SEQ ID NO: 18577 - DNA, 20 bp, human
gtacggaccgtgaactggag

SEQ ID NO: 18578 - DNA, 20 bp, human
gtcgcgactatgggagctcc

SEQ ID NO: 18579 - DNA, 20 bp, human
gggaagtacggaccgtgaac

SEQ ID NO: 18580 - DNA, 20 bp, human
gggagtggaatcgcgactat

SEQ ID NO: 18581 - DNA, 20 bp, human
gaagatcaaccggccccgaa

SEQ ID NO: 18582 - DNA, 20 bp, human
ggctgctccggagctctgca

SEQ ID NO: 18583 - DNA, 20 bp, human
gcggggctgtgatagaccaa

SEQ ID NO: 18584 - DNA, 20 bp, human
gccgaacggtgactgtgtgg

SEQ ID NO: 18585 - DNA, 20 bp, human
ggcataagcgtcagtgcaca

SEQ ID NO: 18586 - DNA, 20 bp, human
gacaggaccccggagagtcc

SEQ ID NO: 18587 - DNA, 20 bp, human
ggggaaacgtgctcacccga

SEQ ID NO: 18588 - DNA, 20 bp, human
gggtcctgtgagctgccgtc

SEQ ID NO: 18589 - DNA, 20 bp, human
gaccatgccaggactctccg

SEQ ID NO: 18590 - DNA, 20 bp, human
ggtgggcccagcggagagtc

SEQ ID NO: 18591 - DNA, 20 bp, human
gtcacccgacggcagctcac

SEQ ID NO: 18592 - DNA, 20 bp, human
gctctccgctgggcccacga

SEQ ID NO: 18593 - DNA, 20 bp, human
ggtcgcaatgctgggcgcag

SEQ ID NO: 18594 - DNA, 20 bp, human
gttctccttcgtgggcccag

SEQ ID NO: 18595 - DNA, 20 bp, human
gtcgcaggagctccagtccg

SEQ ID NO: 18596 - DNA, 20 bp, human
gagatactcgtagtccggta

SEQ ID NO: 18597 - DNA, 20 bp, human
gcggagagagacggcaacct

SEQ ID NO: 18598 - DNA, 20 bp, human
gggtcaaaggatgctgagtc

SEQ ID NO: 18599 - DNA, 20 bp, human
gttgaagccaccccggtcaa

SEQ ID NO: 18600 - DNA, 20 bp, human
gcagcatcctttgaccgggg

SEQ ID NO: 18601 - DNA, 20 bp, human
gccggtagggctaggcgctc

SEQ ID NO: 18602 - DNA, 20 bp, human
gcttcaaagctccagctctc

SEQ ID NO: 18603 - DNA, 20 bp, human
gctcgtagtccggtagggct

SEQ ID NO: 18604 - DNA, 20 bp, human
gtggagctttgaagccaccc

SEQ ID NO: 18605 - DNA, 20 bp, human
gattattgatatgctggtag

SEQ ID NO: 18606 - DNA, 20 bp, human
gccagctgcccggagagcca

SEQ ID NO: 18607 - DNA, 20 bp, human
gagggctcgataggaggtgg

SEQ ID NO: 18608 - DNA, 20 bp, human
gtccgaggtgcagccccaac

SEQ ID NO: 18609 - DNA, 20 bp, human
ggctctccgggcagctggag

SEQ ID NO: 18610 - DNA, 20 bp, human
gcagcagaagccctggtccg

SEQ ID NO: 18611 - DNA, 20 bp, human
gagagccagggctcgatagg

SEQ ID NO: 18612 - DNA, 20 bp, human
gcggagagccagggctcgat

SEQ ID NO: 18613 - DNA, 20 bp, human
gaggaggaggaggcaccaaa

SEQ ID NO: 18614 - DNA, 20 bp, human
ggggacaaggaggcacaccc

SEQ ID NO: 18615 - DNA, 20 bp, human
gggtcgcgctgcgcctgttg

SEQ ID NO: 18616 - DNA, 20 bp, human
gcatggcgctctgtctccaa

SEQ ID NO: 18617 - DNA, 20 bp, human
gtgggaaaccgggtctgctg

SEQ ID NO: 18618 - DNA, 20 bp, human
gcagagcgccatgggaaacc

SEQ ID NO: 18619 - DNA, 20 bp, human
gggtctgctgcggaggaagc

SEQ ID NO: 18620 - DNA, 20 bp, human
ggttggaacaaggaggtacc

SEQ ID NO: 18621 - DNA, 20 bp, human
gtctaaggcctcctgaaagg

SEQ ID NO: 18622 - DNA, 20 bp, human
gcacttggctctgtcttcta

SEQ ID NO: 18623 - DNA, 20 bp, human
gtgccgcggaaagctcaacc

SEQ ID NO: 18624 - DNA, 20 bp, human
gtagaggccccgaaaatcag

SEQ ID NO: 18625 - DNA, 20 bp, human
gtcttctaaggcctcctgaa

SEQ ID NO: 18626 - DNA, 20 bp, human
gtccctgtgagtcctccgca

SEQ ID NO: 18627 - DNA, 20 bp, human
ggccctgcggaggactcaca

SEQ ID NO: 18628 - DNA, 20 bp, human
ggaggccggtagtctccgta

SEQ ID NO: 18629 - DNA, 20 bp, human
gggagccctacggagactac

SEQ ID NO: 18630 - DNA, 20 bp, human
gagtctccgtagggctcctg

SEQ ID NO: 18631 - DNA, 20 bp, human
gacccggatgccaagcacag

SEQ ID NO: 18632 - DNA, 20 bp, human
gatgccaggacaccctccga

SEQ ID NO: 18633 - DNA, 20 bp, human
gcgactggcactaacagggt

SEQ ID NO: 18634 - DNA, 20 bp, human
gcggaggactcacagggaaa

SEQ ID NO: 18635 - DNA, 20 bp, human
ggcagcctctggagtctaca

SEQ ID NO: 18636 - DNA, 20 bp, human
gaggcgaagatccggactct

SEQ ID NO: 18637 - DNA, 20 bp, human
gccactcacctaaacggtca

SEQ ID NO: 18638 - DNA, 20 bp, human
gtagcaaaacacccagagtc

SEQ ID NO: 18639 - DNA, 20 bp, human
gagggaggactgactaacgt

SEQ ID NO: 18640 - DNA, 20 bp, human
gcaactcctgggaggcagaa

SEQ ID NO: 18641 - DNA, 20 bp, human
gaggagacctgggcgtgcta

SEQ ID NO: 18642 - DNA, 20 bp, human
gtagctcgcgtattctgagg

SEQ ID NO: 18643 - DNA, 20 bp, human
gatgttagccaactcctggg

SEQ ID NO: 18644 - DNA, 20 bp, human
ggacatgttagccaactcct

SEQ ID NO: 18645 - DNA, 20 bp, human
gcgaaacaggtgcaaaagtg

SEQ ID NO: 18646 - DNA, 20 bp, human
ggaggctgcggcgcacggta

SEQ ID NO: 18647 - DNA, 20 bp, human
gtgagggcagagtaaccagt

SEQ ID NO: 18648 - DNA, 20 bp, human
ggtctgggctgggggaaacg

SEQ ID NO: 18649 - DNA, 20 bp, human
gccaaggagtcagggctcaa

SEQ ID NO: 18650 - DNA, 20 bp, human
gccaggaagccaaggagtca

SEQ ID NO: 18651 - DNA, 20 bp, human
ggggccccagaaagtatcta

SEQ ID NO: 18652 - DNA, 20 bp, human
gtcagcctccggcctcagtc

SEQ ID NO: 18653 - DNA, 20 bp, human
ggaaaacgcagccttcccac

SEQ ID NO: 18654 - DNA, 20 bp, human
ggagatctgcctgtcggtct

SEQ ID NO: 18655 - DNA, 20 bp, human
gcctctaggacgaaccccgg

SEQ ID NO: 18656 - DNA, 20 bp, human
ggccgcaacggtgacgactg

SEQ ID NO: 18657 - DNA, 20 bp, human
ggagagccggagacctgcgt

SEQ ID NO: 18658 - DNA, 20 bp, human
ggcagcttacaatccgccaa

SEQ ID NO: 18659 - DNA, 20 bp, human
gggagacctgcgtaggaagg

SEQ ID NO: 18660 - DNA, 20 bp, human
gtgtggcagagaaggcccgg

SEQ ID NO: 18661 - DNA, 20 bp, human
gacagaacgcagagcccctc

SEQ ID NO: 18662 - DNA, 20 bp, human
ggcgctgcttgggcccttgg

SEQ ID NO: 18663 - DNA, 20 bp, human
gtgcgtaggaagggggattg

SEQ ID NO: 18664 - DNA, 20 bp, human
ggcctggagtaggccgggaa

SEQ ID NO: 18665 - DNA, 20 bp, human
gccctcataaagattaaggg

SEQ ID NO: 18666 - DNA, 20 bp, human
ggccggaagctgcccagggg

SEQ ID NO: 18667 - DNA, 20 bp, human
gccgcggccgcgacccggac

SEQ ID NO: 18668 - DNA, 20 bp, human
gggagcgccgggcaggtgac

SEQ ID NO: 18669 - DNA, 20 bp, human
ggttcctcaggaacaagcaa

SEQ ID NO: 18670 - DNA, 20 bp, human
gaaaaccgaacgcctcccct

SEQ ID NO: 18671 - DNA, 20 bp, human
ggaggatgcggggcccgtcc

SEQ ID NO: 18672 - DNA, 20 bp, human
ggcgccgggcaggtgacggg

SEQ ID NO: 18673 - DNA, 20 bp, human
gcgcccaccccagatccggg

SEQ ID NO: 18674 - DNA, 20 bp, human
gcggtggcctcccggatctg

SEQ ID NO: 18675 - DNA, 20 bp, human
ggaacaaggcctgtcacaag

SEQ ID NO: 18676 - DNA, 20 bp, human
ggtagtacgcgctgagagaa

SEQ ID NO: 18677 - DNA, 20 bp, human
gcgggccagcagcgattggt

SEQ ID NO: 18678 - DNA, 20 bp, human
gacgttacctaggagtccag

SEQ ID NO: 18679 - DNA, 20 bp, human
gcgcccgggccagcagcgat

SEQ ID NO: 18680 - DNA, 20 bp, human
ggcagcgattggtaggtgaa

SEQ ID NO: 18681 - DNA, 20 bp, human
gctcaaaccagtgggcacaa

SEQ ID NO: 18682 - DNA, 20 bp, human
gcagtgggcacaaaggctac

SEQ ID NO: 18683 - DNA, 20 bp, human
gtaggagtccagcggcgccc

SEQ ID NO: 18684 - DNA, 20 bp, human
gcccgacgcaacttcaccga

SEQ ID NO: 18685 - DNA, 20 bp, human
gcggtcagcgggaaggtgga

SEQ ID NO: 18686 - DNA, 20 bp, human
gtcccgaggccggctctgta

SEQ ID NO: 18687 - DNA, 20 bp, human
ggtgcgctggcatttaatag

SEQ ID NO: 18688 - DNA, 20 bp, human
gggcccgtgggcgttaatgg

SEQ ID NO: 18689 - DNA, 20 bp, human
gaggtggcgcggcgctaaga

SEQ ID NO: 18690 - DNA, 20 bp, human
ggagcacagctcgggcccgt

SEQ ID NO: 18691 - DNA, 20 bp, human
gcacgttcgcgcagctcccg

SEQ ID NO: 18692 - DNA, 20 bp, human
gggttcccagactcgaacca

SEQ ID NO: 18693 - DNA, 20 bp, human
gccgataacgcctgcctggg

SEQ ID NO: 18694 - DNA, 20 bp, human
gagttgttgttgaggtggcg

SEQ ID NO: 18695 - DNA, 20 bp, human
gtatagacaggcgcagccac

SEQ ID NO: 18696 - DNA, 20 bp, human
gtccatgctgggcagaatca

SEQ ID NO: 18697 - DNA, 20 bp, human
ggagagcacgatggctactg

SEQ ID NO: 18698 - DNA, 20 bp, human
gcgccagtggtgaggaaccg

SEQ ID NO: 18699 - DNA, 20 bp, human
gtccttccgataggactgaa

SEQ ID NO: 18700 - DNA, 20 bp, human
gctggggagctcggggactt

SEQ ID NO: 18701 - DNA, 20 bp, human
gctcggctgggtggatgcct

SEQ ID NO: 18702 - DNA, 20 bp, human
gatggctactggggagctcg

SEQ ID NO: 18703 - DNA, 20 bp, human
gcatcgtgctctcggctggg

SEQ ID NO: 18704 - DNA, 20 bp, human
gcgccgcgtctccatggaaa

SEQ ID NO: 18705 - DNA, 20 bp, human
gccattctgagtgaaccctg

SEQ ID NO: 18706 - DNA, 20 bp, human
gcttaggagatcgggttcaa

SEQ ID NO: 18707 - DNA, 20 bp, human
gcaacggcagggattgggta

SEQ ID NO: 18708 - DNA, 20 bp, human
gcctgtcctccggtgatcag

SEQ ID NO: 18709 - DNA, 20 bp, human
gtagtcatcgggtccgacac

SEQ ID NO: 18710 - DNA, 20 bp, human
gcttccgcaggctcagttat

SEQ ID NO: 18711 - DNA, 20 bp, human
gagagccgtcgagtggatgg

SEQ ID NO: 18712 - DNA, 20 bp, human
gggtggcggccggagcccaa

SEQ ID NO: 18713 - DNA, 20 bp, human
ggccgccaccatccactcga

SEQ ID NO: 18714 - DNA, 20 bp, human
gcgggccgagagccgtcgag

SEQ ID NO: 18715 - DNA, 20 bp, human
gctgctcctctgatcaccgg

SEQ ID NO: 18716 - DNA, 20 bp, human
ggccggcgactaggagtcct

SEQ ID NO: 18717 - DNA, 20 bp, human
gaccgggtgatatcaggaag

SEQ ID NO: 18718 - DNA, 20 bp, human
gagaaggtcagagttcgcgg

SEQ ID NO: 18719 - DNA, 20 bp, human
gtggcccagtcactatgtag

SEQ ID NO: 18720 - DNA, 20 bp, human
ggatgggaccgggtgatatc

SEQ ID NO: 18721 - DNA, 20 bp, human
gcataaggctgagtgaccaa

SEQ ID NO: 18722 - DNA, 20 bp, human
gcctccactacatagtgact

SEQ ID NO: 18723 - DNA, 20 bp, human
gtgggctgcttaggaagaga

SEQ ID NO: 18724 - DNA, 20 bp, human
gtcagagttcgcgggggcag

SEQ ID NO: 18725 - DNA, 20 bp, human
ggaaggggtcaggataccga

SEQ ID NO: 18726 - DNA, 20 bp, human
ggcacctccagggtcgtcag

SEQ ID NO: 18727 - DNA, 20 bp, human
gagaggctccagcaatacca

SEQ ID NO: 18728 - DNA, 20 bp, human
gtggggcgggaggttgaagg

SEQ ID NO: 18729 - DNA, 20 bp, human
gcggttctgtaagacagtca

SEQ ID NO: 18730 - DNA, 20 bp, human
gaggtgcgaagtgactagac

SEQ ID NO: 18731 - DNA, 20 bp, human
gagtgactagacgggagcaa

SEQ ID NO: 18732 - DNA, 20 bp, human
ggagcaaaggaggaaaacta

SEQ ID NO: 18733 - DNA, 20 bp, human
gacacccctgacgaccctgg

SEQ ID NO: 18734 - DNA, 20 bp, human
gcgcagtctgaagggactcc

SEQ ID NO: 18735 - DNA, 20 bp, human
ggttcaaaagtccccaggag

SEQ ID NO: 18736 - DNA, 20 bp, human
gagcaccggcggacacccag

SEQ ID NO: 18737 - DNA, 20 bp, human
gcatgccgcgcagggaacag

SEQ ID NO: 18738 - DNA, 20 bp, human
gcgcgcgcgcgggaagggat

SEQ ID NO: 18739 - DNA, 20 bp, human
gacgccctctctccagccta

SEQ ID NO: 18740 - DNA, 20 bp, human
ggagccgtaggctggagaga

SEQ ID NO: 18741 - DNA, 20 bp, human
gcgggcgtgggcgtggactc

SEQ ID NO: 18742 - DNA, 20 bp, human
gcagtgcagactgggagcga

SEQ ID NO: 18743 - DNA, 20 bp, human
gcctacggctcagaaagctg

SEQ ID NO: 18744 - DNA, 20 bp, human
gtgggcgtggactcgggcgt

SEQ ID NO: 18745 - DNA, 20 bp, human
gagtcggggcgccaggacag

SEQ ID NO: 18746 - DNA, 20 bp, human
ggacgcacagtgactcggac

SEQ ID NO: 18747 - DNA, 20 bp, human
ggccgaactcagtagcacgc

SEQ ID NO: 18748 - DNA, 20 bp, human
ggccggcgtgctactgagtt

SEQ ID NO: 18749 - DNA, 20 bp, human
gtcacctgggggagaagacc

SEQ ID NO: 18750 - DNA, 20 bp, human
ggagtcactgtgcgtcgcct

SEQ ID NO: 18751 - DNA, 20 bp, human
gcacgtactactctgcacag

SEQ ID NO: 18752 - DNA, 20 bp, human
gcgcgggagattcgattgga

SEQ ID NO: 18753 - DNA, 20 bp, human
ggaagagccggagactccta

SEQ ID NO: 18754 - DNA, 20 bp, human
ggagtagtacgtgctgaaag

SEQ ID NO: 18755 - DNA, 20 bp, human
gaggacgcgggagattcgat

SEQ ID NO: 18756 - DNA, 20 bp, human
gtggccgcctgcacagccag

SEQ ID NO: 18757 - DNA, 20 bp, human
gcaaggtccggcgcccacgg

SEQ ID NO: 18758 - DNA, 20 bp, human
gcagccagcggagcgcccac

SEQ ID NO: 18759 - DNA, 20 bp, human
ggcgcccacggaggcaagtc

SEQ ID NO: 18760 - DNA, 20 bp, human
gtcgcaggagctccagtccg

SEQ ID NO: 18761 - DNA, 20 bp, human
gggaggcaagtccggtctca

SEQ ID NO: 18762 - DNA, 20 bp, human
gggaggaagaactggatggt

SEQ ID NO: 18763 - DNA, 20 bp, human
gtctcacggtgacctcccgc

SEQ ID NO: 18764 - DNA, 20 bp, human
ggctcccgtgggcgctccgc

SEQ ID NO: 18765 - DNA, 20 bp, human
gctctccgctgggcccacga

SEQ ID NO: 18766 - DNA, 20 bp, human
gtgggccccaaggctgaagg

SEQ ID NO: 18767 - DNA, 20 bp, human
gggcccgagccgatgctcag

SEQ ID NO: 18768 - DNA, 20 bp, human
gccgacgcgccgaggtctcg

SEQ ID NO: 18769 - DNA, 20 bp, human
gctcggcgcgtcgggagccc

SEQ ID NO: 18770 - DNA, 20 bp, human
gggccgtccctccccagtcg

SEQ ID NO: 18771 - DNA, 20 bp, human
gacgcgccgaggtctcgggg

SEQ ID NO: 18772 - DNA, 20 bp, human
gcggccgtgggcgatagcag

SEQ ID NO: 18773 - DNA, 20 bp, human
gccggccccgcaccgtgacg

SEQ ID NO: 18774 - DNA, 20 bp, human
ggcggggagggctcaatccg

SEQ ID NO: 18775 - DNA, 20 bp, human
gagatccgagagggaaacct

SEQ ID NO: 18776 - DNA, 20 bp, human
gcgtgcgcagaaggcctggt

SEQ ID NO: 18777 - DNA, 20 bp, human
ggccactgcagggctcccac

SEQ ID NO: 18778 - DNA, 20 bp, human
ggcgtgcgaggtagaccggg

SEQ ID NO: 18779 - DNA, 20 bp, human
gcagctcctaagcaacttcg

SEQ ID NO: 18780 - DNA, 20 bp, human
gctgcagggctcccacgggg

SEQ ID NO: 18781 - DNA, 20 bp, human
gtgcaggccgtgccactgca

SEQ ID NO: 18782 - DNA, 20 bp, human
gcacccagcaagctcgccca

SEQ ID NO: 18783 - DNA, 20 bp, human
gccacctggggctgaggtaa

SEQ ID NO: 18784 - DNA, 20 bp, human
gacgagccccgaagttgctt

SEQ ID NO: 18785 - DNA, 20 bp, human
gggtcactcgcccgaaggag

SEQ ID NO: 18786 - DNA, 20 bp, human
gcctgttcccatggctccgg

SEQ ID NO: 18787 - DNA, 20 bp, human
gggtcccagggcctcgagag

SEQ ID NO: 18788 - DNA, 20 bp, human
gggagggtaccacagcaggt

SEQ ID NO: 18789 - DNA, 20 bp, human
gaggcactgggccacctcag

SEQ ID NO: 18790 - DNA, 20 bp, human
gcggcccctcagcaagacac

SEQ ID NO: 18791 - DNA, 20 bp, human
gctgtgggctgaaggatgga

SEQ ID NO: 18792 - DNA, 20 bp, human
ggggccagtgtcttgctgag

SEQ ID NO: 18793 - DNA, 20 bp, human
gggctcctgcagctttccat

SEQ ID NO: 18794 - DNA, 20 bp, human
gggcagctcggttgtcatct

SEQ ID NO: 18795 - DNA, 20 bp, human
gcctctgaaacgtggctctg

SEQ ID NO: 18796 - DNA, 20 bp, human
ggcggtccaggtaagagaca

SEQ ID NO: 18797 - DNA, 20 bp, human
gcgccggctggctgcaagga

SEQ ID NO: 18798 - DNA, 20 bp, human
gcaggctactgccaagttgg

SEQ ID NO: 18799 - DNA, 20 bp, human
gcgccactgcagccgcgcgg

SEQ ID NO: 18800 - DNA, 20 bp, human
ggtagcctgcttctttctag

SEQ ID NO: 18801 - DNA, 20 bp, human
gcgcaagcaagccagggcag

SEQ ID NO: 18802 - DNA, 20 bp, human
ggcagaaagcgtggagtgaa

SEQ ID NO: 18803 - DNA, 20 bp, human
gctggagctatggccagggg

SEQ ID NO: 18804 - DNA, 20 bp, human
gtgcagccagccggcggtcc

SEQ ID NO: 18805 - DNA, 20 bp, human
gagagacaaggtgtgagtaa

SEQ ID NO: 18806 - DNA, 20 bp, human
ggacccagcgaagaacctag

SEQ ID NO: 18807 - DNA, 20 bp, human
gagcggccgaaaagagtccc

SEQ ID NO: 18808 - DNA, 20 bp, human
gtccacccgaaaaggatcag

SEQ ID NO: 18809 - DNA, 20 bp, human
gctgcaggccagttacggtg

SEQ ID NO: 18810 - DNA, 20 bp, human
gggtctggtgagtagaatag

SEQ ID NO: 18811 - DNA, 20 bp, human
gcaaataccagtaatcccgg

SEQ ID NO: 18812 - DNA, 20 bp, human
gatgtgccccccgggattac

SEQ ID NO: 18813 - DNA, 20 bp, human
gcccaggaaatgtgcccccc

SEQ ID NO: 18814 - DNA, 20 bp, human
gctgaggaaatgctatgtgt

SEQ ID NO: 18815 - DNA, 20 bp, human
gaagttggcatcttgttccg

SEQ ID NO: 18816 - DNA, 20 bp, human
ggcgccccgcccgccttcag

SEQ ID NO: 18817 - DNA, 20 bp, human
gtcgaggggcaggggaccag

SEQ ID NO: 18818 - DNA, 20 bp, human
gagggagctagggcaggcta

SEQ ID NO: 18819 - DNA, 20 bp, human
ggaagcgcagaggctcgtag

SEQ ID NO: 18820 - DNA, 20 bp, human
ggctagggcaggctaaggct

SEQ ID NO: 18821 - DNA, 20 bp, human
ggagatgccgcggtcgtaca

SEQ ID NO: 18822 - DNA, 20 bp, human
gtcgcagagctcctccgggt

SEQ ID NO: 18823 - DNA, 20 bp, human
gcaaccacctcaggccccgg

SEQ ID NO: 18824 - DNA, 20 bp, human
ggctgtgcgtgacctcgcca

SEQ ID NO: 18825 - DNA, 20 bp, human
ggtgagtagaagaagcgcag

SEQ ID NO: 18826 - DNA, 20 bp, human
gctgccagcatagggacgac

SEQ ID NO: 18827 - DNA, 20 bp, human
gcagtgccactgccaggatg

SEQ ID NO: 18828 - DNA, 20 bp, human
ggacttggggcacctcttag

SEQ ID NO: 18829 - DNA, 20 bp, human
gcactgtcagggatgggtag

SEQ ID NO: 18830 - DNA, 20 bp, human
gccaggacccgtgtaggaga

SEQ ID NO: 18831 - DNA, 20 bp, human
gtgggatgacaagcccctga

SEQ ID NO: 18832 - DNA, 20 bp, human
ggcgagaaccatctcctaca

SEQ ID NO: 18833 - DNA, 20 bp, human
gaggggcgtctccactgtca

SEQ ID NO: 18834 - DNA, 20 bp, human
ggtggctgcgagagttccag

SEQ ID NO: 18835 - DNA, 20 bp, human
gggctctgcacccccgggct

SEQ ID NO: 18836 - DNA, 20 bp, human
ggggcggccggccgcacgga

SEQ ID NO: 18837 - DNA, 20 bp, human
ggcggggcgcatgcacgggg

SEQ ID NO: 18838 - DNA, 20 bp, human
gtgccgcccgccggatcgag

SEQ ID NO: 18839 - DNA, 20 bp, human
gaccaccggagccggagcag

SEQ ID NO: 18840 - DNA, 20 bp, human
gcggcaggctgctcgctcgg

SEQ ID NO: 18841 - DNA, 20 bp, human
ggagcagcctgccgtccgtg

SEQ ID NO: 18842 - DNA, 20 bp, human
ggggcgcggggcgcatgcac

SEQ ID NO: 18843 - DNA, 20 bp, human
gcagacaggaatccccaccc

SEQ ID NO: 18844 - DNA, 20 bp, human
gccaggtggtctccctaatc

SEQ ID NO: 18845 - DNA, 20 bp, human
gtccgcgctgccgctcgatc

SEQ ID NO: 18846 - DNA, 20 bp, human
gacctcctggatctcgtcga

SEQ ID NO: 18847 - DNA, 20 bp, human
gaccttcgacgagatccagg

SEQ ID NO: 18848 - DNA, 20 bp, human
gacgggctgcgggaactcgt

SEQ ID NO: 18849 - DNA, 20 bp, human
ggcagcttggcgggccgcac

SEQ ID NO: 18850 - DNA, 20 bp, human
gcggccaggcacacgaagtg

SEQ ID NO: 18851 - DNA, 20 bp, human
gcgagccccgtgccccccga

SEQ ID NO: 18852 - DNA, 20 bp, human
gccaagcccggcgagctgat

SEQ ID NO: 18853 - DNA, 20 bp, human
ggctgtcgccgtctgccccg

SEQ ID NO: 18854 - DNA, 20 bp, human
ggggccggcgctcctcggga

SEQ ID NO: 18855 - DNA, 20 bp, human
gtagcccgcggctgcccaca

SEQ ID NO: 18856 - DNA, 20 bp, human
gtgcggtgccgggtatacag

SEQ ID NO: 18857 - DNA, 20 bp, human
gggtgccgggtatacagggg

SEQ ID NO: 18858 - DNA, 20 bp, human
gtaagaggccgcgcaggaat

SEQ ID NO: 18859 - DNA, 20 bp, human
gcggcagcagcagcgttaag

SEQ ID NO: 18860 - DNA, 20 bp, human
gtcccctacccggcgacacc

SEQ ID NO: 18861 - DNA, 20 bp, human
ggcatcctgcgaggtacaca

SEQ ID NO: 18862 - DNA, 20 bp, human
gcccgaatcgggacgcacaa

SEQ ID NO: 18863 - DNA, 20 bp, human
gcagcgttaagaggccgcgc

SEQ ID NO: 18864 - DNA, 20 bp, human
gggaggcaggagcgccgacc

SEQ ID NO: 18865 - DNA, 20 bp, human
gccataagcagctccctgca

SEQ ID NO: 18866 - DNA, 20 bp, human
gcggcggccggcacaacccc

SEQ ID NO: 18867 - DNA, 20 bp, human
gcgggcagtcgcggctccag

SEQ ID NO: 18868 - DNA, 20 bp, human
gatgtggagctggaagactg

SEQ ID NO: 18869 - DNA, 20 bp, human
ggcacaaccccgggcagtcg

SEQ ID NO: 18870 - DNA, 20 bp, human
gggtgcgcaagctccaatcg

SEQ ID NO: 18871 - DNA, 20 bp, human
gcagatgctaagaagtcagg

SEQ ID NO: 18872 - DNA, 20 bp, human
gcatcctgagaggacgcctc

SEQ ID NO: 18873 - DNA, 20 bp, human
ggtcaggcggaggctttcca

SEQ ID NO: 18874 - DNA, 20 bp, human
ggaggcggcctgggcggcag

SEQ ID NO: 18875 - DNA, 20 bp, human
gatgctaagaagtcaggcgg

SEQ ID NO: 18876 - DNA, 20 bp, human
gcgtgcgggtgactgcttca

SEQ ID NO: 18877 - DNA, 20 bp, human
ggcggcgcccggtccagtcg

SEQ ID NO: 18878 - DNA, 20 bp, human
gcaacaagcagtgcgaatgg

SEQ ID NO: 18879 - DNA, 20 bp, human
gtggagggcgtgctttcgag

SEQ ID NO: 18880 - DNA, 20 bp, human
ggtgcgtggcctgagccgtg

SEQ ID NO: 18881 - DNA, 20 bp, human
gcaaaagggagcatcaggta

SEQ ID NO: 18882 - DNA, 20 bp, human
gtccccagggaaacctacag

SEQ ID NO: 18883 - DNA, 20 bp, human
ggcttctccgcgactggacc

SEQ ID NO: 18884 - DNA, 20 bp, human
gaagggagcatcaggtacgg

SEQ ID NO: 18885 - DNA, 20 bp, human
ggcagtcacccgcacggctc

SEQ ID NO: 18886 - DNA, 20 bp, human
ggactgacaagatgtccctg

SEQ ID NO: 18887 - DNA, 20 bp, human
gtagagtttgggagtccaca

SEQ ID NO: 18888 - DNA, 20 bp, human
ggaatctgatgactcctcca

SEQ ID NO: 18889 - DNA, 20 bp, human
gccccatctggagtagagtt

SEQ ID NO: 18890 - DNA, 20 bp, human
gttaagggcacctccccatc

SEQ ID NO: 18891 - DNA, 20 bp, human
gcccaaactctactccagat

SEQ ID NO: 18892 - DNA, 20 bp, human
gaatattgcgagaagtaagg

SEQ ID NO: 18893 - DNA, 20 bp, human
ggaaaagacgcagaacatga

SEQ ID NO: 18894 - DNA, 20 bp, human
gttcctgcaatgaagctccc

SEQ ID NO: 18895 - DNA, 20 bp, human
gtctttgtgaattaactaga

SEQ ID NO: 18896 - DNA, 20 bp, human
gggcaggttgctccaggata

SEQ ID NO: 18897 - DNA, 20 bp, human
ggcgctcccagcgcaacccc

SEQ ID NO: 18898 - DNA, 20 bp, human
gtcgggcggactgtatctga

SEQ ID NO: 18899 - DNA, 20 bp, human
gctgccgggtgagtgaccaa

SEQ ID NO: 18900 - DNA, 20 bp, human
ggcccgagggcagcccgggt

SEQ ID NO: 18901 - DNA, 20 bp, human
ggccccgcgcgaccctatcc

SEQ ID NO: 18902 - DNA, 20 bp, human
gtccaggatagggtcgcgcg

SEQ ID NO: 18903 - DNA, 20 bp, human
gtccagccccgcgccaatgg

SEQ ID NO: 18904 - DNA, 20 bp, human
gcccgcgccaatggtggcaa

SEQ ID NO: 18905 - DNA, 20 bp, human
gacgcgcgagctcccagctc

SEQ ID NO: 18906 - DNA, 20 bp, human
ggtgagcccagaaccgagtg

SEQ ID NO: 18907 - DNA, 20 bp, human
gaggacttcggaactagacg

SEQ ID NO: 18908 - DNA, 20 bp, human
gcaacagagcggaggctctg

SEQ ID NO: 18909 - DNA, 20 bp, human
gcacacagccaacagagcgg

SEQ ID NO: 18910 - DNA, 20 bp, human
gtgtcagcgcgtcctgcact

SEQ ID NO: 18911 - DNA, 20 bp, human
gagcggactgcccaggactt

SEQ ID NO: 18912 - DNA, 20 bp, human
gaacggttgtcagtctgaaa

SEQ ID NO: 18913 - DNA, 20 bp, human
gagtatgtcggcaagtcagc

SEQ ID NO: 18914 - DNA, 20 bp, human
gctgaaagggcatcctcact

SEQ ID NO: 18915 - DNA, 20 bp, human
gtcagctggtttcccagtgc

SEQ ID NO: 18916 - DNA, 20 bp, human
ggggcctcctgacaacgtca

SEQ ID NO: 18917 - DNA, 20 bp, human
ggcttcagcaggatccccca

SEQ ID NO: 18918 - DNA, 20 bp, human
gcacggaaagaaggcagtag

SEQ ID NO: 18919 - DNA, 20 bp, human
gtccgccaggaactagaaag

SEQ ID NO: 18920 - DNA, 20 bp, human
gtgggaggttgggcctcagg

SEQ ID NO: 18921 - DNA, 20 bp, human
gtactcacagtggcccccac

SEQ ID NO: 18922 - DNA, 20 bp, human
gcctcaggcggtggaccaga

SEQ ID NO: 18923 - DNA, 20 bp, human
gagccgcagaggctgttggg

SEQ ID NO: 18924 - DNA, 20 bp, human
gaactagaaagaggagtcgt

SEQ ID NO: 18925 - DNA, 20 bp, human
gtagctggaaagaacttggt

SEQ ID NO: 18926 - DNA, 20 bp, human
gtcgccgggcaaccacaatg

SEQ ID NO: 18927 - DNA, 20 bp, human
ggacccgtctcggggcaggg

SEQ ID NO: 18928 - DNA, 20 bp, human
gtctacctcaccctgccagg

SEQ ID NO: 18929 - DNA, 20 bp, human
gagcgggtcgacccgtctcg

SEQ ID NO: 18930 - DNA, 20 bp, human
gcagcagagagcaaacggtc

SEQ ID NO: 18931 - DNA, 20 bp, human
gaaggagcggaggcaagcgg

SEQ ID NO: 18932 - DNA, 20 bp, human
ggtggtcgccggcccccgag

SEQ ID NO: 18933 - DNA, 20 bp, human
ggctgcagggtccctatccc

SEQ ID NO: 18934 - DNA, 20 bp, human
ggacgggtcgacccgctcgg

SEQ ID NO: 18935 - DNA, 20 bp, human
gcaagcggcggaacccgtcg

SEQ ID NO: 18936 - DNA, 20 bp, human
gagtgaggatagacccaagg

SEQ ID NO: 18937 - DNA, 20 bp, human
gttgcggtggttcaagatgg

SEQ ID NO: 18938 - DNA, 20 bp, human
gagtaacagcagtagcgatg

SEQ ID NO: 18939 - DNA, 20 bp, human
gtgggtgcgagaataccggg

SEQ ID NO: 18940 - DNA, 20 bp, human
ggtgcgagaataccgggagg

SEQ ID NO: 18941 - DNA, 20 bp, human
gggctgggtgcgagaatacc

SEQ ID NO: 18942 - DNA, 20 bp, human
gaatcgctcactgtgccact

SEQ ID NO: 18943 - DNA, 20 bp, human
gaacagcagtagcgatgcgg

SEQ ID NO: 18944 - DNA, 20 bp, human
gcctttgcggtggttcaaga

SEQ ID NO: 18945 - DNA, 20 bp, human
gacggcagccttcccagtgt

SEQ ID NO: 18946 - DNA, 20 bp, human
gggcaggctccagaccacct

SEQ ID NO: 18947 - DNA, 20 bp, human
gtccagaccacctgggtcgg

SEQ ID NO: 18948 - DNA, 20 bp, human
ggcatctgagaggctggtcg

SEQ ID NO: 18949 - DNA, 20 bp, human
gtcagatgccaccactctcc

SEQ ID NO: 18950 - DNA, 20 bp, human
gatgccaccactctcccggc

SEQ ID NO: 18951 - DNA, 20 bp, human
ggtcgcaccagggcgtgagg

SEQ ID NO: 18952 - DNA, 20 bp, human
ggccgcccccgagacacccg

SEQ ID NO: 18953 - DNA, 20 bp, human
gacctgcggaggtcgcacca

SEQ ID NO: 18954 - DNA, 20 bp, human
ggcctccgacccaggtggtc

SEQ ID NO: 18955 - DNA, 20 bp, human
gagaggctggtcgtggactg

SEQ ID NO: 18956 - DNA, 20 bp, human
gggtgggcgacgaacaactc

SEQ ID NO: 18957 - DNA, 20 bp, human
gagggaagcatggaggtcca

SEQ ID NO: 18958 - DNA, 20 bp, human
gctcctgaggaatcccgggt

SEQ ID NO: 18959 - DNA, 20 bp, human
gaggcttgagggaagcatgg

SEQ ID NO: 18960 - DNA, 20 bp, human
gcatccgggcctgagagtgc

SEQ ID NO: 18961 - DNA, 20 bp, human
gggcatgggccgcacacgtg

SEQ ID NO: 18962 - DNA, 20 bp, human
gaacaactcgggctagcctt

SEQ ID NO: 18963 - DNA, 20 bp, human
gcgggcagggagccaccggc

SEQ ID NO: 18964 - DNA, 20 bp, human
gcgggctccgtaccctcgag

SEQ ID NO: 18965 - DNA, 20 bp, human
gaggcccggatgcaggaaaa

SEQ ID NO: 18966 - DNA, 20 bp, human
gaggctgccgggagcagact

SEQ ID NO: 18967 - DNA, 20 bp, human
gggcatggcccctacgcgcc

SEQ ID NO: 18968 - DNA, 20 bp, human
ggcaccttcaagcaggtcag

SEQ ID NO: 18969 - DNA, 20 bp, human
ggcgtagggcggggtcacgt

SEQ ID NO: 18970 - DNA, 20 bp, human
gagggaaggggtaggaagac

SEQ ID NO: 18971 - DNA, 20 bp, human
gggaggaaggtaacgaagga

SEQ ID NO: 18972 - DNA, 20 bp, human
gtggggctgccgggcgcgta

SEQ ID NO: 18973 - DNA, 20 bp, human
gcggccactgacctgcttga

SEQ ID NO: 18974 - DNA, 20 bp, human
gtcacgtggggctgcgccca

SEQ ID NO: 18975 - DNA, 20 bp, human
gcgcgccgggatggtgaacc

SEQ ID NO: 18976 - DNA, 20 bp, human
ggaggtagcccgcagtgcag

SEQ ID NO: 18977 - DNA, 20 bp, human
gcggagccgcgtcccgtcgg

SEQ ID NO: 18978 - DNA, 20 bp, human
gtcccggagccgcgtcccgt

SEQ ID NO: 18979 - DNA, 20 bp, human
gggacgcggctccgggaaca

SEQ ID NO: 18980 - DNA, 20 bp, human
gcgcggcgcggggccaccga

SEQ ID NO: 18981 - DNA, 20 bp, human
gcggggccaccgacgggacg

SEQ ID NO: 18982 - DNA, 20 bp, human
gcggtacccagacaagtctg

SEQ ID NO: 18983 - DNA, 20 bp, human
ggcgaagcgagccatgttcc

SEQ ID NO: 18984 - DNA, 20 bp, human
ggtgaggcccggaggagcaa

SEQ ID NO: 18985 - DNA, 20 bp, human
gtgttgtccggcagtgagta

SEQ ID NO: 18986 - DNA, 20 bp, human
gagtagaatgaagggagata

SEQ ID NO: 18987 - DNA, 20 bp, human
gtttgcagaaacgctgaaag

SEQ ID NO: 18988 - DNA, 20 bp, human
gctgatagcctgaaagactg

SEQ ID NO: 18989 - DNA, 20 bp, human
ggaactatcagtgtgtaagg

SEQ ID NO: 18990 - DNA, 20 bp, human
ggtaatatactgtcaacagg

SEQ ID NO: 18991 - DNA, 20 bp, human
gaacaggaggtcagttttaa

SEQ ID NO: 18992 - DNA, 20 bp, human
gtgcgtaatatactgtcaac

SEQ ID NO: 18993 - DNA, 20 bp, human
gatcttatatttgtaaaatc

SEQ ID NO: 18994 - DNA, 20 bp, human
gaatctttttagtagaatga

SEQ ID NO: 18995 - DNA, 20 bp, human
gtttaattccacatgcataa

SEQ ID NO: 18996 - DNA, 20 bp, human
gggagtcgcagaatgtgggg

SEQ ID NO: 18997 - DNA, 20 bp, human
gccaccaggtctggacccgt

SEQ ID NO: 18998 - DNA, 20 bp, human
gtcaccgacgggtccagacc

SEQ ID NO: 18999 - DNA, 20 bp, human
gggcacaggctacgtgtgaa

SEQ ID NO: 19000 - DNA, 20 bp, human
gggcactggcgaaagctcag

SEQ ID NO: 19001 - DNA, 20 bp, human
gcgagccaagatgctcaggt

SEQ ID NO: 19002 - DNA, 20 bp, human
gtagcctgtgccggctcctc

SEQ ID NO: 19003 - DNA, 20 bp, human
gtcacccgaggagccggcac

SEQ ID NO: 19004 - DNA, 20 bp, human
gcctgagtgagtggcaccag

SEQ ID NO: 19005 - DNA, 20 bp, human
gccaaaaatgcagggacctc

SEQ ID NO: 19006 - DNA, 20 bp, human
gtgtgagatggggctcaaat

SEQ ID NO: 19007 - DNA, 20 bp, human
gctcaaataggaaaaagtct

SEQ ID NO: 19008 - DNA, 20 bp, human
gaggttgatatgggaacagg

SEQ ID NO: 19009 - DNA, 20 bp, human
gccaagcagggtaagtttct

SEQ ID NO: 19010 - DNA, 20 bp, human
gggaaaaagtctaggggtga

SEQ ID NO: 19011 - DNA, 20 bp, human
gtaatttggggaaccaagca

SEQ ID NO: 19012 - DNA, 20 bp, human
gtgttactgacaaagactat

SEQ ID NO: 19013 - DNA, 20 bp, human
gacaggaggctgttgtgaga

SEQ ID NO: 19014 - DNA, 20 bp, human
gcatggttaactaaggatag

SEQ ID NO: 19015 - DNA, 20 bp, human
gtgggagggaaacttctcaa

SEQ ID NO: 19016 - DNA, 20 bp, human
gtctgacggagagctcgagg

SEQ ID NO: 19017 - DNA, 20 bp, human
gccggggcgcgtcaatatgg

SEQ ID NO: 19018 - DNA, 20 bp, human
gaggtggtagagtcgtctga

SEQ ID NO: 19019 - DNA, 20 bp, human
gagacgactctaccacctcg

SEQ ID NO: 19020 - DNA, 20 bp, human
ggggccggggcgcgtcaata

SEQ ID NO: 19021 - DNA, 20 bp, human
gcggccagaggagggacccc

SEQ ID NO: 19022 - DNA, 20 bp, human
gtcgtctgacggagagctcg

SEQ ID NO: 19023 - DNA, 20 bp, human
gtccagcggcccataaaaca

SEQ ID NO: 19024 - DNA, 20 bp, human
gttcagcgttgcggacgcag

SEQ ID NO: 19025 - DNA, 20 bp, human
gtcgaagtcgcggtggaggt

SEQ ID NO: 19026 - DNA, 20 bp, human
gggaccgcgtcgtagacctc

SEQ ID NO: 19027 - DNA, 20 bp, human
gccgcgtcgtagacctcggg

SEQ ID NO: 19028 - DNA, 20 bp, human
gggagcgcagtgagaactcc

SEQ ID NO: 19029 - DNA, 20 bp, human
gcctggtgagcggcgcgggt

SEQ ID NO: 19030 - DNA, 20 bp, human
gcccgcccaagtccatccgg

SEQ ID NO: 19031 - DNA, 20 bp, human
gcagccctccccgcgcagga

SEQ ID NO: 19032 - DNA, 20 bp, human
gcagtgagaactcccggctg

SEQ ID NO: 19033 - DNA, 20 bp, human
gagaggaggcgacgcgtggc

SEQ ID NO: 19034 - DNA, 20 bp, human
gccgcaggaacacatccagg

SEQ ID NO: 19035 - DNA, 20 bp, human
ggacgtcgtggccattgacc

SEQ ID NO: 19036 - DNA, 20 bp, human
ggaacagacagcgggcccag

SEQ ID NO: 19037 - DNA, 20 bp, human
gtgggaacggttgtaggacg

SEQ ID NO: 19038 - DNA, 20 bp, human
gtctgaagctctaggttcag

SEQ ID NO: 19039 - DNA, 20 bp, human
gggcgtcggagaacagacag

SEQ ID NO: 19040 - DNA, 20 bp, human
gccagggaggcgtcccgggt

SEQ ID NO: 19041 - DNA, 20 bp, human
ggaagctctaggttcagcgg

SEQ ID NO: 19042 - DNA, 20 bp, human
ggtttcctttccgctcccag

SEQ ID NO: 19043 - DNA, 20 bp, human
gtggcgcgcagtggtcctcg

SEQ ID NO: 19044 - DNA, 20 bp, human
gcgccagaagcatcccaggg

SEQ ID NO: 19045 - DNA, 20 bp, human
gatagggcgtctgaagctct

SEQ ID NO: 19046 - DNA, 20 bp, human
gacggtcctgtctctcgagt

SEQ ID NO: 19047 - DNA, 20 bp, human
gacgttgagccgtccgagaa

SEQ ID NO: 19048 - DNA, 20 bp, human
gtgcctccaactcgagagac

SEQ ID NO: 19049 - DNA, 20 bp, human
ggtcctgtctctcgagttgg

SEQ ID NO: 19050 - DNA, 20 bp, human
gaagatagctgctaactgag

SEQ ID NO: 19051 - DNA, 20 bp, human
gtcggacggctcaacgtacc

SEQ ID NO: 19052 - DNA, 20 bp, human
gcaatctgcgactctaatac

SEQ ID NO: 19053 - DNA, 20 bp, human
gagtcgcagattgcttatat

SEQ ID NO: 19054 - DNA, 20 bp, human
gagaatgtaccgttctcgga

SEQ ID NO: 19055 - DNA, 20 bp, human
gacgtactaggcgctcacat

SEQ ID NO: 19056 - DNA, 20 bp, human
gggcgcagctcgggacgtgg

SEQ ID NO: 19057 - DNA, 20 bp, human
ggaggcgacgcgctcccctc

SEQ ID NO: 19058 - DNA, 20 bp, human
gccgctcgaaagcaggaaat

SEQ ID NO: 19059 - DNA, 20 bp, human
gcgagagctacggggatgag

SEQ ID NO: 19060 - DNA, 20 bp, human
ggaaaagcggcggtgtcctg

SEQ ID NO: 19061 - DNA, 20 bp, human
gtctgaagagagaaaagcgg

SEQ ID NO: 19062 - DNA, 20 bp, human
gggggcagtccagaaccagt

SEQ ID NO: 19063 - DNA, 20 bp, human
gaggcacgggaccacgcgga

SEQ ID NO: 19064 - DNA, 20 bp, human
gcgctccctccactgcccga

SEQ ID NO: 19065 - DNA, 20 bp, human
gagtagtttgtgctgttggt

SEQ ID NO: 19066 - DNA, 20 bp, human
ggaacgttgagggcacgagt

SEQ ID NO: 19067 - DNA, 20 bp, human
gacgccgaagggctccgagg

SEQ ID NO: 19068 - DNA, 20 bp, human
ggatatccaaatcacctcag

SEQ ID NO: 19069 - DNA, 20 bp, human
gacggcgcgtgcgcagatca

SEQ ID NO: 19070 - DNA, 20 bp, human
ggattgcgaatcctccgctg

SEQ ID NO: 19071 - DNA, 20 bp, human
ggatatccctagaacgttga

SEQ ID NO: 19072 - DNA, 20 bp, human
ggcttgcatgaccctgacat

SEQ ID NO: 19073 - DNA, 20 bp, human
gcgagtcgggtcctgagacc

SEQ ID NO: 19074 - DNA, 20 bp, human
gatccaaatcacctcagcgg

SEQ ID NO: 19075 - DNA, 20 bp, human
gaggcccaaggcgaaacgga

SEQ ID NO: 19076 - DNA, 20 bp, human
ggaggccgaggagagccacg

SEQ ID NO: 19077 - DNA, 20 bp, human
gagctggggcgcagctcgca

SEQ ID NO: 19078 - DNA, 20 bp, human
ggaacggtgggaggagatct

SEQ ID NO: 19079 - DNA, 20 bp, human
gagccacgtgggtcgagctg

SEQ ID NO: 19080 - DNA, 20 bp, human
gatcagcagcgcaggccggt

SEQ ID NO: 19081 - DNA, 20 bp, human
gagggaaggaaaggaacggt

SEQ ID NO: 19082 - DNA, 20 bp, human
gtgttccaccgggaccgggg

SEQ ID NO: 19083 - DNA, 20 bp, human
gtggggcgcagctcgcatgg

SEQ ID NO: 19084 - DNA, 20 bp, human
gtctagtcgcaggctcgact

SEQ ID NO: 19085 - DNA, 20 bp, human
ggcctgttccaccgggaccg

SEQ ID NO: 19086 - DNA, 20 bp, human
gactcccccaggccattacc

SEQ ID NO: 19087 - DNA, 20 bp, human
ggcacggtggacacctccag

SEQ ID NO: 19088 - DNA, 20 bp, human
gcgatccgggaggcgaggca

SEQ ID NO: 19089 - DNA, 20 bp, human
gcgggcagcgcccgcgagtg

SEQ ID NO: 19090 - DNA, 20 bp, human
gcagctggggtgggtctccc

SEQ ID NO: 19091 - DNA, 20 bp, human
gcagagggcggcgctgacac

SEQ ID NO: 19092 - DNA, 20 bp, human
gcgcttctgccactcaatgg

SEQ ID NO: 19093 - DNA, 20 bp, human
gccagcggcgcgtcggactc

SEQ ID NO: 19094 - DNA, 20 bp, human
gtcggactcgggactccccc

SEQ ID NO: 19095 - DNA, 20 bp, human
gagatcatgaccaaggacgg

SEQ ID NO: 19096 - DNA, 20 bp, human
gttggacgggaggcagaaag

SEQ ID NO: 19097 - DNA, 20 bp, human
ggagccaatgtccacgtccc

SEQ ID NO: 19098 - DNA, 20 bp, human
gtgcaaactaagcatcttcc

SEQ ID NO: 19099 - DNA, 20 bp, human
gagagaacaaaactgtctgt

SEQ ID NO: 19100 - DNA, 20 bp, human
gtggcctgggacgtggacat

SEQ ID NO: 19101 - DNA, 20 bp, human
ggctcttgagtctgtgttat

SEQ ID NO: 19102 - DNA, 20 bp, human
gttagtttgcaaaactgctc

SEQ ID NO: 19103 - DNA, 20 bp, human
gcccatgccccttggacggg

SEQ ID NO: 19104 - DNA, 20 bp, human
gacgggaggcagaaagtgga

SEQ ID NO: 19105 - DNA, 20 bp, human
gtggtaacttgtctatccac

SEQ ID NO: 19106 - DNA, 20 bp, human
gtgctgggcaacaggtctaa

SEQ ID NO: 19107 - DNA, 20 bp, human
gcgcgaactgcagggatgct

SEQ ID NO: 19108 - DNA, 20 bp, human
gtgggcaacaggtctaaggg

SEQ ID NO: 19109 - DNA, 20 bp, human
ggcacgcccgcgggcatggt

SEQ ID NO: 19110 - DNA, 20 bp, human
gtagtagagcgcgtgtatag

SEQ ID NO: 19111 - DNA, 20 bp, human
ggactgtaccgcgaactgca

SEQ ID NO: 19112 - DNA, 20 bp, human
gctcctggccatgtgcgcag

SEQ ID NO: 19113 - DNA, 20 bp, human
gctggacacgagacacacgg

SEQ ID NO: 19114 - DNA, 20 bp, human
gtcggcaggctggacgggga

SEQ ID NO: 19115 - DNA, 20 bp, human
gcgcgtgtatagaggcagag

SEQ ID NO: 19116 - DNA, 20 bp, human
gtggagacaaaagctgacgt

SEQ ID NO: 19117 - DNA, 20 bp, human
gcaccagcccccgaaaatac

SEQ ID NO: 19118 - DNA, 20 bp, human
gggtggaggaccagaagacg

SEQ ID NO: 19119 - DNA, 20 bp, human
gggaccagaagacggggact

SEQ ID NO: 19120 - DNA, 20 bp, human
gtgggaggtgatgctcgaat

SEQ ID NO: 19121 - DNA, 20 bp, human
gccgcttggcctttcgggaa

SEQ ID NO: 19122 - DNA, 20 bp, human
gggtggacgcgtgggcgata

SEQ ID NO: 19123 - DNA, 20 bp, human
gtagtctgtaaggttatggg

SEQ ID NO: 19124 - DNA, 20 bp, human
gcttggcctttcgggaaggg

SEQ ID NO: 19125 - DNA, 20 bp, human
gttgtctccagtattttcgg

SEQ ID NO: 19126 - DNA, 20 bp, human
gagagtgagctgccaggcga

SEQ ID NO: 19127 - DNA, 20 bp, human
gggacgcattgttacaggtg

SEQ ID NO: 19128 - DNA, 20 bp, human
gcaggaggacgcattgttac

SEQ ID NO: 19129 - DNA, 20 bp, human
ggttgctccgagccctcgcc

SEQ ID NO: 19130 - DNA, 20 bp, human
ggagctgccaggcgagggct

SEQ ID NO: 19131 - DNA, 20 bp, human
gtgcacccaggtgggtcccg

SEQ ID NO: 19132 - DNA, 20 bp, human
gcctaaatgactacacccag

SEQ ID NO: 19133 - DNA, 20 bp, human
gatggcttccccaacagtgt

SEQ ID NO: 19134 - DNA, 20 bp, human
gcctgaaggcaactgcaccc

SEQ ID NO: 19135 - DNA, 20 bp, human
gctgatagcaataggacaaa

SEQ ID NO: 19136 - DNA, 20 bp, human
gctgccgggcggaaaccacc

SEQ ID NO: 19137 - DNA, 20 bp, human
gggggccaggaaccgagtgg

SEQ ID NO: 19138 - DNA, 20 bp, human
ggggcggagacccagacgaa

SEQ ID NO: 19139 - DNA, 20 bp, human
gggtctcagggctctcctgg

SEQ ID NO: 19140 - DNA, 20 bp, human
gtggcaagtcccccgcgcgg

SEQ ID NO: 19141 - DNA, 20 bp, human
ggacgcggcccggggcgcag

SEQ ID NO: 19142 - DNA, 20 bp, human
ggacccgcggccgagagctc

SEQ ID NO: 19143 - DNA, 20 bp, human
gcggtctttccagaaacggg

SEQ ID NO: 19144 - DNA, 20 bp, human
gccgcaggctcgactgctcc

SEQ ID NO: 19145 - DNA, 20 bp, human
gcccgagcgggaggctgacg

SEQ ID NO: 19146 - DNA, 20 bp, human
gggtacagccacggtaacgc

SEQ ID NO: 19147 - DNA, 20 bp, human
gtgctggagccgggcatgta

SEQ ID NO: 19148 - DNA, 20 bp, human
ggctgcgtccagcgttaccg

SEQ ID NO: 19149 - DNA, 20 bp, human
gcccggagcagtgaaagctc

SEQ ID NO: 19150 - DNA, 20 bp, human
gcgacgcagagagacctggg

SEQ ID NO: 19151 - DNA, 20 bp, human
ggcatgtacggagcggacag

SEQ ID NO: 19152 - DNA, 20 bp, human
ggcggacaggggatagagtg

SEQ ID NO: 19153 - DNA, 20 bp, human
gccgctccagcggatccacg

SEQ ID NO: 19154 - DNA, 20 bp, human
gacagaggcagggcttgcga

SEQ ID NO: 19155 - DNA, 20 bp, human
gcagcgacgcagagagacct

SEQ ID NO: 19156 - DNA, 20 bp, human
gcaagtaactgaaatgacag

SEQ ID NO: 19157 - DNA, 20 bp, human
gaagatgcctaggaaggatg

SEQ ID NO: 19158 - DNA, 20 bp, human
gagtgctgggaaagatgcct

SEQ ID NO: 19159 - DNA, 20 bp, human
gctgggaaagatgcctagga

SEQ ID NO: 19160 - DNA, 20 bp, human
gttctgttattgctgtggtg

SEQ ID NO: 19161 - DNA, 20 bp, human
gtgtagagccgggcggggac

SEQ ID NO: 19162 - DNA, 20 bp, human
gctgattagaaagtataatc

SEQ ID NO: 19163 - DNA, 20 bp, human
gcatttctacagagtggctt

SEQ ID NO: 19164 - DNA, 20 bp, human
ggttttttgtagagccgggc

SEQ ID NO: 19165 - DNA, 20 bp, human
gatactttctaatcagatga

SEQ ID NO: 19166 - DNA, 20 bp, human
gctaaacaccacagagagat

SEQ ID NO: 19167 - DNA, 20 bp, human
ggcctgttctttaagactat

SEQ ID NO: 19168 - DNA, 20 bp, human
gacccatagtcttaaagaac

SEQ ID NO: 19169 - DNA, 20 bp, human
gctatgggtcacctgccccg

SEQ ID NO: 19170 - DNA, 20 bp, human
gttgtagacaacacaggaat

SEQ ID NO: 19171 - DNA, 20 bp, human
ggcattatcaaggttcactt

SEQ ID NO: 19172 - DNA, 20 bp, human
gcactaccccatataataga

SEQ ID NO: 19173 - DNA, 20 bp, human
ggcaagtccttctattatat

SEQ ID NO: 19174 - DNA, 20 bp, human
gtaagctggaattcaacaaa

SEQ ID NO: 19175 - DNA, 20 bp, human
gtcaattagaaatttccccg

SEQ ID NO: 19176 - DNA, 20 bp, human
gacgacagcaccagtaatca

SEQ ID NO: 19177 - DNA, 20 bp, human
gggcaggcaggggtcaaact

SEQ ID NO: 19178 - DNA, 20 bp, human
gcacttcaagctctaggtag

SEQ ID NO: 19179 - DNA, 20 bp, human
gacttagtaagtacttaaca

SEQ ID NO: 19180 - DNA, 20 bp, human
ggaggcagacacgcgctgct

SEQ ID NO: 19181 - DNA, 20 bp, human
gaaaatctaaggtgtgatgg

SEQ ID NO: 19182 - DNA, 20 bp, human
gcagtggtgagaaggcaggc

SEQ ID NO: 19183 - DNA, 20 bp, human
gaggtgtgatggtggtgtgt

SEQ ID NO: 19184 - DNA, 20 bp, human
gagtggggtagaaagggcac

SEQ ID NO: 19185 - DNA, 20 bp, human
gctaccccacttcaagctct

SEQ ID NO: 19186 - DNA, 20 bp, human
gggagcagggtgctactggg

SEQ ID NO: 19187 - DNA, 20 bp, human
gggaaacgtggacatgacac

SEQ ID NO: 19188 - DNA, 20 bp, human
gctggctggacgtgtgagac

SEQ ID NO: 19189 - DNA, 20 bp, human
gttcggagcagggtgctact

SEQ ID NO: 19190 - DNA, 20 bp, human
gcaacacggtgaccatcccc

SEQ ID NO: 19191 - DNA, 20 bp, human
gctccgaagaagcggaaacg

SEQ ID NO: 19192 - DNA, 20 bp, human
gtgcctgggttcctacgaag

SEQ ID NO: 19193 - DNA, 20 bp, human
gactggcgtcttccccccga

SEQ ID NO: 19194 - DNA, 20 bp, human
gggtcccttctccgaagaag

SEQ ID NO: 19195 - DNA, 20 bp, human
gatctccagctcagaagctc

SEQ ID NO: 19196 - DNA, 20 bp, human
ggccagtgtcctgtaggact

SEQ ID NO: 19197 - DNA, 20 bp, human
gcctgtaggactcggcactg

SEQ ID NO: 19198 - DNA, 20 bp, human
gactaatatggactgatcgg

SEQ ID NO: 19199 - DNA, 20 bp, human
ggggctcctctgagaaaagt

SEQ ID NO: 19200 - DNA, 20 bp, human
ggagctggcaggtttgatag

SEQ ID NO: 19201 - DNA, 20 bp, human
ggctctctccaggaaaatca

SEQ ID NO: 19202 - DNA, 20 bp, human
gccgtcagccagtgtcctgt

SEQ ID NO: 19203 - DNA, 20 bp, human
gagtccatattagtagtctg

SEQ ID NO: 19204 - DNA, 20 bp, human
gtgtccccagactactaata

SEQ ID NO: 19205 - DNA, 20 bp, human
gcatttctttgtgactctgt

SEQ ID NO: 19206 - DNA, 20 bp, human
gtacagtgctaggctcatag

SEQ ID NO: 19207 - DNA, 20 bp, human
gcgggctggagctgtcctgg

SEQ ID NO: 19208 - DNA, 20 bp, human
gcgccaggtaaggagaatat

SEQ ID NO: 19209 - DNA, 20 bp, human
gaatggctcaggtggactcc

SEQ ID NO: 19210 - DNA, 20 bp, human
ggctcaggtggactccgggc

SEQ ID NO: 19211 - DNA, 20 bp, human
gctccgggctggagctgtcc

SEQ ID NO: 19212 - DNA, 20 bp, human
gggggcccggtcgccaggta

SEQ ID NO: 19213 - DNA, 20 bp, human
ggggcggggacaaatggctc

SEQ ID NO: 19214 - DNA, 20 bp, human
gttctccttacctggcgacc

SEQ ID NO: 19215 - DNA, 20 bp, human
ggatagaaatatcaacccga

SEQ ID NO: 19216 - DNA, 20 bp, human
gccagaataaagccttggaa

SEQ ID NO: 19217 - DNA, 20 bp, human
gaaagaggtagagactccct

SEQ ID NO: 19218 - DNA, 20 bp, human
ggcagtgaaacagagctaga

SEQ ID NO: 19219 - DNA, 20 bp, human
gattcagaggaaagctgcga

SEQ ID NO: 19220 - DNA, 20 bp, human
gagtccacacggccagccga

SEQ ID NO: 19221 - DNA, 20 bp, human
gtgctactttgatcacccta

SEQ ID NO: 19222 - DNA, 20 bp, human
gaccaaggagcattattaat

SEQ ID NO: 19223 - DNA, 20 bp, human
gcactctaagactcacctta

SEQ ID NO: 19224 - DNA, 20 bp, human
ggcacctttgcaaaacaaag

SEQ ID NO: 19225 - DNA, 20 bp, human
gtgactgctttgtaaagcga

SEQ ID NO: 19226 - DNA, 20 bp, human
gccttagactccaactactg

SEQ ID NO: 19227 - DNA, 20 bp, human
gaccgtgcgcgcggatccag

SEQ ID NO: 19228 - DNA, 20 bp, human
gagcgcgagcccaaatggga

SEQ ID NO: 19229 - DNA, 20 bp, human
gcggcgcaggcgcagtatcc

SEQ ID NO: 19230 - DNA, 20 bp, human
ggcgcgcacggtggttgatg

SEQ ID NO: 19231 - DNA, 20 bp, human
gtccgaggccggaagtgcgt

SEQ ID NO: 19232 - DNA, 20 bp, human
gaccgacctgaaggccgcac

SEQ ID NO: 19233 - DNA, 20 bp, human
ggcgccggttcccgccttaa

SEQ ID NO: 19234 - DNA, 20 bp, human
gagtacctcacgcaagatgg

SEQ ID NO: 19235 - DNA, 20 bp, human
gcaggaagcagttcctccaa

SEQ ID NO: 19236 - DNA, 20 bp, human
gccgcccgggcccctctcgt

SEQ ID NO: 19237 - DNA, 20 bp, human
gggcgcactcggctgtctct

SEQ ID NO: 19238 - DNA, 20 bp, human
ggacagccgagtgcgccgtg

SEQ ID NO: 19239 - DNA, 20 bp, human
ggctccagatctctactagg

SEQ ID NO: 19240 - DNA, 20 bp, human
ggccttcctgccaacgagag

SEQ ID NO: 19241 - DNA, 20 bp, human
ggagtgcgccgtgcggtctc

SEQ ID NO: 19242 - DNA, 20 bp, human
gctggctccagatctctact

SEQ ID NO: 19243 - DNA, 20 bp, human
gggaacagctcgagccgcgg

SEQ ID NO: 19244 - DNA, 20 bp, human
gcctccgcctagtagagatc

SEQ ID NO: 19245 - DNA, 20 bp, human
ggcaggcggctgacccgcag

SEQ ID NO: 19246 - DNA, 20 bp, human
ggctgctgggagagtacgtc

SEQ ID NO: 19247 - DNA, 20 bp, human
gagagtacgtcgggcaggaa

SEQ ID NO: 19248 - DNA, 20 bp, human
ggacaccgggaagcgccacc

SEQ ID NO: 19249 - DNA, 20 bp, human
gtcgtgttctggaagcttag

SEQ ID NO: 19250 - DNA, 20 bp, human
gtggcgggctaggcgaagtg

SEQ ID NO: 19251 - DNA, 20 bp, human
gaagctgcgggtgtcctgtg

SEQ ID NO: 19252 - DNA, 20 bp, human
gagggaagccgcagaagctg

SEQ ID NO: 19253 - DNA, 20 bp, human
ggaagtgcagcaccgggtgg

SEQ ID NO: 19254 - DNA, 20 bp, human
ggcttccagaacacgacacc

SEQ ID NO: 19255 - DNA, 20 bp, human
gcaagtctgccactctacac

SEQ ID NO: 19256 - DNA, 20 bp, human
ggtgacctgggagttctcaa

SEQ ID NO: 19257 - DNA, 20 bp, human
gggctcgggtctacaagctg

SEQ ID NO: 19258 - DNA, 20 bp, human
gcagcaagcctgtggctcaa

SEQ ID NO: 19259 - DNA, 20 bp, human
gccccacctaaggagcccaa

SEQ ID NO: 19260 - DNA, 20 bp, human
ggacagaacatatcaggtat

SEQ ID NO: 19261 - DNA, 20 bp, human
gctgcctccagccaacgcag

SEQ ID NO: 19262 - DNA, 20 bp, human
gtacagtcagcgcttggggc

SEQ ID NO: 19263 - DNA, 20 bp, human
gcctgaggacagaacatatc

SEQ ID NO: 19264 - DNA, 20 bp, human
ggctgctacagtcagcgctt

SEQ ID NO: 19265 - DNA, 20 bp, human
gccacgtgagctcaggctgt

SEQ ID NO: 19266 - DNA, 20 bp, human
gttatgggagagtatgtcaa

SEQ ID NO: 19267 - DNA, 20 bp, human
gttgccagaagtgaagggaa

SEQ ID NO: 19268 - DNA, 20 bp, human
gcttcacttctggcaagaaa

SEQ ID NO: 19269 - DNA, 20 bp, human
ggtgaagggaaaggagttat

SEQ ID NO: 19270 - DNA, 20 bp, human
gagaggaaaactataaagtg

SEQ ID NO: 19271 - DNA, 20 bp, human
gaggcttgtttttccctagt

SEQ ID NO: 19272 - DNA, 20 bp, human
gaggctttgcaaacacaata

SEQ ID NO: 19273 - DNA, 20 bp, human
gtgtttttccctagtaggtg

SEQ ID NO: 19274 - DNA, 20 bp, human
ggagaaaaaatggagattca

SEQ ID NO: 19275 - DNA, 20 bp, human
gactcctttcccttcacttc

SEQ ID NO: 19276 - DNA, 20 bp, human
gagaagaagcgaggtggagc

SEQ ID NO: 19277 - DNA, 20 bp, human
gcgcgtgtccctgacctggg

SEQ ID NO: 19278 - DNA, 20 bp, human
ggagcgggaggcgcaggcac

SEQ ID NO: 19279 - DNA, 20 bp, human
gaacatgccgagacaggagt

SEQ ID NO: 19280 - DNA, 20 bp, human
gggcgacgcggcgagagggc

SEQ ID NO: 19281 - DNA, 20 bp, human
gagaagcgaggtggagcggg

SEQ ID NO: 19282 - DNA, 20 bp, human
gggccgggagagaagaagcg

SEQ ID NO: 19283 - DNA, 20 bp, human
ggaggtacgtggcgacccag

SEQ ID NO: 19284 - DNA, 20 bp, human
gctaattacccagggaacca

SEQ ID NO: 19285 - DNA, 20 bp, human
gggccgcgtgtccctgacct

SEQ ID NO: 19286 - DNA, 20 bp, human
gagcaagccctgggaagagt

SEQ ID NO: 19287 - DNA, 20 bp, human
gccagctcatctgggagagt

SEQ ID NO: 19288 - DNA, 20 bp, human
gtcgagaggtggcaagaagt

SEQ ID NO: 19289 - DNA, 20 bp, human
gacctctcccagacagagtt

SEQ ID NO: 19290 - DNA, 20 bp, human
gtagggaagcagtcgagagg

SEQ ID NO: 19291 - DNA, 20 bp, human
gggtgccaggaccctcttga

SEQ ID NO: 19292 - DNA, 20 bp, human
gtcttagggaagcagtcgag

SEQ ID NO: 19293 - DNA, 20 bp, human
gctacttctccagctcatct

SEQ ID NO: 19294 - DNA, 20 bp, human
ggggaagagtaggctttgat

SEQ ID NO: 19295 - DNA, 20 bp, human
ggagacagaggtgaatggac

SEQ ID NO: 19296 - DNA, 20 bp, human
ggggggacgcgctacccggt

SEQ ID NO: 19297 - DNA, 20 bp, human
gacctgggggacgcgctacc

SEQ ID NO: 19298 - DNA, 20 bp, human
ggccgggggcgaagctaaag

SEQ ID NO: 19299 - DNA, 20 bp, human
gctggcctggagcccatcca

SEQ ID NO: 19300 - DNA, 20 bp, human
gcgggcggggaagactggtg

SEQ ID NO: 19301 - DNA, 20 bp, human
gctgcctagcgagaactcgg

SEQ ID NO: 19302 - DNA, 20 bp, human
gccggccgggcggggaagac

SEQ ID NO: 19303 - DNA, 20 bp, human
ggagaactcggaggaatcga

SEQ ID NO: 19304 - DNA, 20 bp, human
gcgctccctgcagaccccgt

SEQ ID NO: 19305 - DNA, 20 bp, human
gggccgcaggtggataacac

SEQ ID NO: 19306 - DNA, 20 bp, human
gctggagccaccataagagt

SEQ ID NO: 19307 - DNA, 20 bp, human
gtgcttgggatggttactag

SEQ ID NO: 19308 - DNA, 20 bp, human
gggaccacatctggcaatct

SEQ ID NO: 19309 - DNA, 20 bp, human
gactaggggctgaatcacta

SEQ ID NO: 19310 - DNA, 20 bp, human
gcataagagtaggagctgtc

SEQ ID NO: 19311 - DNA, 20 bp, human
gttcagccacagcactcggt

SEQ ID NO: 19312 - DNA, 20 bp, human
gaggaccgcaaacctgcagt

SEQ ID NO: 19313 - DNA, 20 bp, human
gacatctggcaatctaggtg

SEQ ID NO: 19314 - DNA, 20 bp, human
gccctgctatgtaattagta

SEQ ID NO: 19315 - DNA, 20 bp, human
gggaaataagttcttcatgt

SEQ ID NO: 19316 - DNA, 20 bp, human
gttgattggggtcctcgata

SEQ ID NO: 19317 - DNA, 20 bp, human
gctaggcctagtcgtagcgg

SEQ ID NO: 19318 - DNA, 20 bp, human
gcagacggcggtcactactg

SEQ ID NO: 19319 - DNA, 20 bp, human
gggcgcatatcagcagacgg

SEQ ID NO: 19320 - DNA, 20 bp, human
gcgggcggtgacctgacccg

SEQ ID NO: 19321 - DNA, 20 bp, human
gcgactaggcctagtcgtag

SEQ ID NO: 19322 - DNA, 20 bp, human
gtcgctcgcgctggaagaag

SEQ ID NO: 19323 - DNA, 20 bp, human
gggctcgggcgaacgagatg

SEQ ID NO: 19324 - DNA, 20 bp, human
gagtggcgcatatcagcaga

SEQ ID NO: 19325 - DNA, 20 bp, human
gcccggggcacagaatgacg

SEQ ID NO: 19326 - DNA, 20 bp, human
gcccgagggctctgatctgg

SEQ ID NO: 19327 - DNA, 20 bp, human
gcttcccgagggctctgatc

SEQ ID NO: 19328 - DNA, 20 bp, human
gacagacccggccctgccag

SEQ ID NO: 19329 - DNA, 20 bp, human
gtgcagggcacacaggtgaa

SEQ ID NO: 19330 - DNA, 20 bp, human
gacgaaggccacaacagacc

SEQ ID NO: 19331 - DNA, 20 bp, human
gcccgaggctcaactctcaa

SEQ ID NO: 19332 - DNA, 20 bp, human
ggcctccagatcagagccct

SEQ ID NO: 19333 - DNA, 20 bp, human
gagggctggagacgggacga

SEQ ID NO: 19334 - DNA, 20 bp, human
gttccctcctggctccccga

SEQ ID NO: 19335 - DNA, 20 bp, human
ggagcttgttcaggtcactc

SEQ ID NO: 19336 - DNA, 20 bp, human
gcaccagcaggagcccaggt

SEQ ID NO: 19337 - DNA, 20 bp, human
gggccacaggcctaacccaa

SEQ ID NO: 19338 - DNA, 20 bp, human
gaggttgtgccttcttccgg

SEQ ID NO: 19339 - DNA, 20 bp, human
gggtcccagtcttcttccac

SEQ ID NO: 19340 - DNA, 20 bp, human
ggcctgtggccaaactacta

SEQ ID NO: 19341 - DNA, 20 bp, human
ggccccagggccattgggtt

SEQ ID NO: 19342 - DNA, 20 bp, human
gtgcaggttgtgccttcttc

SEQ ID NO: 19343 - DNA, 20 bp, human
ggtcttcttccaccggaaga

SEQ ID NO: 19344 - DNA, 20 bp, human
gttacggcgacactgagcag

SEQ ID NO: 19345 - DNA, 20 bp, human
ggccagcgaggcagtgtcca

SEQ ID NO: 19346 - DNA, 20 bp, human
gtcccagcagagagtcacgg

SEQ ID NO: 19347 - DNA, 20 bp, human
gacctcccagcagagagtca

SEQ ID NO: 19348 - DNA, 20 bp, human
gccagttaggaagtctctgg

SEQ ID NO: 19349 - DNA, 20 bp, human
gcccccagttaggaagtctc

SEQ ID NO: 19350 - DNA, 20 bp, human
gcctcataagacggcaaaac

SEQ ID NO: 19351 - DNA, 20 bp, human
ggaaagatgactagagtctg

SEQ ID NO: 19352 - DNA, 20 bp, human
gaaagcctgccctcataaga

SEQ ID NO: 19353 - DNA, 20 bp, human
gagccaccgtgactctctgc

SEQ ID NO: 19354 - DNA, 20 bp, human
gaatttggtcaggctgggtc

SEQ ID NO: 19355 - DNA, 20 bp, human
ggagggcaggctttgtaatt

SEQ ID NO: 19356 - DNA, 20 bp, human
gggcctgccagatgcagata

SEQ ID NO: 19357 - DNA, 20 bp, human
ggagaaccctaagacctcca

SEQ ID NO: 19358 - DNA, 20 bp, human
gttcagccatggaggtctta

SEQ ID NO: 19359 - DNA, 20 bp, human
gaaccgtgagaaatacccac

SEQ ID NO: 19360 - DNA, 20 bp, human
ggtggtacgcagctgagaag

SEQ ID NO: 19361 - DNA, 20 bp, human
gtggaaatgtgagttcctgt

SEQ ID NO: 19362 - DNA, 20 bp, human
gtgctcctctacataacaat

SEQ ID NO: 19363 - DNA, 20 bp, human
ggctgcccattgttatgtag

SEQ ID NO: 19364 - DNA, 20 bp, human
gttgttatgttcagccatgg

SEQ ID NO: 19365 - DNA, 20 bp, human
ggggttctcgaatagtaaga

SEQ ID NO: 19366 - DNA, 20 bp, human
gtcctgcgccaaggtgagta

SEQ ID NO: 19367 - DNA, 20 bp, human
gcctaggcgatgcttccctc

SEQ ID NO: 19368 - DNA, 20 bp, human
gcaccttggcgcaggacaga

SEQ ID NO: 19369 - DNA, 20 bp, human
gcaggtccccgtactcacct

SEQ ID NO: 19370 - DNA, 20 bp, human
gatctgcagccaactcggaa

SEQ ID NO: 19371 - DNA, 20 bp, human
ggttcagctgcctaacccag

SEQ ID NO: 19372 - DNA, 20 bp, human
gaaggccaaggagggaaacg

SEQ ID NO: 19373 - DNA, 20 bp, human
gtggctcccgaggtgcgaga

SEQ ID NO: 19374 - DNA, 20 bp, human
gctcggtgacctttccgagt

SEQ ID NO: 19375 - DNA, 20 bp, human
gcacaaatctgcagccaact

SEQ ID NO: 19376 - DNA, 20 bp, human
gcccacggagccaggacagt

SEQ ID NO: 19377 - DNA, 20 bp, human
gcgcccaggcccaatctcac

SEQ ID NO: 19378 - DNA, 20 bp, human
gccgtgggtccagtgagatt

SEQ ID NO: 19379 - DNA, 20 bp, human
ggcgacgtgtcccactgtcc

SEQ ID NO: 19380 - DNA, 20 bp, human
gcttattacggaggaagatt

SEQ ID NO: 19381 - DNA, 20 bp, human
gctcgcgggcccctaactcg

SEQ ID NO: 19382 - DNA, 20 bp, human
gggaggcctggcaccgaggc

SEQ ID NO: 19383 - DNA, 20 bp, human
gcgcagttctgagcactcgg

SEQ ID NO: 19384 - DNA, 20 bp, human
gccggcggtactcatagatg

SEQ ID NO: 19385 - DNA, 20 bp, human
ggacacgtcgcttcttatta

SEQ ID NO: 19386 - DNA, 20 bp, human
gcccctagcgtcccagacag

SEQ ID NO: 19387 - DNA, 20 bp, human
gctagcgtcccagacagcgg

SEQ ID NO: 19388 - DNA, 20 bp, human
ggcgctcggcatcccagcgg

SEQ ID NO: 19389 - DNA, 20 bp, human
ggctccgccagcacaaaggc

SEQ ID NO: 19390 - DNA, 20 bp, human
ggcgctccggaggaggatcg

SEQ ID NO: 19391 - DNA, 20 bp, human
gccgcgagcgtaacagtccc

SEQ ID NO: 19392 - DNA, 20 bp, human
ggcaagctccgccagcacaa

SEQ ID NO: 19393 - DNA, 20 bp, human
gaaaggccggctcgctggtg

SEQ ID NO: 19394 - DNA, 20 bp, human
ggccggggcagggacggaac

SEQ ID NO: 19395 - DNA, 20 bp, human
gcgcacgcctggcgcaccca

SEQ ID NO: 19396 - DNA, 20 bp, human
gtccactcaggacgccacag

SEQ ID NO: 19397 - DNA, 20 bp, human
gtccgctgtggcgtcctgag

SEQ ID NO: 19398 - DNA, 20 bp, human
gggggtcccaaactccactc

SEQ ID NO: 19399 - DNA, 20 bp, human
gtcgggccgcaccaacccag

SEQ ID NO: 19400 - DNA, 20 bp, human
gttgtagttaggatccgctg

SEQ ID NO: 19401 - DNA, 20 bp, human
gagtccagcccagggctccg

SEQ ID NO: 19402 - DNA, 20 bp, human
gcccactgcgggaggcgcac

SEQ ID NO: 19403 - DNA, 20 bp, human
gcgactccggtcgctctgag

SEQ ID NO: 19404 - DNA, 20 bp, human
gtagacaggaaccccgcctc

SEQ ID NO: 19405 - DNA, 20 bp, human
ggaacagccaattcgcatta

SEQ ID NO: 19406 - DNA, 20 bp, human
gcttccggcgtccgtcgccg

SEQ ID NO: 19407 - DNA, 20 bp, human
ggaggcgcgtaccagaccca

SEQ ID NO: 19408 - DNA, 20 bp, human
gccgaggcggcgaccaaggt

SEQ ID NO: 19409 - DNA, 20 bp, human
gggcgcggagtccgacacag

SEQ ID NO: 19410 - DNA, 20 bp, human
ggcccgcgggagtcccaagt

SEQ ID NO: 19411 - DNA, 20 bp, human
ggcgtgcgagagggactctc

SEQ ID NO: 19412 - DNA, 20 bp, human
gagtgccccgggctgcccag

SEQ ID NO: 19413 - DNA, 20 bp, human
gactccgcgcccgcctgcgt

SEQ ID NO: 19414 - DNA, 20 bp, human
gagtcccaagtgggaaggag

SEQ ID NO: 19415 - DNA, 20 bp, human
gcagttccacagcagcacgt

SEQ ID NO: 19416 - DNA, 20 bp, human
gttccagccggagcggtaac

SEQ ID NO: 19417 - DNA, 20 bp, human
ggcggtgacgctctcgcgga

SEQ ID NO: 19418 - DNA, 20 bp, human
ggcacgggccgggtttagtg

SEQ ID NO: 19419 - DNA, 20 bp, human
gcccagggcgagcgatgcca

SEQ ID NO: 19420 - DNA, 20 bp, human
gctgcgtccaatcaccgcac

SEQ ID NO: 19421 - DNA, 20 bp, human
gggggccagtgctaccgggt

SEQ ID NO: 19422 - DNA, 20 bp, human
gtggcgagagcacacggaag

SEQ ID NO: 19423 - DNA, 20 bp, human
gagggagtggcgagagcaca

SEQ ID NO: 19424 - DNA, 20 bp, human
gaggcggggccagtgctacc

SEQ ID NO: 19425 - DNA, 20 bp, human
gggcgcggcggaagatctcg

SEQ ID NO: 19426 - DNA, 20 bp, human
gaggatacccgaaggtcgta

SEQ ID NO: 19427 - DNA, 20 bp, human
gcaaagagccatacgacctt

SEQ ID NO: 19428 - DNA, 20 bp, human
gcttccttcgatgttgcctg

SEQ ID NO: 19429 - DNA, 20 bp, human
gaacacacacaagattaagg

SEQ ID NO: 19430 - DNA, 20 bp, human
ggtgcaaaaaggaggactcg

SEQ ID NO: 19431 - DNA, 20 bp, human
ggaaaacacacacaagatta

SEQ ID NO: 19432 - DNA, 20 bp, human
gtcgtgtgtgtgcaaaaagg

SEQ ID NO: 19433 - DNA, 20 bp, human
gcacgcaaacggctttatga

SEQ ID NO: 19434 - DNA, 20 bp, human
gggccggaaacggttgtaca

SEQ ID NO: 19435 - DNA, 20 bp, human
ggagatctgtagcagtgttg

SEQ ID NO: 19436 - DNA, 20 bp, human
gggctgactcagctaggcag

SEQ ID NO: 19437 - DNA, 20 bp, human
ggcgcggtagccgggtacac

SEQ ID NO: 19438 - DNA, 20 bp, human
gcgggagacagaactatccg

SEQ ID NO: 19439 - DNA, 20 bp, human
ggatgacaaggtggacccca

SEQ ID NO: 19440 - DNA, 20 bp, human
gggtagccgggtacacgggc

SEQ ID NO: 19441 - DNA, 20 bp, human
gactgctcaagaggcctcag

SEQ ID NO: 19442 - DNA, 20 bp, human
ggtgcctggcgctaccgcac

SEQ ID NO: 19443 - DNA, 20 bp, human
gcagagcgcactgtatggta

SEQ ID NO: 19444 - DNA, 20 bp, human
gagggatgcggagagcagag

SEQ ID NO: 19445 - DNA, 20 bp, human
gggtacacgggcaggcgccg

SEQ ID NO: 19446 - DNA, 20 bp, human
ggctaacgcatggtgtcgga

SEQ ID NO: 19447 - DNA, 20 bp, human
gatggtccgggagtccggat

SEQ ID NO: 19448 - DNA, 20 bp, human
gcgatggcgcagaacgtgta

SEQ ID NO: 19449 - DNA, 20 bp, human
ggaatacgggggacttagtg

SEQ ID NO: 19450 - DNA, 20 bp, human
gggcttgaggcgctcaaagt

SEQ ID NO: 19451 - DNA, 20 bp, human
ggcccacttgctgaacagca

SEQ ID NO: 19452 - DNA, 20 bp, human
gagtggggctctagactaag

SEQ ID NO: 19453 - DNA, 20 bp, human
gccacgctaacgcatggtgt

SEQ ID NO: 19454 - DNA, 20 bp, human
gaagactctaaggaatacgg

SEQ ID NO: 19455 - DNA, 20 bp, human
gcgcagaacgtgtatggtcc

SEQ ID NO: 19456 - DNA, 20 bp, human
gccacaagactcgggcagtg

SEQ ID NO: 19457 - DNA, 20 bp, human
gtgcagctggacccgaacca

SEQ ID NO: 19458 - DNA, 20 bp, human
ggattcgctcggctctgcag

SEQ ID NO: 19459 - DNA, 20 bp, human
gcgccccgaccacaagactc

SEQ ID NO: 19460 - DNA, 20 bp, human
gagccaggcgagggtgcgtg

SEQ ID NO: 19461 - DNA, 20 bp, human
gaccaagccacaaatcctca

SEQ ID NO: 19462 - DNA, 20 bp, human
gttcagacgtggtatagagg

SEQ ID NO: 19463 - DNA, 20 bp, human
ggtggaaatcccacaccctg

SEQ ID NO: 19464 - DNA, 20 bp, human
gatacctgctgcccgggctc

SEQ ID NO: 19465 - DNA, 20 bp, human
gggggaatcccattgcagta

SEQ ID NO: 19466 - DNA, 20 bp, human
gctggatgccactaacacaa

SEQ ID NO: 19467 - DNA, 20 bp, human
ggctacacctctgtgtgacc

SEQ ID NO: 19468 - DNA, 20 bp, human
gttccctgaaggccagacct

SEQ ID NO: 19469 - DNA, 20 bp, human
gcccagcctggaatcaggaa

SEQ ID NO: 19470 - DNA, 20 bp, human
gcccggctgacccccagagt

SEQ ID NO: 19471 - DNA, 20 bp, human
gttgtctggcatgttcaccg

SEQ ID NO: 19472 - DNA, 20 bp, human
gcagaggtgtagccccagct

SEQ ID NO: 19473 - DNA, 20 bp, human
ggattccttggtctggggta

SEQ ID NO: 19474 - DNA, 20 bp, human
ggccactaacacaacggcag

SEQ ID NO: 19475 - DNA, 20 bp, human
gaatctgattccttggtctg

SEQ ID NO: 19476 - DNA, 20 bp, human
gggtcgggaccctctctcga

SEQ ID NO: 19477 - DNA, 20 bp, human
gggaccccgccgcccaccag

SEQ ID NO: 19478 - DNA, 20 bp, human
gatccgccggctgggaatcg

SEQ ID NO: 19479 - DNA, 20 bp, human
gcagccggcggatccgggaa

SEQ ID NO: 19480 - DNA, 20 bp, human
gacccgcgattcccagccgg

SEQ ID NO: 19481 - DNA, 20 bp, human
ggcgaccccatgacacagat

SEQ ID NO: 19482 - DNA, 20 bp, human
ggccttcggagacctgtctg

SEQ ID NO: 19483 - DNA, 20 bp, human
gagggtcccgacccccagac

SEQ ID NO: 19484 - DNA, 20 bp, human
gtcgagggcaggcggacagg

SEQ ID NO: 19485 - DNA, 20 bp, human
ggggcaccccggcacagagc

SEQ ID NO: 19486 - DNA, 20 bp, human
ggccggtgctgagagaaccg

SEQ ID NO: 19487 - DNA, 20 bp, human
ggccacggttctctcagcac

SEQ ID NO: 19488 - DNA, 20 bp, human
gtggctggcaaagatgattc

SEQ ID NO: 19489 - DNA, 20 bp, human
gggagctttctgggagtagc

SEQ ID NO: 19490 - DNA, 20 bp, human
gcatagtgggcgccctgaag

SEQ ID NO: 19491 - DNA, 20 bp, human
gcgagatagaagcgacagtg

SEQ ID NO: 19492 - DNA, 20 bp, human
gaccgctctttggtcacctg

SEQ ID NO: 19493 - DNA, 20 bp, human
gaccaaagagcggtgccccc

SEQ ID NO: 19494 - DNA, 20 bp, human
gacgggaaaatgtcacaaaa

SEQ ID NO: 19495 - DNA, 20 bp, human
gttggcctctcggcgcccgg

SEQ ID NO: 19496 - DNA, 20 bp, human
gggtcgggaccctctctcga

SEQ ID NO: 19497 - DNA, 20 bp, human
ggggcaccccggcacagagc

SEQ ID NO: 19498 - DNA, 20 bp, human
gagggtcccgacccccagac

SEQ ID NO: 19499 - DNA, 20 bp, human
ggccttcggagacctgtctg

SEQ ID NO: 19500 - DNA, 20 bp, human
gggaccccgccgcccaccag

SEQ ID NO: 19501 - DNA, 20 bp, human
gtgcgggtgggggaaaactg

SEQ ID NO: 19502 - DNA, 20 bp, human
gcgcgccgtcgtggtagatg

SEQ ID NO: 19503 - DNA, 20 bp, human
gggcgcgctccggaacaagg

SEQ ID NO: 19504 - DNA, 20 bp, human
ggtccgcctgccctcgagag

SEQ ID NO: 19505 - DNA, 20 bp, human
gccccgcaacaggatcgggt

SEQ ID NO: 19506 - DNA, 20 bp, human
ggcgcgaacggcagctagga

SEQ ID NO: 19507 - DNA, 20 bp, human
gcagctaggagggttgctcc

SEQ ID NO: 19508 - DNA, 20 bp, human
gggagaacaggcgcctaatc

SEQ ID NO: 19509 - DNA, 20 bp, human
gtcgcagtgagcaccaagcc

SEQ ID NO: 19510 - DNA, 20 bp, human
gcgcccagcggcggcgcgaa

SEQ ID NO: 19511 - DNA, 20 bp, human
gcgcgggtcctagtccgacc

SEQ ID NO: 19512 - DNA, 20 bp, human
gtagcgctctgggtctccgg

SEQ ID NO: 19513 - DNA, 20 bp, human
gatctggcgagaaggaactc

SEQ ID NO: 19514 - DNA, 20 bp, human
gggagacccagagcgctacc

SEQ ID NO: 19515 - DNA, 20 bp, human
gggcggcgcgaacggcagct

SEQ ID NO: 19516 - DNA, 20 bp, human
ggtgcgatcagccaaagcaa

SEQ ID NO: 19517 - DNA, 20 bp, human
ggagccccggaactgagaga

SEQ ID NO: 19518 - DNA, 20 bp, human
gggatgctgcggctccgcag

SEQ ID NO: 19519 - DNA, 20 bp, human
gagcgggctgaggcaccttc

SEQ ID NO: 19520 - DNA, 20 bp, human
gcgagcggagccccgagtat

SEQ ID NO: 19521 - DNA, 20 bp, human
gcgggcaacacccaatactc

SEQ ID NO: 19522 - DNA, 20 bp, human
gacggcagcgcagcctactg

SEQ ID NO: 19523 - DNA, 20 bp, human
gtcggcgcaaagaagccgag

SEQ ID NO: 19524 - DNA, 20 bp, human
gttctgagcgctgggcccgg

SEQ ID NO: 19525 - DNA, 20 bp, human
gcagcaggccgcagctctgg

SEQ ID NO: 19526 - DNA, 20 bp, human
gctttggtcagtatcatgtt

SEQ ID NO: 19527 - DNA, 20 bp, human
ggcccggtcccaggctccac

SEQ ID NO: 19528 - DNA, 20 bp, human
gcctagctgcaaaagcgggg

SEQ ID NO: 19529 - DNA, 20 bp, human
gggctccaccggcacctccg

SEQ ID NO: 19530 - DNA, 20 bp, human
gtgctcagtaagccaagcta

SEQ ID NO: 19531 - DNA, 20 bp, human
ggtcaggcgttaggaggtcg

SEQ ID NO: 19532 - DNA, 20 bp, human
ggtacagccagtccccgccg

SEQ ID NO: 19533 - DNA, 20 bp, human
gcttggtgccgagggatgag

SEQ ID NO: 19534 - DNA, 20 bp, human
gggtaggcggcacagacact

SEQ ID NO: 19535 - DNA, 20 bp, human
gggggaggaacaccagtgtc

SEQ ID NO: 19536 - DNA, 20 bp, human
gtggcgacgccatgtttcaa

SEQ ID NO: 19537 - DNA, 20 bp, human
gcagcgttagccaggatctg

SEQ ID NO: 19538 - DNA, 20 bp, human
gccgcgctgcccttgaaaca

SEQ ID NO: 19539 - DNA, 20 bp, human
gcagctgaacaagaagtcgg

SEQ ID NO: 19540 - DNA, 20 bp, human
gcctccacagtggctgaagg

SEQ ID NO: 19541 - DNA, 20 bp, human
gtgaggtactgagggcgacc

SEQ ID NO: 19542 - DNA, 20 bp, human
gcaggatctgaggcaattct

SEQ ID NO: 19543 - DNA, 20 bp, human
gcggctcatcctaacataag

SEQ ID NO: 19544 - DNA, 20 bp, human
ggtggaagcagcgggttagg

SEQ ID NO: 19545 - DNA, 20 bp, human
gtcctctctcacatctccac

SEQ ID NO: 19546 - DNA, 20 bp, human
gcagtcatgaacaccaccaa

SEQ ID NO: 19547 - DNA, 20 bp, human
ggtggtgttcatgactgtgg

SEQ ID NO: 19548 - DNA, 20 bp, human
ggcgctccgcaggccaactg

SEQ ID NO: 19549 - DNA, 20 bp, human
gtgcagatgggagactcacc

SEQ ID NO: 19550 - DNA, 20 bp, human
gcaactcctgatgaaaagga

SEQ ID NO: 19551 - DNA, 20 bp, human
ggactcacctggacgccggg

SEQ ID NO: 19552 - DNA, 20 bp, human
gggagactcacctggacgcc

SEQ ID NO: 19553 - DNA, 20 bp, human
gtgcgcaccgcccggcgtcc

SEQ ID NO: 19554 - DNA, 20 bp, human
gggtaacgcccggaaccgaa

SEQ ID NO: 19555 - DNA, 20 bp, human
gcggagcgcggtggacggtt

SEQ ID NO: 19556 - DNA, 20 bp, human
ggcccctggggagccagagt

SEQ ID NO: 19557 - DNA, 20 bp, human
gaccggagccgggcctctgc

SEQ ID NO: 19558 - DNA, 20 bp, human
ggccggcagaggcccggctc

SEQ ID NO: 19559 - DNA, 20 bp, human
gcgaaagctgctggtagtcg

SEQ ID NO: 19560 - DNA, 20 bp, human
gtaccaggcagccaccctct

SEQ ID NO: 19561 - DNA, 20 bp, human
gaagctggagccaccggagc

SEQ ID NO: 19562 - DNA, 20 bp, human
gaggaagaaggctgtgacta

SEQ ID NO: 19563 - DNA, 20 bp, human
gagagagccagctcccctgg

SEQ ID NO: 19564 - DNA, 20 bp, human
gtgggcacaggcctaggtgc

SEQ ID NO: 19565 - DNA, 20 bp, human
gccgagtgcatggcaacggc

SEQ ID NO: 19566 - DNA, 20 bp, human
gggcctggggaaccaccgag

SEQ ID NO: 19567 - DNA, 20 bp, human
gaggccacatgggcagtgct

SEQ ID NO: 19568 - DNA, 20 bp, human
gcatagaggggtcacctgga

SEQ ID NO: 19569 - DNA, 20 bp, human
gctaccagagcaaggaacca

SEQ ID NO: 19570 - DNA, 20 bp, human
gaggatgctgaggaccacgg

SEQ ID NO: 19571 - DNA, 20 bp, human
gcactgcccatgtggcctga

SEQ ID NO: 19572 - DNA, 20 bp, human
gcgggtggttagcaggaact

SEQ ID NO: 19573 - DNA, 20 bp, human
gctgcccagcactgcccatg

SEQ ID NO: 19574 - DNA, 20 bp, human
ggaaggtcctcacttggggg

SEQ ID NO: 19575 - DNA, 20 bp, human
ggttctgcaggaaaagcggg

SEQ ID NO: 19576 - DNA, 20 bp, human
gaaggggcccaagaggacct

SEQ ID NO: 19577 - DNA, 20 bp, human
ggaaatgcccaggtcctctt

SEQ ID NO: 19578 - DNA, 20 bp, human
ggagctttgcagtactccag

SEQ ID NO: 19579 - DNA, 20 bp, human
ggagctacaaggggcccaag

SEQ ID NO: 19580 - DNA, 20 bp, human
gaggggagaaagtctaggat

SEQ ID NO: 19581 - DNA, 20 bp, human
gggccaggaagcaaggctaa

SEQ ID NO: 19582 - DNA, 20 bp, human
gtccagcctgtataagtcag

SEQ ID NO: 19583 - DNA, 20 bp, human
gttcctccggggactagaga

SEQ ID NO: 19584 - DNA, 20 bp, human
gtctgatatggagctacaag

SEQ ID NO: 19585 - DNA, 20 bp, human
ggatgggtgatgccccccac

SEQ ID NO: 19586 - DNA, 20 bp, human
gccaggtgcctgattctatt

SEQ ID NO: 19587 - DNA, 20 bp, human
gtaatgtacccaatagaatc

SEQ ID NO: 19588 - DNA, 20 bp, human
gccaggccaactcaagtgga

SEQ ID NO: 19589 - DNA, 20 bp, human
gaggaatggagcgattgtca

SEQ ID NO: 19590 - DNA, 20 bp, human
gacaagccttgagagtttcc

SEQ ID NO: 19591 - DNA, 20 bp, human
gcaatccaggccaactcaag

SEQ ID NO: 19592 - DNA, 20 bp, human
gcatttattaggcacctacc

SEQ ID NO: 19593 - DNA, 20 bp, human
gtctgtgtacatcctgctga

SEQ ID NO: 19594 - DNA, 20 bp, human
gcacatccctccacttgagt

SEQ ID NO: 19595 - DNA, 20 bp, human
gtacttaggagtacacgtgc

SEQ ID NO: 19596 - DNA, 20 bp, human
gggcattcgcgtccccgaga

SEQ ID NO: 19597 - DNA, 20 bp, human
gtcagggtgtggcctcaggt

SEQ ID NO: 19598 - DNA, 20 bp, human
gtgtggcctcaggtaggacg

SEQ ID NO: 19599 - DNA, 20 bp, human
gctccagccacactccgacc

SEQ ID NO: 19600 - DNA, 20 bp, human
gccactgctgcgccctctcg

SEQ ID NO: 19601 - DNA, 20 bp, human
gggcctcaggtaggacgcgg

SEQ ID NO: 19602 - DNA, 20 bp, human
gcgccgccgcgtcctacctg

SEQ ID NO: 19603 - DNA, 20 bp, human
gcagccggggaacccacctg

SEQ ID NO: 19604 - DNA, 20 bp, human
gctctcgccgcgaacctccg

SEQ ID NO: 19605 - DNA, 20 bp, human
gcggcggcgaacccagagcg

SEQ ID NO: 19606 - DNA, 20 bp, human
ggcagctgttacggtaagtg

SEQ ID NO: 19607 - DNA, 20 bp, human
gctcacaccagagccccgca

SEQ ID NO: 19608 - DNA, 20 bp, human
gtgttacggtaagtgaggag

SEQ ID NO: 19609 - DNA, 20 bp, human
ggccccggaataccacatag

SEQ ID NO: 19610 - DNA, 20 bp, human
gcagctgcccagtaaacgct

SEQ ID NO: 19611 - DNA, 20 bp, human
ggcccggaggaaatcgggag

SEQ ID NO: 19612 - DNA, 20 bp, human
gcgtaaaggccggaagtaaa

SEQ ID NO: 19613 - DNA, 20 bp, human
gtctgtcgcctgtagcccgg

SEQ ID NO: 19614 - DNA, 20 bp, human
ggcccagccagcgtaaaggc

SEQ ID NO: 19615 - DNA, 20 bp, human
gtcagtcgctcaggtctcta

SEQ ID NO: 19616 - DNA, 20 bp, human
gcaaagtcggagggctggga

SEQ ID NO: 19617 - DNA, 20 bp, human
gccactcctggactcaccga

SEQ ID NO: 19618 - DNA, 20 bp, human
ggggaggccgaggagacgcc

SEQ ID NO: 19619 - DNA, 20 bp, human
gaggctcgctctctccgcag

SEQ ID NO: 19620 - DNA, 20 bp, human
ggccgtgaccggagacatct

SEQ ID NO: 19621 - DNA, 20 bp, human
gggatcccctcacaactcct

SEQ ID NO: 19622 - DNA, 20 bp, human
ggagagagaagcccgcccta

SEQ ID NO: 19623 - DNA, 20 bp, human
ggggcccccaaggctcccta

SEQ ID NO: 19624 - DNA, 20 bp, human
gcgcgtgagccaaagtcgga

SEQ ID NO: 19625 - DNA, 20 bp, human
ggagggtccgctgggaacga

SEQ ID NO: 19626 - DNA, 20 bp, human
gcggtaagcccgaggctcaa

SEQ ID NO: 19627 - DNA, 20 bp, human
ggtgaggcaggacatggcgg

SEQ ID NO: 19628 - DNA, 20 bp, human
gtagcagtaggagacatggt

SEQ ID NO: 19629 - DNA, 20 bp, human
gcagattggcaggtccccgc

SEQ ID NO: 19630 - DNA, 20 bp, human
gttctcctccggtaagcccg

SEQ ID NO: 19631 - DNA, 20 bp, human
ggaaggcaggaatatccctg

SEQ ID NO: 19632 - DNA, 20 bp, human
gtccccgccggcagtgcgtg

SEQ ID NO: 19633 - DNA, 20 bp, human
gtacatagcagtaggagaca

SEQ ID NO: 19634 - DNA, 20 bp, human
ggcctcaccacacgcactgc

SEQ ID NO: 19635 - DNA, 20 bp, human
ggactctattcagggtgcta

SEQ ID NO: 19636 - DNA, 20 bp, human
gcggcagtcgccactcaccg

SEQ ID NO: 19637 - DNA, 20 bp, human
gcggcagaaccgcttcttca

SEQ ID NO: 19638 - DNA, 20 bp, human
gggtcgtcaacctcggtgag

SEQ ID NO: 19639 - DNA, 20 bp, human
gcgggcgggcttcaccgcgt

SEQ ID NO: 19640 - DNA, 20 bp, human
gctgtagggcacgcagaagg

SEQ ID NO: 19641 - DNA, 20 bp, human
gaggcggagcgcgacctcgt

SEQ ID NO: 19642 - DNA, 20 bp, human
ggacctcgtgggccctcctc

SEQ ID NO: 19643 - DNA, 20 bp, human
ggagcgccgggaaggccaac

SEQ ID NO: 19644 - DNA, 20 bp, human
gccagcctgcgtccccggcg

SEQ ID NO: 19645 - DNA, 20 bp, human
gcgctcaaggtcgtcaacct

SEQ ID NO: 19646 - DNA, 20 bp, human
gaggagccaggcaaacacca

SEQ ID NO: 19647 - DNA, 20 bp, human
gcactgccccagagacatat

SEQ ID NO: 19648 - DNA, 20 bp, human
gatgtctctggggcagtgtg

SEQ ID NO: 19649 - DNA, 20 bp, human
gtggcgagcgctccttccac

SEQ ID NO: 19650 - DNA, 20 bp, human
gaggccactcatcagagtcc

SEQ ID NO: 19651 - DNA, 20 bp, human
ggtggcctggttactgaata

SEQ ID NO: 19652 - DNA, 20 bp, human
ggcagggaccacatgcaccc

SEQ ID NO: 19653 - DNA, 20 bp, human
ggcagacagctgggagttcc

SEQ ID NO: 19654 - DNA, 20 bp, human
gggagcagccagggtgcatg

SEQ ID NO: 19655 - DNA, 20 bp, human
gcaccagggcgagtgagctc

SEQ ID NO: 19656 - DNA, 20 bp, human
ggcagatccccacaacatcc

SEQ ID NO: 19657 - DNA, 20 bp, human
gagcaactggaagtggtcgc

SEQ ID NO: 19658 - DNA, 20 bp, human
gaaccacgaattctttctgg

SEQ ID NO: 19659 - DNA, 20 bp, human
gcagaggctattcggactta

SEQ ID NO: 19660 - DNA, 20 bp, human
gacccgggaaaacagctccc

SEQ ID NO: 19661 - DNA, 20 bp, human
ggaaagccggtgaacgccta

SEQ ID NO: 19662 - DNA, 20 bp, human
gctgcgctccacttcgggag

SEQ ID NO: 19663 - DNA, 20 bp, human
gccggctcccggatgttgtg

SEQ ID NO: 19664 - DNA, 20 bp, human
gccccgaaaagcactttaca

SEQ ID NO: 19665 - DNA, 20 bp, human
gaccgcaaccgggtgagttt

SEQ ID NO: 19666 - DNA, 20 bp, human
ggggtccgcggtccctcgag

SEQ ID NO: 19667 - DNA, 20 bp, human
ggagggagggccgccctcag

SEQ ID NO: 19668 - DNA, 20 bp, human
gggagaaccggtggcacggg

SEQ ID NO: 19669 - DNA, 20 bp, human
ggacccggcaatcgctcccg

SEQ ID NO: 19670 - DNA, 20 bp, human
ggtctgcgaggccgcgtgta

SEQ ID NO: 19671 - DNA, 20 bp, human
ggtgcggcgagcgcgaggtc

SEQ ID NO: 19672 - DNA, 20 bp, human
gcgcggcctcgcagacttgg

SEQ ID NO: 19673 - DNA, 20 bp, human
gtggacttcgagaagagggt

SEQ ID NO: 19674 - DNA, 20 bp, human
gcaacttcgggaggtgcgag

SEQ ID NO: 19675 - DNA, 20 bp, human
ggcagggcgccccacacagg

SEQ ID NO: 19676 - DNA, 20 bp, human
gtgaggagcggagaccaaag

SEQ ID NO: 19677 - DNA, 20 bp, human
gcagctagggcctgccccgg

SEQ ID NO: 19678 - DNA, 20 bp, human
gcctagctgtgcggcccccg

SEQ ID NO: 19679 - DNA, 20 bp, human
gccgcggctgcggaagtggg

SEQ ID NO: 19680 - DNA, 20 bp, human
gcagcaacaactccccgccg

SEQ ID NO: 19681 - DNA, 20 bp, human
gtggggggcacgttgaggag

SEQ ID NO: 19682 - DNA, 20 bp, human
gtacacctggacgtgacgtg

SEQ ID NO: 19683 - DNA, 20 bp, human
ggccgcagcacgtgcaagat

SEQ ID NO: 19684 - DNA, 20 bp, human
ggaccaaagcggctgggaag

SEQ ID NO: 19685 - DNA, 20 bp, human
gagcgctggtccacgtccga

SEQ ID NO: 19686 - DNA, 20 bp, human
gctgggcagagcctgaacca

SEQ ID NO: 19687 - DNA, 20 bp, human
gacagaccagtcaggagccc

SEQ ID NO: 19688 - DNA, 20 bp, human
gtgagccaaacagaccagtc

SEQ ID NO: 19689 - DNA, 20 bp, human
gtctgcccaggagcctctaa

SEQ ID NO: 19690 - DNA, 20 bp, human
gaggcactggttggattcgg

SEQ ID NO: 19691 - DNA, 20 bp, human
gcagacctttagaggctcct

SEQ ID NO: 19692 - DNA, 20 bp, human
ggttctgagccgaggatgcc

SEQ ID NO: 19693 - DNA, 20 bp, human
ggttgtgccgaggcactggt

SEQ ID NO: 19694 - DNA, 20 bp, human
gaggatgccgggcagacatg

SEQ ID NO: 19695 - DNA, 20 bp, human
ggctcacagtaagtggcctg

SEQ ID NO: 19696 - DNA, 20 bp, human
gggagagggagcagcgtcac

SEQ ID NO: 19697 - DNA, 20 bp, human
ggcctacgggtacccagaag

SEQ ID NO: 19698 - DNA, 20 bp, human
gctccccgcgaacaaaaggg

SEQ ID NO: 19699 - DNA, 20 bp, human
gcctctgaggcgctatgggg

SEQ ID NO: 19700 - DNA, 20 bp, human
gtatggggcggtggaggaga

SEQ ID NO: 19701 - DNA, 20 bp, human
ggccccttctgggtacccgt

SEQ ID NO: 19702 - DNA, 20 bp, human
gaacgccagcagtggaccca

SEQ ID NO: 19703 - DNA, 20 bp, human
gggcttctcggcttccagat

SEQ ID NO: 19704 - DNA, 20 bp, human
gggtacccgtaggcgctccc

SEQ ID NO: 19705 - DNA, 20 bp, human
ggcgcgaggaacgccagcag

SEQ ID NO: 19706 - DNA, 20 bp, human
gccagcgtggtcgtaaccca

SEQ ID NO: 19707 - DNA, 20 bp, human
gacagctagtcccggcctac

SEQ ID NO: 19708 - DNA, 20 bp, human
gtaggaactggcggaggaag

SEQ ID NO: 19709 - DNA, 20 bp, human
ggccccgagacagctagtcc

SEQ ID NO: 19710 - DNA, 20 bp, human
gcccaaggcaacggcccatc

SEQ ID NO: 19711 - DNA, 20 bp, human
gtggtcgtaacccaaggcaa

SEQ ID NO: 19712 - DNA, 20 bp, human
gaggcttatggcataaaggg

SEQ ID NO: 19713 - DNA, 20 bp, human
gtccgcttggccccacaggt

SEQ ID NO: 19714 - DNA, 20 bp, human
gtttgtggcacggtaggaac

SEQ ID NO: 19715 - DNA, 20 bp, human
ggcacggtaggaactggcgg

SEQ ID NO: 19716 - DNA, 20 bp, human
gtaggttcagggctacatct

SEQ ID NO: 19717 - DNA, 20 bp, human
gcccttgtcggccagtatca

SEQ ID NO: 19718 - DNA, 20 bp, human
gtggtagcgggatcaggaca

SEQ ID NO: 19719 - DNA, 20 bp, human
gaacctatccatcaagtcta

SEQ ID NO: 19720 - DNA, 20 bp, human
gggaaaccccagctcccgaa

SEQ ID NO: 19721 - DNA, 20 bp, human
gttccttagacttgatggat

SEQ ID NO: 19722 - DNA, 20 bp, human
gaactcaccgcagctaccca

SEQ ID NO: 19723 - DNA, 20 bp, human
gcacattcttgaactgggaa

SEQ ID NO: 19724 - DNA, 20 bp, human
gcgcagctacccagggaaag

SEQ ID NO: 19725 - DNA, 20 bp, human
gccccgtctatcccagggaa

SEQ ID NO: 19726 - DNA, 20 bp, human
ggctagcctgaggagaccgg

SEQ ID NO: 19727 - DNA, 20 bp, human
ggcgatggcgaagatatcgg

SEQ ID NO: 19728 - DNA, 20 bp, human
gacccgggccgcggaggaaa

SEQ ID NO: 19729 - DNA, 20 bp, human
ggactgaggagaggacgggg

SEQ ID NO: 19730 - DNA, 20 bp, human
gctccgcccccggtctcctc

SEQ ID NO: 19731 - DNA, 20 bp, human
gtgagggcgacgcgagagag

SEQ ID NO: 19732 - DNA, 20 bp, human
gggcgggccgagcagttccg

SEQ ID NO: 19733 - DNA, 20 bp, human
ggcggcgcggcccgcacaga

SEQ ID NO: 19734 - DNA, 20 bp, human
gccggccggaggctagcctg

SEQ ID NO: 19735 - DNA, 20 bp, human
ggaggctagcctgaggagac

SEQ ID NO: 19736 - DNA, 20 bp, human
gagtccagcaccaggaagag

SEQ ID NO: 19737 - DNA, 20 bp, human
ggacctagagaggaagtggt

SEQ ID NO: 19738 - DNA, 20 bp, human
gaggaagagtggctctagga

SEQ ID NO: 19739 - DNA, 20 bp, human
ggagtggctctaggagggag

SEQ ID NO: 19740 - DNA, 20 bp, human
gtaagaggtgcaggcttgga

SEQ ID NO: 19741 - DNA, 20 bp, human
gagggtgcctcagacaagaa

SEQ ID NO: 19742 - DNA, 20 bp, human
gttcctggtgctggactaag

SEQ ID NO: 19743 - DNA, 20 bp, human
ggtcttgctcagacctagag

SEQ ID NO: 19744 - DNA, 20 bp, human
gccgggcctctacgtctgag

SEQ ID NO: 19745 - DNA, 20 bp, human
gtcaccttgggtcagtccct

SEQ ID NO: 19746 - DNA, 20 bp, human
gcgaactgctcggaacacag

SEQ ID NO: 19747 - DNA, 20 bp, human
ggggctgggatccaaaagct

SEQ ID NO: 19748 - DNA, 20 bp, human
ggcctgccacgtccaccgtg

SEQ ID NO: 19749 - DNA, 20 bp, human
gaggtcagctcggtcgtctg

SEQ ID NO: 19750 - DNA, 20 bp, human
gctcggcatggctgacgacg

SEQ ID NO: 19751 - DNA, 20 bp, human
gtggacgggtgactgagact

SEQ ID NO: 19752 - DNA, 20 bp, human
gactgagactcggagcccgg

SEQ ID NO: 19753 - DNA, 20 bp, human
gtccccggagccgaactgct

SEQ ID NO: 19754 - DNA, 20 bp, human
ggggatccaaaagctcggca

SEQ ID NO: 19755 - DNA, 20 bp, human
gtccctccccaataatggac

SEQ ID NO: 19756 - DNA, 20 bp, human
gcccgccggcagcatgaagg

SEQ ID NO: 19757 - DNA, 20 bp, human
gagccgccggtgcgtccccc

SEQ ID NO: 19758 - DNA, 20 bp, human
ggccggcagcatgaaggcgg

SEQ ID NO: 19759 - DNA, 20 bp, human
gcctgccgcgcaggcctcac

SEQ ID NO: 19760 - DNA, 20 bp, human
gaccggcgcgagcagcccgc

SEQ ID NO: 19761 - DNA, 20 bp, human
gcagcccgccggcagcatga

SEQ ID NO: 19762 - DNA, 20 bp, human
gtcagaggcggcaaattgca

SEQ ID NO: 19763 - DNA, 20 bp, human
gagcccaaacagacccgagg

SEQ ID NO: 19764 - DNA, 20 bp, human
gcgctgtgcgcaggcgtcca

SEQ ID NO: 19765 - DNA, 20 bp, human
gcagccgtcgcacggccagg

SEQ ID NO: 19766 - DNA, 20 bp, human
gctccgctggaccgcggtag

SEQ ID NO: 19767 - DNA, 20 bp, human
ggtcttgaccgtagaatccc

SEQ ID NO: 19768 - DNA, 20 bp, human
gtaaggaagcagcggcgggt

SEQ ID NO: 19769 - DNA, 20 bp, human
ggtgcctaggataggatgaa

SEQ ID NO: 19770 - DNA, 20 bp, human
gctggacgagtcgggagatc

SEQ ID NO: 19771 - DNA, 20 bp, human
gcgctggatgagggtaatgg

SEQ ID NO: 19772 - DNA, 20 bp, human
ggccgaccccatcacaagta

SEQ ID NO: 19773 - DNA, 20 bp, human
gcgcagagaggcagcagacg

SEQ ID NO: 19774 - DNA, 20 bp, human
gtggccgtctttccttggta

SEQ ID NO: 19775 - DNA, 20 bp, human
gcgccgctgcttccttacca

SEQ ID NO: 19776 - DNA, 20 bp, human
ggcggcagcgggggcaacga

SEQ ID NO: 19777 - DNA, 20 bp, human
gcgagccgagaggacgaaag

SEQ ID NO: 19778 - DNA, 20 bp, human
gtggagcccagcgagccgag

SEQ ID NO: 19779 - DNA, 20 bp, human
gcccgagacgagcaactgac

SEQ ID NO: 19780 - DNA, 20 bp, human
ggaaccaatgctggacctgg

SEQ ID NO: 19781 - DNA, 20 bp, human
gggcgcgactgcagtaaaag

SEQ ID NO: 19782 - DNA, 20 bp, human
ggcagaagggacccgagcta

SEQ ID NO: 19783 - DNA, 20 bp, human
ggcgttcgggcactacctcc

SEQ ID NO: 19784 - DNA, 20 bp, human
gagtgcccgaacgctctctg

SEQ ID NO: 19785 - DNA, 20 bp, human
gtgaggtgaggtgtggtgtt

SEQ ID NO: 19786 - DNA, 20 bp, human
gccggaaggccgttattcag

SEQ ID NO: 19787 - DNA, 20 bp, human
gggcggggctctgagaaccg

SEQ ID NO: 19788 - DNA, 20 bp, human
ggagggagagtgctgaagaa

SEQ ID NO: 19789 - DNA, 20 bp, human
ggaaggccgttattcagagg

SEQ ID NO: 19790 - DNA, 20 bp, human
gtgagaaacccaccccgaga

SEQ ID NO: 19791 - DNA, 20 bp, human
gacgcgcaaaggcccgaaag

SEQ ID NO: 19792 - DNA, 20 bp, human
gaccccgagacggagccgga

SEQ ID NO: 19793 - DNA, 20 bp, human
ggccttccggctccgtctcg

SEQ ID NO: 19794 - DNA, 20 bp, human
gaatgtaaagctccgctgag

SEQ ID NO: 19795 - DNA, 20 bp, human
gccgaaagaggagctgggcg

SEQ ID NO: 19796 - DNA, 20 bp, human
gcggagggctcggcgatcag

SEQ ID NO: 19797 - DNA, 20 bp, human
ggcagccgcagagccgtcct

SEQ ID NO: 19798 - DNA, 20 bp, human
gcgcagctcggcctgcaccg

SEQ ID NO: 19799 - DNA, 20 bp, human
ggcagagccgtcctcggcgg

SEQ ID NO: 19800 - DNA, 20 bp, human
ggggaggccgcggaggatgg

SEQ ID NO: 19801 - DNA, 20 bp, human
gagggctcggcgatcagcgg

SEQ ID NO: 19802 - DNA, 20 bp, human
ggacgacgttgctcagtctt

SEQ ID NO: 19803 - DNA, 20 bp, human
gggagcacgggcccgagcac

SEQ ID NO: 19804 - DNA, 20 bp, human
gtcgtcgtcaagcggcccgg

SEQ ID NO: 19805 - DNA, 20 bp, human
gccgcggccccgtgcaacca

SEQ ID NO: 19806 - DNA, 20 bp, human
gcctaaccgagctacttcaa

SEQ ID NO: 19807 - DNA, 20 bp, human
ggagctatggcttcccggaa

SEQ ID NO: 19808 - DNA, 20 bp, human
gcatgacaggcaagtaaggt

SEQ ID NO: 19809 - DNA, 20 bp, human
gacactacagtcagtcttgg

SEQ ID NO: 19810 - DNA, 20 bp, human
gtcctctttgacttcagaag

SEQ ID NO: 19811 - DNA, 20 bp, human
gccgtgaaaaatgggtccac

SEQ ID NO: 19812 - DNA, 20 bp, human
ggctttaccatgcagagcta

SEQ ID NO: 19813 - DNA, 20 bp, human
gagtttccgttgaagtagct

SEQ ID NO: 19814 - DNA, 20 bp, human
gttgttgggttagttctcat

SEQ ID NO: 19815 - DNA, 20 bp, human
gatgcagagctatggcttcc

SEQ ID NO: 19816 - DNA, 20 bp, human
gcgcgctgcaacttgcacgg

SEQ ID NO: 19817 - DNA, 20 bp, human
gctgcaagacagagcagcgg

SEQ ID NO: 19818 - DNA, 20 bp, human
ggactttgctgcggagacac

SEQ ID NO: 19819 - DNA, 20 bp, human
ggtcccgccccgctcctaga

SEQ ID NO: 19820 - DNA, 20 bp, human
ggcgccgtcacgagttcctt

SEQ ID NO: 19821 - DNA, 20 bp, human
gccgccccgctcctagaggg

SEQ ID NO: 19822 - DNA, 20 bp, human
gcatggcccggccggcgctc

SEQ ID NO: 19823 - DNA, 20 bp, human
gggccgcgctgcaacttgca

SEQ ID NO: 19824 - DNA, 20 bp, human
ggcgttctggtccattccca

SEQ ID NO: 19825 - DNA, 20 bp, human
gattcccaaggaactcgtga

SEQ ID NO: 19826 - DNA, 20 bp, human
gggccatcaagtccagacaa

SEQ ID NO: 19827 - DNA, 20 bp, human
gctacccaaggacattaagg

SEQ ID NO: 19828 - DNA, 20 bp, human
gtgacttagaaggtagggtg

SEQ ID NO: 19829 - DNA, 20 bp, human
gccactccagcacacaggtg

SEQ ID NO: 19830 - DNA, 20 bp, human
gctcaaggtagttgcagtag

SEQ ID NO: 19831 - DNA, 20 bp, human
gagctagtgagaactaccca

SEQ ID NO: 19832 - DNA, 20 bp, human
gccacccccttaatgtcctt

SEQ ID NO: 19833 - DNA, 20 bp, human
ggtcttgctagtggcttggg

SEQ ID NO: 19834 - DNA, 20 bp, human
gcattgtggagtcttgctag

SEQ ID NO: 19835 - DNA, 20 bp, human
gggaattagttaatatgatt

SEQ ID NO: 19836 - DNA, 20 bp, human
gtgatggccggactcggacg

SEQ ID NO: 19837 - DNA, 20 bp, human
ggcttaggagctgaagatcg

SEQ ID NO: 19838 - DNA, 20 bp, human
gtaggccccggagtagatac

SEQ ID NO: 19839 - DNA, 20 bp, human
ggcgcggacggtagttgctg

SEQ ID NO: 19840 - DNA, 20 bp, human
gtgaaggcggggaaataccg

SEQ ID NO: 19841 - DNA, 20 bp, human
gagccactgatggccggact

SEQ ID NO: 19842 - DNA, 20 bp, human
gaggcacagcagcgtcctct

SEQ ID NO: 19843 - DNA, 20 bp, human
gtcagtggctgcagatccgg

SEQ ID NO: 19844 - DNA, 20 bp, human
ggtcgtgtaagcagcggagg

SEQ ID NO: 19845 - DNA, 20 bp, human
gccagcccccggacgaggag

SEQ ID NO: 19846 - DNA, 20 bp, human
gggtcacagccaacattcag

SEQ ID NO: 19847 - DNA, 20 bp, human
gtggtttatccagggagagg

SEQ ID NO: 19848 - DNA, 20 bp, human
ggggcagccaccggagagtg

SEQ ID NO: 19849 - DNA, 20 bp, human
gcaaagggcagccttatata

SEQ ID NO: 19850 - DNA, 20 bp, human
ggcagcgacatcagcttggt

SEQ ID NO: 19851 - DNA, 20 bp, human
gtctccctcgagaaaaatgg

SEQ ID NO: 19852 - DNA, 20 bp, human
gctctaagctgggtgactgt

SEQ ID NO: 19853 - DNA, 20 bp, human
ggagagtgcggctgaacaga

SEQ ID NO: 19854 - DNA, 20 bp, human
gaagtggtttatccagggag

SEQ ID NO: 19855 - DNA, 20 bp, human
gaacagaaggctcaacaccc

SEQ ID NO: 19856 - DNA, 20 bp, human
ggagaccggccagcaagcga

SEQ ID NO: 19857 - DNA, 20 bp, human
gcgaccgcggagcccaccct

SEQ ID NO: 19858 - DNA, 20 bp, human
gcccggcgcaaagcgtcctg

SEQ ID NO: 19859 - DNA, 20 bp, human
ggaagagaaaccggcgaccg

SEQ ID NO: 19860 - DNA, 20 bp, human
gggcagcgctcagacctccg

SEQ ID NO: 19861 - DNA, 20 bp, human
gtgtagtttcggccgagggt

SEQ ID NO: 19862 - DNA, 20 bp, human
gccaggctgggccctccagg

SEQ ID NO: 19863 - DNA, 20 bp, human
gagacaccgaaacgggaata

SEQ ID NO: 19864 - DNA, 20 bp, human
ggggccctccaggcggggag

SEQ ID NO: 19865 - DNA, 20 bp, human
gggcccagcctggcagttag

SEQ ID NO: 19866 - DNA, 20 bp, human
ggctgccgccgctaagggag

SEQ ID NO: 19867 - DNA, 20 bp, human
gcgccggcgaggagagtctg

SEQ ID NO: 19868 - DNA, 20 bp, human
gcgcccggtgagcccaccaa

SEQ ID NO: 19869 - DNA, 20 bp, human
gccgagtgcgaccaacaggt

SEQ ID NO: 19870 - DNA, 20 bp, human
gtgctcctctcccttagcgg

SEQ ID NO: 19871 - DNA, 20 bp, human
gtcgctgctgccgccgctaa

SEQ ID NO: 19872 - DNA, 20 bp, human
gtcgcactcggggcatgatt

SEQ ID NO: 19873 - DNA, 20 bp, human
gagctagggcctggcctcgg

SEQ ID NO: 19874 - DNA, 20 bp, human
ggtgcggcacactctcgccg

SEQ ID NO: 19875 - DNA, 20 bp, human
gcaaaggcgcgctcctccag

SEQ ID NO: 19876 - DNA, 20 bp, human
gtcggctataaggagagagg

SEQ ID NO: 19877 - DNA, 20 bp, human
ggccgaggcaggctatactg

SEQ ID NO: 19878 - DNA, 20 bp, human
ggtgaggaggaccacagcgg

SEQ ID NO: 19879 - DNA, 20 bp, human
ggtcccaggcgtacagagca

SEQ ID NO: 19880 - DNA, 20 bp, human
gagtgagcagaggccggcca

SEQ ID NO: 19881 - DNA, 20 bp, human
gctctgttctaggaagacgg

SEQ ID NO: 19882 - DNA, 20 bp, human
gggccggccatggccagcct

SEQ ID NO: 19883 - DNA, 20 bp, human
ggccaggggctggatcttcc

SEQ ID NO: 19884 - DNA, 20 bp, human
gatagcctgcctcggctata

SEQ ID NO: 19885 - DNA, 20 bp, human
ggccccagtatagcctgcct

SEQ ID NO: 19886 - DNA, 20 bp, human
gcatggagggccagtgtggt

SEQ ID NO: 19887 - DNA, 20 bp, human
gcaatgtaccccctaggcag

SEQ ID NO: 19888 - DNA, 20 bp, human
gcttccatggagggccagtg

SEQ ID NO: 19889 - DNA, 20 bp, human
gagaccaaggcttccatgga

SEQ ID NO: 19890 - DNA, 20 bp, human
gccactcccaaccaacaggg

SEQ ID NO: 19891 - DNA, 20 bp, human
gtagggtagcgggcagaaca

SEQ ID NO: 19892 - DNA, 20 bp, human
gccctgctgcacccaagtcc

SEQ ID NO: 19893 - DNA, 20 bp, human
gacctgccaatgtaccccct

SEQ ID NO: 19894 - DNA, 20 bp, human
gggaagaggagtcgtgtctt

SEQ ID NO: 19895 - DNA, 20 bp, human
gggagtcgtgtcttgggcat

SEQ ID NO: 19896 - DNA, 20 bp, human
gggcgtcagtcgaggagtca

SEQ ID NO: 19897 - DNA, 20 bp, human
gcggccgggtgagctcctca

SEQ ID NO: 19898 - DNA, 20 bp, human
gggagagcgaggcggaccag

SEQ ID NO: 19899 - DNA, 20 bp, human
gggagctcacccggccgccg

SEQ ID NO: 19900 - DNA, 20 bp, human
gggtatggcccaccgaccag

SEQ ID NO: 19901 - DNA, 20 bp, human
gagctcctcaaggtctcgga

SEQ ID NO: 19902 - DNA, 20 bp, human
gcgcgccaaggcgtcagtcg

SEQ ID NO: 19903 - DNA, 20 bp, human
gccagtggttgagacaggtg

SEQ ID NO: 19904 - DNA, 20 bp, human
gtgtaggcagctggagtctc

SEQ ID NO: 19905 - DNA, 20 bp, human
ggcagggtgggcccgatccc

SEQ ID NO: 19906 - DNA, 20 bp, human
gggcttccgagtccctaagt

SEQ ID NO: 19907 - DNA, 20 bp, human
gtaaggctgggtggtctcac

SEQ ID NO: 19908 - DNA, 20 bp, human
gagctgggtgcaccacgaca

SEQ ID NO: 19909 - DNA, 20 bp, human
gtaggtgggaccagcaggat

SEQ ID NO: 19910 - DNA, 20 bp, human
gccggataatcgaagaagtc

SEQ ID NO: 19911 - DNA, 20 bp, human
gtccggactcagaccaagcc

SEQ ID NO: 19912 - DNA, 20 bp, human
gtgccacggcgtcagccctg

SEQ ID NO: 19913 - DNA, 20 bp, human
gcctcgagagataaaggcag

SEQ ID NO: 19914 - DNA, 20 bp, human
gaaagtgtgatgcccactta

SEQ ID NO: 19915 - DNA, 20 bp, human
gcaggtctgtctaagaagcg

SEQ ID NO: 19916 - DNA, 20 bp, human
ggcgatgcagggtcccctga

SEQ ID NO: 19917 - DNA, 20 bp, human
ggcggcggctggagcgatgc

SEQ ID NO: 19918 - DNA, 20 bp, human
gaagttgcgagtgcccacct

SEQ ID NO: 19919 - DNA, 20 bp, human
gcttccaggttgctaatacg

SEQ ID NO: 19920 - DNA, 20 bp, human
gaggttgctaatacgagggc

SEQ ID NO: 19921 - DNA, 20 bp, human
gtgcgagtgtgcggactcag

SEQ ID NO: 19922 - DNA, 20 bp, human
gcgcagctcagtgcatgggt

SEQ ID NO: 19923 - DNA, 20 bp, human
ggcgcggtgtcagttactat

SEQ ID NO: 19924 - DNA, 20 bp, human
gggatcgcagctcagtgcat

SEQ ID NO: 19925 - DNA, 20 bp, human
gatctacgcgcggagaggcg

SEQ ID NO: 19926 - DNA, 20 bp, human
gtgccgggccgggaactcac

SEQ ID NO: 19927 - DNA, 20 bp, human
gcccaacctcaaccgctcag

SEQ ID NO: 19928 - DNA, 20 bp, human
gtgctccatgacctatgcac

SEQ ID NO: 19929 - DNA, 20 bp, human
gctgggcgcgggctagtcag

SEQ ID NO: 19930 - DNA, 20 bp, human
gatgtaagtgaggttcctgt

SEQ ID NO: 19931 - DNA, 20 bp, human
gcgggcgcgcgggcgttgtt

SEQ ID NO: 19932 - DNA, 20 bp, human
gactcttgaccgccacccac

SEQ ID NO: 19933 - DNA, 20 bp, human
ggcgggctagtcagcgggac

SEQ ID NO: 19934 - DNA, 20 bp, human
ggctagtcagcgggacgggc

SEQ ID NO: 19935 - DNA, 20 bp, human
gaactcacaggcgaggtgtc

SEQ ID NO: 19936 - DNA, 20 bp, human
gtacatggactggtcctcag

SEQ ID NO: 19937 - DNA, 20 bp, human
gccggcccgtccaggacctg

SEQ ID NO: 19938 - DNA, 20 bp, human
gtgagctccagccagaacag

SEQ ID NO: 19939 - DNA, 20 bp, human
gaggtgtcctcaaggacaag

SEQ ID NO: 19940 - DNA, 20 bp, human
gtatcctcaaccccatgaag

SEQ ID NO: 19941 - DNA, 20 bp, human
ggtgagccgcctcgacaagt

SEQ ID NO: 19942 - DNA, 20 bp, human
gagtggttccgagagctaca

SEQ ID NO: 19943 - DNA, 20 bp, human
gttccgagagctacatggac

SEQ ID NO: 19944 - DNA, 20 bp, human
gctggttctccaacttgtcg

SEQ ID NO: 19945 - DNA, 20 bp, human
ggctgggcgtctccttccct

SEQ ID NO: 19946 - DNA, 20 bp, human
ggtgactgactataatacta

SEQ ID NO: 19947 - DNA, 20 bp, human
gtgccacttaaccagtttgg

SEQ ID NO: 19948 - DNA, 20 bp, human
ggttaagtggcaagtactta

SEQ ID NO: 19949 - DNA, 20 bp, human
ggaagtcaagacttttccca

SEQ ID NO: 19950 - DNA, 20 bp, human
gacttgccacttaaccagtt

SEQ ID NO: 19951 - DNA, 20 bp, human
ggaatagggattcagtcact

SEQ ID NO: 19952 - DNA, 20 bp, human
gtaattagctgataattgtc

SEQ ID NO: 19953 - DNA, 20 bp, human
gtaagtcaacactgggaata

SEQ ID NO: 19954 - DNA, 20 bp, human
gttgatattatgtaaaggga

SEQ ID NO: 19955 - DNA, 20 bp, human
gttgcacactataatttcct

SEQ ID NO: 19956 - DNA, 20 bp, human
gccccaaagagcaggttgtt

SEQ ID NO: 19957 - DNA, 20 bp, human
gtggacagcccagtcccaga

SEQ ID NO: 19958 - DNA, 20 bp, human
gagcaggttgttaggctctt

SEQ ID NO: 19959 - DNA, 20 bp, human
gaggcggccctgtctagcaa

SEQ ID NO: 19960 - DNA, 20 bp, human
gcctgtgcggaaaaaataaa

SEQ ID NO: 19961 - DNA, 20 bp, human
gaatagcccacagggtccca

SEQ ID NO: 19962 - DNA, 20 bp, human
gaccattcttaactatagta

SEQ ID NO: 19963 - DNA, 20 bp, human
gtgggggcagtaggacaatg

SEQ ID NO: 19964 - DNA, 20 bp, human
gtccttactatagttaagaa

SEQ ID NO: 19965 - DNA, 20 bp, human
ggcttcctggcaagagtact

SEQ ID NO: 19966 - DNA, 20 bp, human
ggatggcctagcataatggt

SEQ ID NO: 19967 - DNA, 20 bp, human
gccactcactaagtgacttg

SEQ ID NO: 19968 - DNA, 20 bp, human
gtatgctaggccatctccca

SEQ ID NO: 19969 - DNA, 20 bp, human
gagaagcattcttcccacat

SEQ ID NO: 19970 - DNA, 20 bp, human
gagcctggtgagtctctgtt

SEQ ID NO: 19971 - DNA, 20 bp, human
gatccttgcctttcccatgt

SEQ ID NO: 19972 - DNA, 20 bp, human
gaaactggtgggaaaacctc

SEQ ID NO: 19973 - DNA, 20 bp, human
gttatcagcattgatctcag

SEQ ID NO: 19974 - DNA, 20 bp, human
gacagtatgaagccagaaac

SEQ ID NO: 19975 - DNA, 20 bp, human
gacaaagcaagacaggaggt

SEQ ID NO: 19976 - DNA, 20 bp, human
gaagcaccatggtccttcga

SEQ ID NO: 19977 - DNA, 20 bp, human
gcggtgaccattgggctgta

SEQ ID NO: 19978 - DNA, 20 bp, human
gcagggacgaggctctgacg

SEQ ID NO: 19979 - DNA, 20 bp, human
ggcgccacaacacgatgacg

SEQ ID NO: 19980 - DNA, 20 bp, human
gagagcctcgtccctgaggg

SEQ ID NO: 19981 - DNA, 20 bp, human
ggtcaccgcaggcagaagag

SEQ ID NO: 19982 - DNA, 20 bp, human
gcagagacgtctccaccctc

SEQ ID NO: 19983 - DNA, 20 bp, human
gcgatgacgtggaagcacca

SEQ ID NO: 19984 - DNA, 20 bp, human
ggacgaggctctgacgtggc

SEQ ID NO: 19985 - DNA, 20 bp, human
gcgcgggtggagccatccca

SEQ ID NO: 19986 - DNA, 20 bp, human
gggagaaacgcagctgaggg

SEQ ID NO: 19987 - DNA, 20 bp, human
gaaagggacatcagtgactg

SEQ ID NO: 19988 - DNA, 20 bp, human
gccgggtgggcgctgaatcc

SEQ ID NO: 19989 - DNA, 20 bp, human
gcctggagaaacgcagctga

SEQ ID NO: 19990 - DNA, 20 bp, human
gactgcggtggcgtctaccc

SEQ ID NO: 19991 - DNA, 20 bp, human
ggctagcgctgggacccgaa

SEQ ID NO: 19992 - DNA, 20 bp, human
gggcgctgaatcccggacgg

SEQ ID NO: 19993 - DNA, 20 bp, human
gacacctccggcgcccggtg

SEQ ID NO: 19994 - DNA, 20 bp, human
gagcggctgcaaaacacctc

SEQ ID NO: 19995 - DNA, 20 bp, human
gcgccgccaggctaggaatg

SEQ ID NO: 19996 - DNA, 20 bp, human
gcgctgaaagtgacactcgg

SEQ ID NO: 19997 - DNA, 20 bp, human
gcggcgctgaaagtgacact

SEQ ID NO: 19998 - DNA, 20 bp, human
ggcaggcggtggggtagtta

SEQ ID NO: 19999 - DNA, 20 bp, human
ggggcgcgcggggaaaggtc

SEQ ID NO: 20000 - DNA, 20 bp, human
ggcggcggcagcaacaaaaa

SEQ ID NO: 20001 - DNA, 20 bp, human
gccgccgcctgcggtctccc

SEQ ID NO: 20002 - DNA, 20 bp, human
gtgaaagtgacactcggcgg

SEQ ID NO: 20003 - DNA, 20 bp, human
ggcgccgccagttcactgtc

SEQ ID NO: 20004 - DNA, 20 bp, human
gcctggccccgagcacaacc

SEQ ID NO: 20005 - DNA, 20 bp, human
gggcgctccgggaagtggaa

SEQ ID NO: 20006 - DNA, 20 bp, human
gggtcgccgcgattcccggg

SEQ ID NO: 20007 - DNA, 20 bp, human
gggagccagtgtgcgggtaa

SEQ ID NO: 20008 - DNA, 20 bp, human
gggctgcctcccgggaatcg

SEQ ID NO: 20009 - DNA, 20 bp, human
gggccaccgcctcagcgcga

SEQ ID NO: 20010 - DNA, 20 bp, human
gcctgagtgctgaccccgag

SEQ ID NO: 20011 - DNA, 20 bp, human
gacttcccttacccgcacac

SEQ ID NO: 20012 - DNA, 20 bp, human
gggaggcagccgtcgcgctg

SEQ ID NO: 20013 - DNA, 20 bp, human
gggcgcgtccctagacgggg

SEQ ID NO: 20014 - DNA, 20 bp, human
gcgggtaagggaagtccgag

SEQ ID NO: 20015 - DNA, 20 bp, human
ggcctctgccgccccgtcta

SEQ ID NO: 20016 - DNA, 20 bp, human
ggggtaggccagataatcca

SEQ ID NO: 20017 - DNA, 20 bp, human
gttagagacgataacagggt

SEQ ID NO: 20018 - DNA, 20 bp, human
ggtgattagagacgataaca

SEQ ID NO: 20019 - DNA, 20 bp, human
gtcatttctgaagtgagact

SEQ ID NO: 20020 - DNA, 20 bp, human
gatagacaggctaataatat

SEQ ID NO: 20021 - DNA, 20 bp, human
ggccgaagtacgttagaaag

SEQ ID NO: 20022 - DNA, 20 bp, human
gagaatacaaataggtatgt

SEQ ID NO: 20023 - DNA, 20 bp, human
gattcttgtgagatacgtag

SEQ ID NO: 20024 - DNA, 20 bp, human
ggctctttcattggattaga

SEQ ID NO: 20025 - DNA, 20 bp, human
gccagaccaggtcacagctt

SEQ ID NO: 20026 - DNA, 20 bp, human
ggcggccacggagagttcca

SEQ ID NO: 20027 - DNA, 20 bp, human
gtgtagggggcgcagctgga

SEQ ID NO: 20028 - DNA, 20 bp, human
ggcagagcagtagagtagca

SEQ ID NO: 20029 - DNA, 20 bp, human
gttagaggtggggtactggg

SEQ ID NO: 20030 - DNA, 20 bp, human
gcatggccgccacaagtggt

SEQ ID NO: 20031 - DNA, 20 bp, human
gccagggaagacagaagcgg

SEQ ID NO: 20032 - DNA, 20 bp, human
gctgccccgaagcccaccct

SEQ ID NO: 20033 - DNA, 20 bp, human
gccgccacaagtggtaggac

SEQ ID NO: 20034 - DNA, 20 bp, human
gtaccccacctctaacaagg

SEQ ID NO: 20035 - DNA, 20 bp, human
gacccgaaccgaagatgcag

SEQ ID NO: 20036 - DNA, 20 bp, human
gtccaggcctaaatgaataa

SEQ ID NO: 20037 - DNA, 20 bp, human
gggcatgacactgagattga

SEQ ID NO: 20038 - DNA, 20 bp, human
gatgataagtaaacagaaga

SEQ ID NO: 20039 - DNA, 20 bp, human
gagatgccgttgaagaaggg

SEQ ID NO: 20040 - DNA, 20 bp, human
gttcatttaggcctggaggg

SEQ ID NO: 20041 - DNA, 20 bp, human
gagagggaatggtgcaaaag

SEQ ID NO: 20042 - DNA, 20 bp, human
gtctgcactgtagtttgggt

SEQ ID NO: 20043 - DNA, 20 bp, human
gaatttatatggcctctcac

SEQ ID NO: 20044 - DNA, 20 bp, human
gatttgctgatggtaattca

SEQ ID NO: 20045 - DNA, 20 bp, human
gtagagatgccgttgaagaa

SEQ ID NO: 20046 - DNA, 20 bp, human
gctggagggagacagatcga

SEQ ID NO: 20047 - DNA, 20 bp, human
gtcttgggctcccacaaaag

SEQ ID NO: 20048 - DNA, 20 bp, human
gatcccctcagcagggacat

SEQ ID NO: 20049 - DNA, 20 bp, human
ggtccagtctcgggtccccg

SEQ ID NO: 20050 - DNA, 20 bp, human
gcagacagagaggtagctaa

SEQ ID NO: 20051 - DNA, 20 bp, human
gtctcgggtccccgaggagt

SEQ ID NO: 20052 - DNA, 20 bp, human
gggagactgcagcacttcga

SEQ ID NO: 20053 - DNA, 20 bp, human
gtcagcacagagagggtctg

SEQ ID NO: 20054 - DNA, 20 bp, human
ggaacaacagccacttttgt

SEQ ID NO: 20055 - DNA, 20 bp, human
ggtcttctggctctttagat

SEQ ID NO: 20056 - DNA, 20 bp, human
gggagcgacgccataaagaa

SEQ ID NO: 20057 - DNA, 20 bp, human
ggccataaagaagggagtcg

SEQ ID NO: 20058 - DNA, 20 bp, human
gagggagtcggggatcgccg

SEQ ID NO: 20059 - DNA, 20 bp, human
gccccctgcgagggcatcct

SEQ ID NO: 20060 - DNA, 20 bp, human
gggatcgccgaggtgcaagc

SEQ ID NO: 20061 - DNA, 20 bp, human
gtgggaggcgaggaaactct

SEQ ID NO: 20062 - DNA, 20 bp, human
gagcgggctcggaaagcggt

SEQ ID NO: 20063 - DNA, 20 bp, human
gggccgcaggcaggccggag

SEQ ID NO: 20064 - DNA, 20 bp, human
ggcctggggagtgatcatgt

SEQ ID NO: 20065 - DNA, 20 bp, human
ggcccaggatgccctcgcag

SEQ ID NO: 20066 - DNA, 20 bp, human
gggccccgcgcgcctcctca

SEQ ID NO: 20067 - DNA, 20 bp, human
gcggcggcggcgtctccgtg

SEQ ID NO: 20068 - DNA, 20 bp, human
gcggcggcgtctccgtgagg

SEQ ID NO: 20069 - DNA, 20 bp, human
gcccggctcgcgtgtagcgg

SEQ ID NO: 20070 - DNA, 20 bp, human
gtacacgcgagccgggacca

SEQ ID NO: 20071 - DNA, 20 bp, human
gcagggagcgctgtccgcga

SEQ ID NO: 20072 - DNA, 20 bp, human
gggctcgcgtgtagcggcgg

SEQ ID NO: 20073 - DNA, 20 bp, human
gtaccccgcaggagaagagt

SEQ ID NO: 20074 - DNA, 20 bp, human
gatgacgtcagcgtccacaa

SEQ ID NO: 20075 - DNA, 20 bp, human
gttggactcggtcacagaca

SEQ ID NO: 20076 - DNA, 20 bp, human
gtcaggaaggcgaaaggaga

SEQ ID NO: 20077 - DNA, 20 bp, human
gctttccctgatcagagact

SEQ ID NO: 20078 - DNA, 20 bp, human
gcacatcccagtctctgatc

SEQ ID NO: 20079 - DNA, 20 bp, human
gtgggaagaatggataagca

SEQ ID NO: 20080 - DNA, 20 bp, human
ggagagggcttgcagctaca

SEQ ID NO: 20081 - DNA, 20 bp, human
gtgtccaagctagggtcaag

SEQ ID NO: 20082 - DNA, 20 bp, human
gacatgagacaaagttctat

SEQ ID NO: 20083 - DNA, 20 bp, human
gaatggataagcatggtgag

SEQ ID NO: 20084 - DNA, 20 bp, human
ggggcttgcagctacatgga

SEQ ID NO: 20085 - DNA, 20 bp, human
gggctggattgtccaagcta

SEQ ID NO: 20086 - DNA, 20 bp, human
ggcagccgagaggcccacac

SEQ ID NO: 20087 - DNA, 20 bp, human
gcagcctgtgcacggcgggt

SEQ ID NO: 20088 - DNA, 20 bp, human
ggcgcacagcgcatgccccg

SEQ ID NO: 20089 - DNA, 20 bp, human
ggcgcgcggagctccgtggc

SEQ ID NO: 20090 - DNA, 20 bp, human
gctgcgcctgcgggaccatc

SEQ ID NO: 20091 - DNA, 20 bp, human
ggtaaagtgcagcctgtgca

SEQ ID NO: 20092 - DNA, 20 bp, human
gtgcgcccggccggcgtggc

SEQ ID NO: 20093 - DNA, 20 bp, human
gcctcccacccgccgtgcac

SEQ ID NO: 20094 - DNA, 20 bp, human
gtaaggaacatagcgatcac

SEQ ID NO: 20095 - DNA, 20 bp, human
gtgttggagcccgcgaagag

SEQ ID NO: 20096 - DNA, 20 bp, human
gtgtcatagaaaccactccc

SEQ ID NO: 20097 - DNA, 20 bp, human
ggattgcctgctgcctgagg

SEQ ID NO: 20098 - DNA, 20 bp, human
gcatagaaaccgacacagag

SEQ ID NO: 20099 - DNA, 20 bp, human
gaggcagcaggcaatccttg

SEQ ID NO: 20100 - DNA, 20 bp, human
ggcatccggagacgctcctg

SEQ ID NO: 20101 - DNA, 20 bp, human
gtgcctgctgcctgaggtgg

SEQ ID NO: 20102 - DNA, 20 bp, human
gaccgaagccctgccacgga

SEQ ID NO: 20103 - DNA, 20 bp, human
gatggaagcacccccacctc

SEQ ID NO: 20104 - DNA, 20 bp, human
gtccgggcaggcctgaggat

SEQ ID NO: 20105 - DNA, 20 bp, human
gctccacgcgaacgaccctc

SEQ ID NO: 20106 - DNA, 20 bp, human
gcggcggagtcgggagacct

SEQ ID NO: 20107 - DNA, 20 bp, human
ggatgagtctctgcgatata

SEQ ID NO: 20108 - DNA, 20 bp, human
ggcgcctgccgccagtctcc

SEQ ID NO: 20109 - DNA, 20 bp, human
ggagacctgggctgtcgtca

SEQ ID NO: 20110 - DNA, 20 bp, human
ggggaaagtcgccaggagac

SEQ ID NO: 20111 - DNA, 20 bp, human
gtggaagtctcggactccga

SEQ ID NO: 20112 - DNA, 20 bp, human
gtccgagggacagtgcttcc

SEQ ID NO: 20113 - DNA, 20 bp, human
gggaaagggatggacccaag

SEQ ID NO: 20114 - DNA, 20 bp, human
ggtggcggcgtcttcgaatg

SEQ ID NO: 20115 - DNA, 20 bp, human
gggcggagacgccccagtgg

SEQ ID NO: 20116 - DNA, 20 bp, human
gcgggctccgcgtccctctg

SEQ ID NO: 20117 - DNA, 20 bp, human
gagctgaggctgaagcgcgg

SEQ ID NO: 20118 - DNA, 20 bp, human
gggactgggagaggaactcg

SEQ ID NO: 20119 - DNA, 20 bp, human
gcgcccgcgctcgccaccga

SEQ ID NO: 20120 - DNA, 20 bp, human
ggcgttcgtccagatcggac

SEQ ID NO: 20121 - DNA, 20 bp, human
gctcgcgggcggattctccg

SEQ ID NO: 20122 - DNA, 20 bp, human
gagcccgccgcagagggacg

SEQ ID NO: 20123 - DNA, 20 bp, human
ggtcgggggtgaggtacagg

SEQ ID NO: 20124 - DNA, 20 bp, human
gaacgggatcgtgcacgatg

SEQ ID NO: 20125 - DNA, 20 bp, human
gcaggcgccctgggatctcg

SEQ ID NO: 20126 - DNA, 20 bp, human
ggggcggcccgggcccgaga

SEQ ID NO: 20127 - DNA, 20 bp, human
gctgcaggtgggggccgcaa

SEQ ID NO: 20128 - DNA, 20 bp, human
ggactccatactgcaggtgg

SEQ ID NO: 20129 - DNA, 20 bp, human
ggcggcccccacctgcagta

SEQ ID NO: 20130 - DNA, 20 bp, human
gcctcgacggcagtccctcc

SEQ ID NO: 20131 - DNA, 20 bp, human
gcgagggcaagccctcctcc

SEQ ID NO: 20132 - DNA, 20 bp, human
gcgacggcagtccctcccgg

SEQ ID NO: 20133 - DNA, 20 bp, human
gggcccgccgccaaagacta

SEQ ID NO: 20134 - DNA, 20 bp, human
gcagtatggagtcgtctcgg

SEQ ID NO: 20135 - DNA, 20 bp, human
gcagccagaaggtccgtctc

SEQ ID NO: 20136 - DNA, 20 bp, human
gggaccgctgtgctctcggt

SEQ ID NO: 20137 - DNA, 20 bp, human
gcctcccggagtgggcctaa

SEQ ID NO: 20138 - DNA, 20 bp, human
gcgcgcggcacggagcggga

SEQ ID NO: 20139 - DNA, 20 bp, human
gccgctgtgctctcggtagg

SEQ ID NO: 20140 - DNA, 20 bp, human
ggtgctctcggtaggcggct

SEQ ID NO: 20141 - DNA, 20 bp, human
ggcagcagagagacgcgaac

SEQ ID NO: 20142 - DNA, 20 bp, human
gcgcagacccctcccggagt

SEQ ID NO: 20143 - DNA, 20 bp, human
ggagagacgcgaaccggcgg

SEQ ID NO: 20144 - DNA, 20 bp, human
ggcggggaccgctgtgctct

SEQ ID NO: 20145 - DNA, 20 bp, human
gctaagggtgccgggacgcg

SEQ ID NO: 20146 - DNA, 20 bp, human
ggtgccggtaggctccaggg

SEQ ID NO: 20147 - DNA, 20 bp, human
gggtgtgccggtaggctcca

SEQ ID NO: 20148 - DNA, 20 bp, human
ggcagtgggtcagaagccag

SEQ ID NO: 20149 - DNA, 20 bp, human
ggctaggtcacagaagcagt

SEQ ID NO: 20150 - DNA, 20 bp, human
gtctcagcaggtgtgccggt

SEQ ID NO: 20151 - DNA, 20 bp, human
gcagaagccagaggggacgt

SEQ ID NO: 20152 - DNA, 20 bp, human
ggtgccaccctggagcctac

SEQ ID NO: 20153 - DNA, 20 bp, human
gagccgtctcagggagtggg

SEQ ID NO: 20154 - DNA, 20 bp, human
gcctagccgtctcagggagt

SEQ ID NO: 20155 - DNA, 20 bp, human
ggcactccccacgtcccctc

SEQ ID NO: 20156 - DNA, 20 bp, human
gcagttgccgggacctaaca

SEQ ID NO: 20157 - DNA, 20 bp, human
ggagcagctgacggttagtg

SEQ ID NO: 20158 - DNA, 20 bp, human
gggtcttccatgttaggtcc

SEQ ID NO: 20159 - DNA, 20 bp, human
gcttagggaatggggttctg

SEQ ID NO: 20160 - DNA, 20 bp, human
ggagaaacatgagggctaca

SEQ ID NO: 20161 - DNA, 20 bp, human
gcaggcgagatgacccgaaa

SEQ ID NO: 20162 - DNA, 20 bp, human
gcatatggctcagaagagaa

SEQ ID NO: 20163 - DNA, 20 bp, human
gaatggggttctgagggatg

SEQ ID NO: 20164 - DNA, 20 bp, human
gtggaagaccgcagaatctt

SEQ ID NO: 20165 - DNA, 20 bp, human
ggtggggtccgagcagctga

SEQ ID NO: 20166 - DNA, 20 bp, human
gtgtggtacgagaggtacag

SEQ ID NO: 20167 - DNA, 20 bp, human
gggtacgagaggtacagggg

SEQ ID NO: 20168 - DNA, 20 bp, human
gctgtcctctgtggtacgag

SEQ ID NO: 20169 - DNA, 20 bp, human
gaaagagcagggtacaggtg

SEQ ID NO: 20170 - DNA, 20 bp, human
gctcctcagcagggcctaca

SEQ ID NO: 20171 - DNA, 20 bp, human
gaaggcttttaggggagtgg

SEQ ID NO: 20172 - DNA, 20 bp, human
ggaattgagggtaaagagca

SEQ ID NO: 20173 - DNA, 20 bp, human
gtggctctgcacagtcctca

SEQ ID NO: 20174 - DNA, 20 bp, human
gagggtaaagagcagggtac

SEQ ID NO: 20175 - DNA, 20 bp, human
gatccctgtaggccctgctg

SEQ ID NO: 20176 - DNA, 20 bp, human
ggctgcgaggaggatcctcg

SEQ ID NO: 20177 - DNA, 20 bp, human
ggcccgaggccggggagaaa

SEQ ID NO: 20178 - DNA, 20 bp, human
gaggcccgcccgccacggca

SEQ ID NO: 20179 - DNA, 20 bp, human
ggggcgagggggtagcgcag

SEQ ID NO: 20180 - DNA, 20 bp, human
gccgccgcggccaggtcggg

SEQ ID NO: 20181 - DNA, 20 bp, human
gtcccatctccggtagtccc

SEQ ID NO: 20182 - DNA, 20 bp, human
gagcattcctccggaacctg

SEQ ID NO: 20183 - DNA, 20 bp, human
gcgtggccttgccccgccgg

SEQ ID NO: 20184 - DNA, 20 bp, human
ggggcgtttgagaggatgga

SEQ ID NO: 20185 - DNA, 20 bp, human
gagaggttcggctcaagtcg

SEQ ID NO: 20186 - DNA, 20 bp, human
gtcgctctgaagcagtccgg

SEQ ID NO: 20187 - DNA, 20 bp, human
ggcctgtcgctggaccaccc

SEQ ID NO: 20188 - DNA, 20 bp, human
gccgccaggtagcggacccg

SEQ ID NO: 20189 - DNA, 20 bp, human
ggcagcaggagtgtgcggga

SEQ ID NO: 20190 - DNA, 20 bp, human
ggcccgggtggtccagcgac

SEQ ID NO: 20191 - DNA, 20 bp, human
gaggcagtagaggcccctcc

SEQ ID NO: 20192 - DNA, 20 bp, human
ggcgccgcgggtccgctacc

SEQ ID NO: 20193 - DNA, 20 bp, human
gggcccgcgcgcacgatggc

SEQ ID NO: 20194 - DNA, 20 bp, human
gacgcgctgtgcgcccggag

SEQ ID NO: 20195 - DNA, 20 bp, human
ggccgtaaagcgctccgagg

SEQ ID NO: 20196 - DNA, 20 bp, human
gccactggccgggggggttg

SEQ ID NO: 20197 - DNA, 20 bp, human
ggcgccagccatggcctctg

SEQ ID NO: 20198 - DNA, 20 bp, human
ggtgctgcggggactcccag

SEQ ID NO: 20199 - DNA, 20 bp, human
ggctgcaggaaggtgaccca

SEQ ID NO: 20200 - DNA, 20 bp, human
gccgcagagcgcagtcccga

SEQ ID NO: 20201 - DNA, 20 bp, human
gggcctccctaaccccgcag

SEQ ID NO: 20202 - DNA, 20 bp, human
gagccaggccgcgtgaagga

SEQ ID NO: 20203 - DNA, 20 bp, human
ggtgggacggcccacgagag

SEQ ID NO: 20204 - DNA, 20 bp, human
gagcgcagtcccgacggtga

SEQ ID NO: 20205 - DNA, 20 bp, human
gccgcagccaggccgcgtga

SEQ ID NO: 20206 - DNA, 20 bp, human
gccatggagggggggtccta

SEQ ID NO: 20207 - DNA, 20 bp, human
gggagtccatgccacatctg

SEQ ID NO: 20208 - DNA, 20 bp, human
gtggccctgttcacccccag

SEQ ID NO: 20209 - DNA, 20 bp, human
gattggcatgagtgcagtgt

SEQ ID NO: 20210 - DNA, 20 bp, human
gctccatggaaaaccagcta

SEQ ID NO: 20211 - DNA, 20 bp, human
gttagacaagatgattgatt

SEQ ID NO: 20212 - DNA, 20 bp, human
gctgcactcatgccaatccc

SEQ ID NO: 20213 - DNA, 20 bp, human
ggtttctagggccattgtca

SEQ ID NO: 20214 - DNA, 20 bp, human
gtagggccattgtcaggggt

SEQ ID NO: 20215 - DNA, 20 bp, human
gctactcagaaaagtaagtg

SEQ ID NO: 20216 - DNA, 20 bp, human
ggagcaggggagcggtttgg

SEQ ID NO: 20217 - DNA, 20 bp, human
gggtggggtgcaaggccggg

SEQ ID NO: 20218 - DNA, 20 bp, human
ggagacacagggccgctcag

SEQ ID NO: 20219 - DNA, 20 bp, human
ggcggtttggcggagacaca

SEQ ID NO: 20220 - DNA, 20 bp, human
gcatcgactcctgcaaagag

SEQ ID NO: 20221 - DNA, 20 bp, human
ggggcagccgcgagagtaag

SEQ ID NO: 20222 - DNA, 20 bp, human
gctttgcaggagtcgatgga

SEQ ID NO: 20223 - DNA, 20 bp, human
ggggcactgcgctaaacaaa

SEQ ID NO: 20224 - DNA, 20 bp, human
gcattgcggcggcctctgag

SEQ ID NO: 20225 - DNA, 20 bp, human
gtaagaggctgggatgatat

SEQ ID NO: 20226 - DNA, 20 bp, human
gaaaccagggtcaccatggt

SEQ ID NO: 20227 - DNA, 20 bp, human
gagggtcaccatggtgggag

SEQ ID NO: 20228 - DNA, 20 bp, human
gtgaaaaaccagggtcacca

SEQ ID NO: 20229 - DNA, 20 bp, human
gttctgttccaggaattcct

SEQ ID NO: 20230 - DNA, 20 bp, human
gtggggaaagatgggtatag

SEQ ID NO: 20231 - DNA, 20 bp, human
gagacaatttcaccataaac

SEQ ID NO: 20232 - DNA, 20 bp, human
gttgtcttccgctcccacca

SEQ ID NO: 20233 - DNA, 20 bp, human
ggtggagctctgcctgttta

SEQ ID NO: 20234 - DNA, 20 bp, human
gtggaatgtcttgaaaaacc

SEQ ID NO: 20235 - DNA, 20 bp, human
gtgaaaactttagacttcat

SEQ ID NO: 20236 - DNA, 20 bp, human
gcattcccagtacctctcta

SEQ ID NO: 20237 - DNA, 20 bp, human
gataagaagaagataatggc

SEQ ID NO: 20238 - DNA, 20 bp, human
gagtaggaccaggattaaaa

SEQ ID NO: 20239 - DNA, 20 bp, human
ggatatcccagtacctcttt

SEQ ID NO: 20240 - DNA, 20 bp, human
gtttgggacagagtaggacc

SEQ ID NO: 20241 - DNA, 20 bp, human
gggtcactatacataacccg

SEQ ID NO: 20242 - DNA, 20 bp, human
gtaaaacgggctcaccaaaa

SEQ ID NO: 20243 - DNA, 20 bp, human
gcagtcttgatgtagaaatt

SEQ ID NO: 20244 - DNA, 20 bp, human
gggtgagcccgttttaatcc

SEQ ID NO: 20245 - DNA, 20 bp, human
gctgaccttttattggctgc

SEQ ID NO: 20246 - DNA, 20 bp, human
gctagaggcagagctatcaa

SEQ ID NO: 20247 - DNA, 20 bp, human
ggtgtggtgaaagcaactag

SEQ ID NO: 20248 - DNA, 20 bp, human
gggctgtgacagatgagcag

SEQ ID NO: 20249 - DNA, 20 bp, human
ggtggaatcagagtctctca

SEQ ID NO: 20250 - DNA, 20 bp, human
gtagaggcgagtggatacat

SEQ ID NO: 20251 - DNA, 20 bp, human
gagtctctcagggtcaaact

SEQ ID NO: 20252 - DNA, 20 bp, human
gtcagtattgtcatcaccta

SEQ ID NO: 20253 - DNA, 20 bp, human
ggtatgaatttgggaacctt

SEQ ID NO: 20254 - DNA, 20 bp, human
gcagctacatctctatctgg

SEQ ID NO: 20255 - DNA, 20 bp, human
ggcatgtgctcaagctaaca

SEQ ID NO: 20256 - DNA, 20 bp, human
ggaaaggacctcccctgggg

SEQ ID NO: 20257 - DNA, 20 bp, human
gtcacagccaacggagggta

SEQ ID NO: 20258 - DNA, 20 bp, human
gcaggaggaaatcctcggtg

SEQ ID NO: 20259 - DNA, 20 bp, human
gcccggcgacaagcccccca

SEQ ID NO: 20260 - DNA, 20 bp, human
ggcctgttcacagccaacgg

SEQ ID NO: 20261 - DNA, 20 bp, human
ggcggagagggtagggaatc

SEQ ID NO: 20262 - DNA, 20 bp, human
gtgggggagactctcctgag

SEQ ID NO: 20263 - DNA, 20 bp, human
gagactctcctgagcggaga

SEQ ID NO: 20264 - DNA, 20 bp, human
gctcgcctgttcacagccaa

SEQ ID NO: 20265 - DNA, 20 bp, human
gtggagagcgccggaggtga

SEQ ID NO: 20266 - DNA, 20 bp, human
gggagctgcggccttcggga

SEQ ID NO: 20267 - DNA, 20 bp, human
gcagggccaggccataccgg

SEQ ID NO: 20268 - DNA, 20 bp, human
gtgtggagaaccggagccac

SEQ ID NO: 20269 - DNA, 20 bp, human
gcccgagctccgggtctcct

SEQ ID NO: 20270 - DNA, 20 bp, human
gcctggccctgccctcccga

SEQ ID NO: 20271 - DNA, 20 bp, human
gtgcggccttcgggagggca

SEQ ID NO: 20272 - DNA, 20 bp, human
gagaaccggagccaccggta

SEQ ID NO: 20273 - DNA, 20 bp, human
gctcgggcttcctcccaaga

SEQ ID NO: 20274 - DNA, 20 bp, human
gagttcgcggtcagctgggg

SEQ ID NO: 20275 - DNA, 20 bp, human
gccaaggacagcgaaggagg

SEQ ID NO: 20276 - DNA, 20 bp, human
gggcctgcgggtgtcggtga

SEQ ID NO: 20277 - DNA, 20 bp, human
ggacacccgcaggccccgta

SEQ ID NO: 20278 - DNA, 20 bp, human
gctgcgggtgtcggtgaagg

SEQ ID NO: 20279 - DNA, 20 bp, human
gcagcgatggcggccgtacg

SEQ ID NO: 20280 - DNA, 20 bp, human
gggccggcaggcagcgatgg

SEQ ID NO: 20281 - DNA, 20 bp, human
gagcgggagaaaggacgccg

SEQ ID NO: 20282 - DNA, 20 bp, human
gtctagccggcggccgtgag

SEQ ID NO: 20283 - DNA, 20 bp, human
gccggaaatgggtgttgagg

SEQ ID NO: 20284 - DNA, 20 bp, human
ggggcgggctctcagtggtg

SEQ ID NO: 20285 - DNA, 20 bp, human
gggctcgccacggtcaacac

SEQ ID NO: 20286 - DNA, 20 bp, human
gtaagatggcggcctccagg

SEQ ID NO: 20287 - DNA, 20 bp, human
gcgcggcctgcggaaaggac

SEQ ID NO: 20288 - DNA, 20 bp, human
ggaagaggacggacctaaga

SEQ ID NO: 20289 - DNA, 20 bp, human
gagccggcgtctaaagcacg

SEQ ID NO: 20290 - DNA, 20 bp, human
ggtttgacaccggaagagga

SEQ ID NO: 20291 - DNA, 20 bp, human
gtgaaccaacgggaaagcaa

SEQ ID NO: 20292 - DNA, 20 bp, human
ggctcaaaccttgaaccaac

SEQ ID NO: 20293 - DNA, 20 bp, human
gggaaagcaaaggaaagccg

SEQ ID NO: 20294 - DNA, 20 bp, human
gtccaagagccagcgggccc

SEQ ID NO: 20295 - DNA, 20 bp, human
gctgcggaaaggacgggcgt

SEQ ID NO: 20296 - DNA, 20 bp, human
gggacctggacccgctcagt

SEQ ID NO: 20297 - DNA, 20 bp, human
gctgaggggtgcccactgag

SEQ ID NO: 20298 - DNA, 20 bp, human
gtgggctcttcgggcagcca

SEQ ID NO: 20299 - DNA, 20 bp, human
gggggaagaaagaaaccgag

SEQ ID NO: 20300 - DNA, 20 bp, human
ggaccccgccgggactcaca

SEQ ID NO: 20301 - DNA, 20 bp, human
gaagaaagaaaccgagcggg

SEQ ID NO: 20302 - DNA, 20 bp, human
gtctccatggagcagcctga

SEQ ID NO: 20303 - DNA, 20 bp, human
gtggtattggggcagcgagg

SEQ ID NO: 20304 - DNA, 20 bp, human
gtctctataacgcggtctcc

SEQ ID NO: 20305 - DNA, 20 bp, human
gcgagtcgcccgaagcgcag

SEQ ID NO: 20306 - DNA, 20 bp, human
gaggcgccgcctgtgatggg

SEQ ID NO: 20307 - DNA, 20 bp, human
gaggcccgatgccgactaat

SEQ ID NO: 20308 - DNA, 20 bp, human
ggagcaggaggacctcggtc

SEQ ID NO: 20309 - DNA, 20 bp, human
gctgagagtcgccgattagt

SEQ ID NO: 20310 - DNA, 20 bp, human
gggtccccaaagagtctcca

SEQ ID NO: 20311 - DNA, 20 bp, human
ggcatcaacgtgctgctgac

SEQ ID NO: 20312 - DNA, 20 bp, human
ggaatggtggatatctgtag

SEQ ID NO: 20313 - DNA, 20 bp, human
gctagactgccccccatcac

SEQ ID NO: 20314 - DNA, 20 bp, human
ggcagcaggggtggtcgcca

SEQ ID NO: 20315 - DNA, 20 bp, human
gtaatcggcgactctcagcg

SEQ ID NO: 20316 - DNA, 20 bp, human
gccaccagaaaggccctccg

SEQ ID NO: 20317 - DNA, 20 bp, human
gaggccctccgaggctacgg

SEQ ID NO: 20318 - DNA, 20 bp, human
gcaaccaccgtagcctcgga

SEQ ID NO: 20319 - DNA, 20 bp, human
gtcgcaggcgacactcgctc

SEQ ID NO: 20320 - DNA, 20 bp, human
ggaaaggccctccgaggcta

SEQ ID NO: 20321 - DNA, 20 bp, human
ggaggctacggtggttggga

SEQ ID NO: 20322 - DNA, 20 bp, human
ggcaggggtgtccccatcta

SEQ ID NO: 20323 - DNA, 20 bp, human
ggtcgcctgcgactggagaa

SEQ ID NO: 20324 - DNA, 20 bp, human
ggggatgaggaccctagatg

SEQ ID NO: 20325 - DNA, 20 bp, human
gctagagcgcccataagcgc

SEQ ID NO: 20326 - DNA, 20 bp, human
gagaggccctacacccaccg

SEQ ID NO: 20327 - DNA, 20 bp, human
ggggagccccatgcctcggt

SEQ ID NO: 20328 - DNA, 20 bp, human
ggtgctgggtgagtccacca

SEQ ID NO: 20329 - DNA, 20 bp, human
gcggccaagcagaacagccc

SEQ ID NO: 20330 - DNA, 20 bp, human
ggacagagagggaaagatct

SEQ ID NO: 20331 - DNA, 20 bp, human
ggcagctgtaagagaggtaa

SEQ ID NO: 20332 - DNA, 20 bp, human
gaagagaggtaagggcgata

SEQ ID NO: 20333 - DNA, 20 bp, human
gctgctggcagctgtaagag

SEQ ID NO: 20334 - DNA, 20 bp, human
gggggaggccaggaactagg

SEQ ID NO: 20335 - DNA, 20 bp, human
gctacacccaccgaggcatg

SEQ ID NO: 20336 - DNA, 20 bp, human
gggttcccgcggcgagccag

SEQ ID NO: 20337 - DNA, 20 bp, human
gccgctaacaaagcaagaca

SEQ ID NO: 20338 - DNA, 20 bp, human
gacgctgggaagccgacttc

SEQ ID NO: 20339 - DNA, 20 bp, human
gagtccggacaccaacgacg

SEQ ID NO: 20340 - DNA, 20 bp, human
gttttctcacctggttcccg

SEQ ID NO: 20341 - DNA, 20 bp, human
gaaaatagggcgccggaagt

SEQ ID NO: 20342 - DNA, 20 bp, human
gtgagcgttgtgcggaacag

SEQ ID NO: 20343 - DNA, 20 bp, human
gtggagggaagtgagtccat

SEQ ID NO: 20344 - DNA, 20 bp, human
gcaccaacgacggggacgct

SEQ ID NO: 20345 - DNA, 20 bp, human
ggctgccgctggctcgccgc

SEQ ID NO: 20346 - DNA, 20 bp, human
ggacgactgaagggacttgg

SEQ ID NO: 20347 - DNA, 20 bp, human
gggcggcgcggacgactgaa

SEQ ID NO: 20348 - DNA, 20 bp, human
gaggacgctagggtcaccaa

SEQ ID NO: 20349 - DNA, 20 bp, human
ggcggacgactgaagggact

SEQ ID NO: 20350 - DNA, 20 bp, human
gacgctagggtcaccaacgg

SEQ ID NO: 20351 - DNA, 20 bp, human
gcagcgtcagccggcaatcc

SEQ ID NO: 20352 - DNA, 20 bp, human
gggcggacgagcaaggaggt

SEQ ID NO: 20353 - DNA, 20 bp, human
ggcgcgcgaagcgagcgaga

SEQ ID NO: 20354 - DNA, 20 bp, human
ggcggaagtgaggcgcccag

SEQ ID NO: 20355 - DNA, 20 bp, human
ggaggcggcgaggttcactt

SEQ ID NO: 20356 - DNA, 20 bp, human
ggaaggtaccctgagagcga

SEQ ID NO: 20357 - DNA, 20 bp, human
ggcacactcacccgcgaccg

SEQ ID NO: 20358 - DNA, 20 bp, human
gcaacccaggccgctagccc

SEQ ID NO: 20359 - DNA, 20 bp, human
ggtgagtgtgcccgggctag

SEQ ID NO: 20360 - DNA, 20 bp, human
gggaggagcgcgctcgcgga

SEQ ID NO: 20361 - DNA, 20 bp, human
gcaatgtccgcacttccgga

SEQ ID NO: 20362 - DNA, 20 bp, human
ggtgcccgggctagcggcct

SEQ ID NO: 20363 - DNA, 20 bp, human
ggcgctcgcagagtcctagg

SEQ ID NO: 20364 - DNA, 20 bp, human
ggacgagaacagaggcctaa

SEQ ID NO: 20365 - DNA, 20 bp, human
gtcatcttagtggagacaga

SEQ ID NO: 20366 - DNA, 20 bp, human
gctgcggccccaggatctag

SEQ ID NO: 20367 - DNA, 20 bp, human
gctccacaatgcggccacag

SEQ ID NO: 20368 - DNA, 20 bp, human
ggcgctctgcctccacaatg

SEQ ID NO: 20369 - DNA, 20 bp, human
gcacaatgcggccacagcgg

SEQ ID NO: 20370 - DNA, 20 bp, human
gctcccgccgctagatcctg

SEQ ID NO: 20371 - DNA, 20 bp, human
gagacaggcagacggaggat

SEQ ID NO: 20372 - DNA, 20 bp, human
gcggccccaggatctagcgg

SEQ ID NO: 20373 - DNA, 20 bp, human
gcctgacgttagcagaggac

SEQ ID NO: 20374 - DNA, 20 bp, human
gctagcggcgggagctgtcc

SEQ ID NO: 20375 - DNA, 20 bp, human
gctgtcaagttaataggtcc

SEQ ID NO: 20376 - DNA, 20 bp, human
ggccagggcgagcgcagcaa

SEQ ID NO: 20377 - DNA, 20 bp, human
ggagcgcagcaatggactga

SEQ ID NO: 20378 - DNA, 20 bp, human
gctgaggcggcgacaggaag

SEQ ID NO: 20379 - DNA, 20 bp, human
gtccattgctgcgctcgccc

SEQ ID NO: 20380 - DNA, 20 bp, human
gggcgtctgcggacctgagg

SEQ ID NO: 20381 - DNA, 20 bp, human
gcgaactgaagcctgtacgg

SEQ ID NO: 20382 - DNA, 20 bp, human
gacgggcgtctgcggacctg

SEQ ID NO: 20383 - DNA, 20 bp, human
ggaagcctgtacggaggaaa

SEQ ID NO: 20384 - DNA, 20 bp, human
gccttcgctggccggtcggt

SEQ ID NO: 20385 - DNA, 20 bp, human
gcgatgcgcactgctggaga

SEQ ID NO: 20386 - DNA, 20 bp, human
gtgggacgcggcttacctcc

SEQ ID NO: 20387 - DNA, 20 bp, human
ggcccggccgcggagccgct

SEQ ID NO: 20388 - DNA, 20 bp, human
gccccgaggcgggcgtcatc

SEQ ID NO: 20389 - DNA, 20 bp, human
gtcaggaaggacgaccgcac

SEQ ID NO: 20390 - DNA, 20 bp, human
gagtgatgccgtggcccccg

SEQ ID NO: 20391 - DNA, 20 bp, human
ggcgtttgcccagtgctgga

SEQ ID NO: 20392 - DNA, 20 bp, human
ggcccagtgctggagggtta

SEQ ID NO: 20393 - DNA, 20 bp, human
ggccgcagcggaggatgtgt

SEQ ID NO: 20394 - DNA, 20 bp, human
gtcggcgtcccgctcctgtg

SEQ ID NO: 20395 - DNA, 20 bp, human
gtgcatgccgaataccgaca

SEQ ID NO: 20396 - DNA, 20 bp, human
gagccgggagcgtctcctga

SEQ ID NO: 20397 - DNA, 20 bp, human
gcgaggggacactccgatga

SEQ ID NO: 20398 - DNA, 20 bp, human
gtactgggattggctcccga

SEQ ID NO: 20399 - DNA, 20 bp, human
gggagagcgcgggaaatact

SEQ ID NO: 20400 - DNA, 20 bp, human
gtgcgtcaggcgtctcctca

SEQ ID NO: 20401 - DNA, 20 bp, human
gtgccctcaggagacgctcc

SEQ ID NO: 20402 - DNA, 20 bp, human
gccgaaaaattgggactcat

SEQ ID NO: 20403 - DNA, 20 bp, human
ggccggcaccctgaggacgt

SEQ ID NO: 20404 - DNA, 20 bp, human
ggttgcggaggagcaggtca

SEQ ID NO: 20405 - DNA, 20 bp, human
ggcgtctcctgagggcagcg

SEQ ID NO: 20406 - DNA, 20 bp, human
ggcgcccgccatgggcgagg

SEQ ID NO: 20407 - DNA, 20 bp, human
gccggcccggactgtagcgg

SEQ ID NO: 20408 - DNA, 20 bp, human
gagcccggcccggactgtag

SEQ ID NO: 20409 - DNA, 20 bp, human
gcgcagccgccgctacagtc

SEQ ID NO: 20410 - DNA, 20 bp, human
gggcgaggaggactactatc

SEQ ID NO: 20411 - DNA, 20 bp, human
gcagagtggagcaggatgcg

SEQ ID NO: 20412 - DNA, 20 bp, human
gagtggagcaggatgcgcgg

SEQ ID NO: 20413 - DNA, 20 bp, human
gccgggggcggtcgccagag

SEQ ID NO: 20414 - DNA, 20 bp, human
gctgcgaggacacctggccg

SEQ ID NO: 20415 - DNA, 20 bp, human
gtggcgcgcccgtcttatct

SEQ ID NO: 20416 - DNA, 20 bp, human
gcgcccagcggagggtggaa

SEQ ID NO: 20417 - DNA, 20 bp, human
gggaccctagtccaacatgg

SEQ ID NO: 20418 - DNA, 20 bp, human
gtgaggaccctagtccaaca

SEQ ID NO: 20419 - DNA, 20 bp, human
gcatggcggcgcccagcgga

SEQ ID NO: 20420 - DNA, 20 bp, human
ggcggagggtggaacggcgt

SEQ ID NO: 20421 - DNA, 20 bp, human
gactagggtcctcagggcag

SEQ ID NO: 20422 - DNA, 20 bp, human
ggaggccggggtcatcactg

SEQ ID NO: 20423 - DNA, 20 bp, human
ggcgccgccatgttggacta

SEQ ID NO: 20424 - DNA, 20 bp, human
gtgggccgcgctgctcctag

SEQ ID NO: 20425 - DNA, 20 bp, human
ggggcaggactgaactcata

SEQ ID NO: 20426 - DNA, 20 bp, human
ggcgtaggcatgggtgtggt

SEQ ID NO: 20427 - DNA, 20 bp, human
gccatgcctacgccactcct

SEQ ID NO: 20428 - DNA, 20 bp, human
gcgcgctcggcgatcagacg

SEQ ID NO: 20429 - DNA, 20 bp, human
gagtggcgtaggcatgggtg

SEQ ID NO: 20430 - DNA, 20 bp, human
gaggcctgcgcgaccctccg

SEQ ID NO: 20431 - DNA, 20 bp, human
ggagctgggactagagtccc

SEQ ID NO: 20432 - DNA, 20 bp, human
gtgcgggtggtggatgtggt

SEQ ID NO: 20433 - DNA, 20 bp, human
ggtcgcgcaggccttggtgg

SEQ ID NO: 20434 - DNA, 20 bp, human
ggcgcagccggaaggtggga

SEQ ID NO: 20435 - DNA, 20 bp, human
gccgcgccccgcgagaggag

SEQ ID NO: 20436 - DNA, 20 bp, human
ggggctgcctcgagatccac

SEQ ID NO: 20437 - DNA, 20 bp, human
ggactcacccgtggatctcg

SEQ ID NO: 20438 - DNA, 20 bp, human
gcagttgcctgggattcaag

SEQ ID NO: 20439 - DNA, 20 bp, human
gaggcagccccttgaatccc

SEQ ID NO: 20440 - DNA, 20 bp, human
gctgagtcacataaaaccag

SEQ ID NO: 20441 - DNA, 20 bp, human
ggaattcaatgactcacccg

SEQ ID NO: 20442 - DNA, 20 bp, human
gcggcaagcataaatgaagt

SEQ ID NO: 20443 - DNA, 20 bp, human
gcattgaattcctcattcag

SEQ ID NO: 20444 - DNA, 20 bp, human
gcattcacatggcagataag

SEQ ID NO: 20445 - DNA, 20 bp, human
gtctgtcctctatttatctg

SEQ ID NO: 20446 - DNA, 20 bp, human
gaggcctcttcggcaccgca

SEQ ID NO: 20447 - DNA, 20 bp, human
ggcgccgcctcttaactcgg

SEQ ID NO: 20448 - DNA, 20 bp, human
gtcacccccgagttaagagg

SEQ ID NO: 20449 - DNA, 20 bp, human
gtgactgacagcgcgcatag

SEQ ID NO: 20450 - DNA, 20 bp, human
gtgcagcacgcgcggcccca

SEQ ID NO: 20451 - DNA, 20 bp, human
gccgcttccgccgggccatg

SEQ ID NO: 20452 - DNA, 20 bp, human
gcggggtcgtcacgtggtgt

SEQ ID NO: 20453 - DNA, 20 bp, human
ggcgtcacccccgagttaag

SEQ ID NO: 20454 - DNA, 20 bp, human
ggctgggcacctccaacccc

SEQ ID NO: 20455 - DNA, 20 bp, human
gtccctgttggagtgggcgt

SEQ ID NO: 20456 - DNA, 20 bp, human
gcgcccaggtgggaagaggc

SEQ ID NO: 20457 - DNA, 20 bp, human
ggtggtgcatgagcactcgg

SEQ ID NO: 20458 - DNA, 20 bp, human
gcccgcgcccaggtgggaag

SEQ ID NO: 20459 - DNA, 20 bp, human
gtccacctaagggagcctgg

SEQ ID NO: 20460 - DNA, 20 bp, human
gcccacggtggagcagatcc

SEQ ID NO: 20461 - DNA, 20 bp, human
gccgcggtcaccccagtcgc

SEQ ID NO: 20462 - DNA, 20 bp, human
gctccgaccggaatcggaag

SEQ ID NO: 20463 - DNA, 20 bp, human
gatcctggccccggaaggta

SEQ ID NO: 20464 - DNA, 20 bp, human
gcgcccagcgccccccacgg

SEQ ID NO: 20465 - DNA, 20 bp, human
gacggtggagcagatcctgg

SEQ ID NO: 20466 - DNA, 20 bp, human
gcccacccggctgcctccag

SEQ ID NO: 20467 - DNA, 20 bp, human
gaggcagggacccgacgcca

SEQ ID NO: 20468 - DNA, 20 bp, human
ggccgggacgagcggcccat

SEQ ID NO: 20469 - DNA, 20 bp, human
gccccgagccggccaagggt

SEQ ID NO: 20470 - DNA, 20 bp, human
ggcctgagcgggggtccctc

SEQ ID NO: 20471 - DNA, 20 bp, human
ggtcctcgcccgacctcaca

SEQ ID NO: 20472 - DNA, 20 bp, human
gtccagagggacccccgctc

SEQ ID NO: 20473 - DNA, 20 bp, human
ggggacgagcggcccatggg

SEQ ID NO: 20474 - DNA, 20 bp, human
gacctcagcgccgggacgag

SEQ ID NO: 20475 - DNA, 20 bp, human
ggccgcgcacgtgaccgcgt

SEQ ID NO: 20476 - DNA, 20 bp, human
ggctcccaggtcgaactcca

SEQ ID NO: 20477 - DNA, 20 bp, human
gccgccatggagttcgacct

SEQ ID NO: 20478 - DNA, 20 bp, human
gctgcagaggagcggagcag

SEQ ID NO: 20479 - DNA, 20 bp, human
gtggaggtgcggcagtgagg

SEQ ID NO: 20480 - DNA, 20 bp, human
gcatggcggtaagagaagtt

SEQ ID NO: 20481 - DNA, 20 bp, human
gtaagagaagttgggtccta

SEQ ID NO: 20482 - DNA, 20 bp, human
ggtgcggggacgcctctctg

SEQ ID NO: 20483 - DNA, 20 bp, human
gccctgaagttggaggccta

SEQ ID NO: 20484 - DNA, 20 bp, human
gcccacaccgggcttctggg

SEQ ID NO: 20485 - DNA, 20 bp, human
ggctggagtcggaagagctg

SEQ ID NO: 20486 - DNA, 20 bp, human
gtcgcaggaggggtctgacc

SEQ ID NO: 20487 - DNA, 20 bp, human
gagactggcgtgccctctgg

SEQ ID NO: 20488 - DNA, 20 bp, human
gcgtggggacaaactcccaa

SEQ ID NO: 20489 - DNA, 20 bp, human
gcagcccctggcctcgcagg

SEQ ID NO: 20490 - DNA, 20 bp, human
gcgggctgcggtctgacagt

SEQ ID NO: 20491 - DNA, 20 bp, human
ggaggggtctgacctggcgc

SEQ ID NO: 20492 - DNA, 20 bp, human
gactcaggcctcatccccga

SEQ ID NO: 20493 - DNA, 20 bp, human
gggcctgagtgtggatccct

SEQ ID NO: 20494 - DNA, 20 bp, human
ggacccctcctgcgaggcca

SEQ ID NO: 20495 - DNA, 20 bp, human
gctggcgtgccctctggggg

SEQ ID NO: 20496 - DNA, 20 bp, human
gctcctgtgaggccagatcg

SEQ ID NO: 20497 - DNA, 20 bp, human
gagcaggagggtctacctag

SEQ ID NO: 20498 - DNA, 20 bp, human
gctggcctcacaggaggagt

SEQ ID NO: 20499 - DNA, 20 bp, human
gacctagggggatatcagtg

SEQ ID NO: 20500 - DNA, 20 bp, human
ggaaggctccttgagtgctg

SEQ ID NO: 20501 - DNA, 20 bp, human
gggagccttcagagacgaag

SEQ ID NO: 20502 - DNA, 20 bp, human
gtgggcacagctgactccag

SEQ ID NO: 20503 - DNA, 20 bp, human
ggccacactgatatccccct

SEQ ID NO: 20504 - DNA, 20 bp, human
gcgttctcagggcatcgagg

SEQ ID NO: 20505 - DNA, 20 bp, human
ggggctgaatcatggggtgt

SEQ ID NO: 20506 - DNA, 20 bp, human
gtctctagactgggacggtg

SEQ ID NO: 20507 - DNA, 20 bp, human
gctgtattcgggccttggac

SEQ ID NO: 20508 - DNA, 20 bp, human
gcatgatctctagactggga

SEQ ID NO: 20509 - DNA, 20 bp, human
gtggctggagacgggatgtg

SEQ ID NO: 20510 - DNA, 20 bp, human
gggttcctgccggctgtatt

SEQ ID NO: 20511 - DNA, 20 bp, human
gaggcccgaatacagccggc

SEQ ID NO: 20512 - DNA, 20 bp, human
ggtaacatgatctctagact

SEQ ID NO: 20513 - DNA, 20 bp, human
gtacggtgcggatccagctg

SEQ ID NO: 20514 - DNA, 20 bp, human
gctagagatcatgttactgg

SEQ ID NO: 20515 - DNA, 20 bp, human
gagcaccgagggcgtgaacc

SEQ ID NO: 20516 - DNA, 20 bp, human
gggcggtggcgggagccgtt

SEQ ID NO: 20517 - DNA, 20 bp, human
ggctgcccgagggagacggg

SEQ ID NO: 20518 - DNA, 20 bp, human
ggcggcacctggcgacaaaa

SEQ ID NO: 20519 - DNA, 20 bp, human
gcgacaaaatggctgcccga

SEQ ID NO: 20520 - DNA, 20 bp, human
ggtgccgcgcaaaggactcc

SEQ ID NO: 20521 - DNA, 20 bp, human
gaggctccgcccgtctccct

SEQ ID NO: 20522 - DNA, 20 bp, human
gcgcgcaaaggactccggga

SEQ ID NO: 20523 - DNA, 20 bp, human
gggtcccgatcccccttcac

SEQ ID NO: 20524 - DNA, 20 bp, human
ggtcgccaggtgccgcgcaa

SEQ ID NO: 20525 - DNA, 20 bp, human
gcgggcgccacggcctgtct

SEQ ID NO: 20526 - DNA, 20 bp, human
gccttcaggcgtgaatgtgg

SEQ ID NO: 20527 - DNA, 20 bp, human
gccacgccgtccattcgcag

SEQ ID NO: 20528 - DNA, 20 bp, human
gggctgcctctgcgaatgga

SEQ ID NO: 20529 - DNA, 20 bp, human
ggctccttcaggcgtgaatg

SEQ ID NO: 20530 - DNA, 20 bp, human
gccagggcaaccgctccttc

SEQ ID NO: 20531 - DNA, 20 bp, human
gtggcggctgcctctgcgaa

SEQ ID NO: 20532 - DNA, 20 bp, human
ggcgggtcgcttcatagctg

SEQ ID NO: 20533 - DNA, 20 bp, human
gttaaaagtggcgaacacta

SEQ ID NO: 20534 - DNA, 20 bp, human
gggagtcgtcagcttaaaag

SEQ ID NO: 20535 - DNA, 20 bp, human
gtagaactttgcgtcaggcc

SEQ ID NO: 20536 - DNA, 20 bp, human
gatgctacagcgggtaaggg

SEQ ID NO: 20537 - DNA, 20 bp, human
ggatcactaactctgagaca

SEQ ID NO: 20538 - DNA, 20 bp, human
gtaactctacaccaatgtgg

SEQ ID NO: 20539 - DNA, 20 bp, human
gcagcgctgaagttgaccag

SEQ ID NO: 20540 - DNA, 20 bp, human
ggggaaagaggtaggcgctg

SEQ ID NO: 20541 - DNA, 20 bp, human
gcattaggcaacccccacat

SEQ ID NO: 20542 - DNA, 20 bp, human
ggagatgctacagcgggtaa

SEQ ID NO: 20543 - DNA, 20 bp, human
ggactgaagagatgctacag

SEQ ID NO: 20544 - DNA, 20 bp, human
ggggccggaggtgttctgtg

SEQ ID NO: 20545 - DNA, 20 bp, human
ggtgggggttgcctaatgat

SEQ ID NO: 20546 - DNA, 20 bp, human
gggagtcgcggtcgaagatg

SEQ ID NO: 20547 - DNA, 20 bp, human
gtcgcggtcgccaggaggca

SEQ ID NO: 20548 - DNA, 20 bp, human
gacttgtcgcggtcgccagg

SEQ ID NO: 20549 - DNA, 20 bp, human
gcgggatgcgcaacttgtcg

SEQ ID NO: 20550 - DNA, 20 bp, human
ggcacccgagagcggatccg

SEQ ID NO: 20551 - DNA, 20 bp, human
ggccggcgcgcacccgagag

SEQ ID NO: 20552 - DNA, 20 bp, human
ggcgccgcggatccgctctc

SEQ ID NO: 20553 - DNA, 20 bp, human
gattagtagggcgcggtgaa

SEQ ID NO: 20554 - DNA, 20 bp, human
ggcgcctggtgcgtggtggg

SEQ ID NO: 20555 - DNA, 20 bp, human
ggggcgcgcgctcaccgagg

SEQ ID NO: 20556 - DNA, 20 bp, human
ggggaggagtgtctgacagt

SEQ ID NO: 20557 - DNA, 20 bp, human
ggagggcgggcggcgcgagt

SEQ ID NO: 20558 - DNA, 20 bp, human
gacagttggcgccgccggga

SEQ ID NO: 20559 - DNA, 20 bp, human
gcaagtcccgctccactgtg

SEQ ID NO: 20560 - DNA, 20 bp, human
gaggccccactgccgcacag

SEQ ID NO: 20561 - DNA, 20 bp, human
gccactgccgcacagtggag

SEQ ID NO: 20562 - DNA, 20 bp, human
ggttggcgccgccgggaggg

SEQ ID NO: 20563 - DNA, 20 bp, human
ggacttgaaccaaaattcga

SEQ ID NO: 20564 - DNA, 20 bp, human
ggtacagatgagaaaaaacg

SEQ ID NO: 20565 - DNA, 20 bp, human
gcggttgcggtagggacggg

SEQ ID NO: 20566 - DNA, 20 bp, human
gagggacaaacactcacagc

SEQ ID NO: 20567 - DNA, 20 bp, human
gctctggcatgcagacagac

SEQ ID NO: 20568 - DNA, 20 bp, human
gaggctctgtgaggccacgt

SEQ ID NO: 20569 - DNA, 20 bp, human
gcaggaacagctgtactctg

SEQ ID NO: 20570 - DNA, 20 bp, human
gggagagagatccagtgatg

SEQ ID NO: 20571 - DNA, 20 bp, human
gctgaggaccgtggcagggt

SEQ ID NO: 20572 - DNA, 20 bp, human
gtcttctctttcaggctcca

SEQ ID NO: 20573 - DNA, 20 bp, human
ggtccagcaggtctcccacg

SEQ ID NO: 20574 - DNA, 20 bp, human
ggtgataataacaacaccta

SEQ ID NO: 20575 - DNA, 20 bp, human
gggcctgcccgcctcatcac

SEQ ID NO: 20576 - DNA, 20 bp, human
gcttcggagagagaaatgct

SEQ ID NO: 20577 - DNA, 20 bp, human
gagcggcgcgcactataaaa

SEQ ID NO: 20578 - DNA, 20 bp, human
gctgcaacccgcgcccgctt

SEQ ID NO: 20579 - DNA, 20 bp, human
gtacctacaggtgcttcctt

SEQ ID NO: 20580 - DNA, 20 bp, human
gataggagtcgcaaactccc

SEQ ID NO: 20581 - DNA, 20 bp, human
gcggcgtgcgggcagcacaa

SEQ ID NO: 20582 - DNA, 20 bp, human
gggagtcgcaaactcccagg

SEQ ID NO: 20583 - DNA, 20 bp, human
gccccgctcgcgccagctat

SEQ ID NO: 20584 - DNA, 20 bp, human
gaagacgcacgtgtcctgaa

SEQ ID NO: 20585 - DNA, 20 bp, human
gcctgtaggtagcacgaaaa

SEQ ID NO: 20586 - DNA, 20 bp, human
gcccccaagacggaagagga

SEQ ID NO: 20587 - DNA, 20 bp, human
gaggacccccaagacggaag

SEQ ID NO: 20588 - DNA, 20 bp, human
gcggaagaggatggccgcgg

SEQ ID NO: 20589 - DNA, 20 bp, human
gtggtcccggcgccgcgcag

SEQ ID NO: 20590 - DNA, 20 bp, human
gagcgagggtgccttcgagg

SEQ ID NO: 20591 - DNA, 20 bp, human
gcgcgtcgcccgcctctgcg

SEQ ID NO: 20592 - DNA, 20 bp, human
gtcccggcgccgcgcagagg

SEQ ID NO: 20593 - DNA, 20 bp, human
gcagagcagcctctgcacga

SEQ ID NO: 20594 - DNA, 20 bp, human
ggtccgaagccttcgtgcag

SEQ ID NO: 20595 - DNA, 20 bp, human
gggcggctctgaggagattt

SEQ ID NO: 20596 - DNA, 20 bp, human
ggccatggtccggcacgcag

SEQ ID NO: 20597 - DNA, 20 bp, human
gctgcccctgcgccatggtc

SEQ ID NO: 20598 - DNA, 20 bp, human
ggcaaagagtaagacggcag

SEQ ID NO: 20599 - DNA, 20 bp, human
ggtgccggaccatggcgcag

SEQ ID NO: 20600 - DNA, 20 bp, human
gcggcacgcagcggaagagg

SEQ ID NO: 20601 - DNA, 20 bp, human
gggaagctggcgagggatag

SEQ ID NO: 20602 - DNA, 20 bp, human
ggggacgagctaggagcgag

SEQ ID NO: 20603 - DNA, 20 bp, human
gaaacccgcaaagagtaaga

SEQ ID NO: 20604 - DNA, 20 bp, human
gtccgctgcgtgccggacca

SEQ ID NO: 20605 - DNA, 20 bp, human
gagctcaagaaggtgtgcgg

SEQ ID NO: 20606 - DNA, 20 bp, human
gtgggcgccgcgataaccac

SEQ ID NO: 20607 - DNA, 20 bp, human
gtcagagatcagaggccggt

SEQ ID NO: 20608 - DNA, 20 bp, human
gaaatccggaaccggatctg

SEQ ID NO: 20609 - DNA, 20 bp, human
gaggcacctgacggttaaca

SEQ ID NO: 20610 - DNA, 20 bp, human
gacctgacggttaacagggt

SEQ ID NO: 20611 - DNA, 20 bp, human
ggatgcgacttagggaccca

SEQ ID NO: 20612 - DNA, 20 bp, human
ggaggctgactcaagtcata

SEQ ID NO: 20613 - DNA, 20 bp, human
gtcccactcccggaaaatgg

SEQ ID NO: 20614 - DNA, 20 bp, human
gttacctcgggagtcttagg

SEQ ID NO: 20615 - DNA, 20 bp, human
gccaaccggtaccacagatc

SEQ ID NO: 20616 - DNA, 20 bp, human
gtcacctgcggtccatcccg

SEQ ID NO: 20617 - DNA, 20 bp, human
ggagcgatcggcctcacctg

SEQ ID NO: 20618 - DNA, 20 bp, human
gagcagagcggccggaagcg

SEQ ID NO: 20619 - DNA, 20 bp, human
gacaagccccaggatccact

SEQ ID NO: 20620 - DNA, 20 bp, human
gggaggctggggaggaccaa

SEQ ID NO: 20621 - DNA, 20 bp, human
gacattcctgggggacacga

SEQ ID NO: 20622 - DNA, 20 bp, human
ggagcggccggaagcgcgga

SEQ ID NO: 20623 - DNA, 20 bp, human
ggtgtcccccaggaatgtat

SEQ ID NO: 20624 - DNA, 20 bp, human
gtagtccctggaagagcgat

SEQ ID NO: 20625 - DNA, 20 bp, human
ggagccgcgggatggaccgc

SEQ ID NO: 20626 - DNA, 20 bp, human
gggtcggcgtagtgtcagtg

SEQ ID NO: 20627 - DNA, 20 bp, human
ggtcctcacttctcggtggt

SEQ ID NO: 20628 - DNA, 20 bp, human
gaggggcggcgacatctgtg

SEQ ID NO: 20629 - DNA, 20 bp, human
gagagcgcgcgcaggtgtga

SEQ ID NO: 20630 - DNA, 20 bp, human
gacgtgaagccggagcccgt

SEQ ID NO: 20631 - DNA, 20 bp, human
gacgctggaggcctcgagtc

SEQ ID NO: 20632 - DNA, 20 bp, human
ggcgtctgtcagtcaccgac

SEQ ID NO: 20633 - DNA, 20 bp, human
gctggaggcctcgagtccgg

SEQ ID NO: 20634 - DNA, 20 bp, human
gcgagaagtgaggactccac

SEQ ID NO: 20635 - DNA, 20 bp, human
gaaagaggcagagcgcgcgc

SEQ ID NO: 20636 - DNA, 20 bp, human
gcttcagggacaagaaacag

SEQ ID NO: 20637 - DNA, 20 bp, human
ggggtctcagccaagaatca

SEQ ID NO: 20638 - DNA, 20 bp, human
ggaggaaatctacaagcacc

SEQ ID NO: 20639 - DNA, 20 bp, human
gttattgagtgcaaagggtt

SEQ ID NO: 20640 - DNA, 20 bp, human
gtgcactcaataaattgtag

SEQ ID NO: 20641 - DNA, 20 bp, human
gaaggttagggaactcgagg

SEQ ID NO: 20642 - DNA, 20 bp, human
gatcaaggttagggaactcg

SEQ ID NO: 20643 - DNA, 20 bp, human
ggtttcttgtccctgaaggc

SEQ ID NO: 20644 - DNA, 20 bp, human
gtgcttgcatcttgacttcc

SEQ ID NO: 20645 - DNA, 20 bp, human
gcggtgggcggggacgtgta

SEQ ID NO: 20646 - DNA, 20 bp, human
ggtcatgatcaccgagaccg

SEQ ID NO: 20647 - DNA, 20 bp, human
ggagaccgcggcggagccta

SEQ ID NO: 20648 - DNA, 20 bp, human
gatgatcaccgagaccgcgg

SEQ ID NO: 20649 - DNA, 20 bp, human
gtcgcgtccccgagcttcgg

SEQ ID NO: 20650 - DNA, 20 bp, human
gcgactggaggagtgagtgg

SEQ ID NO: 20651 - DNA, 20 bp, human
gaggaggccaccgaagctcg

SEQ ID NO: 20652 - DNA, 20 bp, human
ggcgggcggcgcagacccag

SEQ ID NO: 20653 - DNA, 20 bp, human
gtcctcgcgtccccgagctt

SEQ ID NO: 20654 - DNA, 20 bp, human
ggggaccgtaggctccgccg

SEQ ID NO: 20655 - DNA, 20 bp, human
gagtgagtcgtcgggtagtg

SEQ ID NO: 20656 - DNA, 20 bp, human
gcaagttcgggccgggagaa

SEQ ID NO: 20657 - DNA, 20 bp, human
ggacaggggggttccggtgg

SEQ ID NO: 20658 - DNA, 20 bp, human
gcgacgggcgcacccaggta

SEQ ID NO: 20659 - DNA, 20 bp, human
ggcgcggctgctggaccgac

SEQ ID NO: 20660 - DNA, 20 bp, human
gaggcaggggtaaggatctg

SEQ ID NO: 20661 - DNA, 20 bp, human
gcggcggaggccaaaaccaa

SEQ ID NO: 20662 - DNA, 20 bp, human
ggcgcacccaggtagggggg

SEQ ID NO: 20663 - DNA, 20 bp, human
gcccagcctaaggtgtgggg

SEQ ID NO: 20664 - DNA, 20 bp, human
gcgcgagggtccgcactgcg

SEQ ID NO: 20665 - DNA, 20 bp, human
ggcgtcccagcctaaggtgt

SEQ ID NO: 20666 - DNA, 20 bp, human
gtacagagcagtggttcgag

SEQ ID NO: 20667 - DNA, 20 bp, human
gtaccatggctacagagcag

SEQ ID NO: 20668 - DNA, 20 bp, human
gccgccccccggccctacca

SEQ ID NO: 20669 - DNA, 20 bp, human
gtagccatggtagggccggg

SEQ ID NO: 20670 - DNA, 20 bp, human
gcaggttccaaggcgtctgg

SEQ ID NO: 20671 - DNA, 20 bp, human
gtgggtaaggagacttggag

SEQ ID NO: 20672 - DNA, 20 bp, human
gtacaagcgctaggagccag

SEQ ID NO: 20673 - DNA, 20 bp, human
ggtgtttctccagggtccag

SEQ ID NO: 20674 - DNA, 20 bp, human
ggttccaaggcgtctggagg

SEQ ID NO: 20675 - DNA, 20 bp, human
ggcgcagctgttgggtgatg

SEQ ID NO: 20676 - DNA, 20 bp, human
gggaggtggacgccgctccg

SEQ ID NO: 20677 - DNA, 20 bp, human
gcggggcgggtaggtgagtg

SEQ ID NO: 20678 - DNA, 20 bp, human
gacgccgctccggggcgggt

SEQ ID NO: 20679 - DNA, 20 bp, human
gcgggaagggtgcacatctt

SEQ ID NO: 20680 - DNA, 20 bp, human
gggtggacgccgctccgggg

SEQ ID NO: 20681 - DNA, 20 bp, human
gaggagaactagccacaagt

SEQ ID NO: 20682 - DNA, 20 bp, human
ggccatagggtcataatcgg

SEQ ID NO: 20683 - DNA, 20 bp, human
gtggcccctcgtcctcggat

SEQ ID NO: 20684 - DNA, 20 bp, human
gcctgggcgcggggcattgt

SEQ ID NO: 20685 - DNA, 20 bp, human
gtggagatgagagtgtctca

SEQ ID NO: 20686 - DNA, 20 bp, human
gagagacgatggaactgtgg

SEQ ID NO: 20687 - DNA, 20 bp, human
gctcagagacgatggaactg

SEQ ID NO: 20688 - DNA, 20 bp, human
gggctggactggtgcctccg

SEQ ID NO: 20689 - DNA, 20 bp, human
gacctccctcagggcctggg

SEQ ID NO: 20690 - DNA, 20 bp, human
gagccatagctcagagacga

SEQ ID NO: 20691 - DNA, 20 bp, human
gcagggagatcccaaaagag

SEQ ID NO: 20692 - DNA, 20 bp, human
gagtctgctgtggatcaggg

SEQ ID NO: 20693 - DNA, 20 bp, human
ggaagtagcaaggtccaggg

SEQ ID NO: 20694 - DNA, 20 bp, human
gcaggaagtagcaaggtcca

SEQ ID NO: 20695 - DNA, 20 bp, human
ggtgagtgaggggtttggaa

SEQ ID NO: 20696 - DNA, 20 bp, human
ggaccacacccgggccacca

SEQ ID NO: 20697 - DNA, 20 bp, human
gtggatccgagcgaccatgg

SEQ ID NO: 20698 - DNA, 20 bp, human
gtcgctgatgaggtgcgtgg

SEQ ID NO: 20699 - DNA, 20 bp, human
ggcgtggatccgagcgacca

SEQ ID NO: 20700 - DNA, 20 bp, human
gggagaaaccaagtgtccct

SEQ ID NO: 20701 - DNA, 20 bp, human
gcgagcgaccatggtggccc

SEQ ID NO: 20702 - DNA, 20 bp, human
gatccacgcgcaaggacact

SEQ ID NO: 20703 - DNA, 20 bp, human
gcggagctgcgagtgacagc

SEQ ID NO: 20704 - DNA, 20 bp, human
gccataggcggggaacgaag

SEQ ID NO: 20705 - DNA, 20 bp, human
ggggctggaaggcttctaga

SEQ ID NO: 20706 - DNA, 20 bp, human
gggcagacatgcaaaccctc

SEQ ID NO: 20707 - DNA, 20 bp, human
ggaggggctcacctgtacag

SEQ ID NO: 20708 - DNA, 20 bp, human
ggggtccccgaggggataca

SEQ ID NO: 20709 - DNA, 20 bp, human
gtggcctcgagggtccccga

SEQ ID NO: 20710 - DNA, 20 bp, human
gcacgggctgcaagaggtgt

SEQ ID NO: 20711 - DNA, 20 bp, human
gcacggccctgtatcccctc

SEQ ID NO: 20712 - DNA, 20 bp, human
ggaagggcccagccccgcac

SEQ ID NO: 20713 - DNA, 20 bp, human
ggcaggagcccgggggatcc

SEQ ID NO: 20714 - DNA, 20 bp, human
gcaggtgagcccctccctac

SEQ ID NO: 20715 - DNA, 20 bp, human
gatcccctcggggaccctcg

SEQ ID NO: 20716 - DNA, 20 bp, human
gcgcgccgcacgggacacga

SEQ ID NO: 20717 - DNA, 20 bp, human
gggctccgggtagacaagag

SEQ ID NO: 20718 - DNA, 20 bp, human
ggctagtgcgcgccactgcc

SEQ ID NO: 20719 - DNA, 20 bp, human
gcgccctcagacgctcttaa

SEQ ID NO: 20720 - DNA, 20 bp, human
gccgcctcgggaactgcacg

SEQ ID NO: 20721 - DNA, 20 bp, human
gcaagagactagtccgaggg

SEQ ID NO: 20722 - DNA, 20 bp, human
gggaacgcgagtcgcgaccc

SEQ ID NO: 20723 - DNA, 20 bp, human
gctgcgtttcaggactctgg

SEQ ID NO: 20724 - DNA, 20 bp, human
gcagtgggcggcctctgtgt

SEQ ID NO: 20725 - DNA, 20 bp, human
ggtgccgcgtgcagttcccg

SEQ ID NO: 20726 - DNA, 20 bp, human
gggaggcccgagctcagagt

SEQ ID NO: 20727 - DNA, 20 bp, human
gaagaggcggggactcagat

SEQ ID NO: 20728 - DNA, 20 bp, human
gtcggccccactctgagctc

SEQ ID NO: 20729 - DNA, 20 bp, human
ggatggggaggggcttgtaa

SEQ ID NO: 20730 - DNA, 20 bp, human
ggccctgcctccccgtgata

SEQ ID NO: 20731 - DNA, 20 bp, human
gcagagtggggccgagctca

SEQ ID NO: 20732 - DNA, 20 bp, human
gaacctgtggacgccgaccc

SEQ ID NO: 20733 - DNA, 20 bp, human
gctcgcccacaccaaacctg

SEQ ID NO: 20734 - DNA, 20 bp, human
gagtggggccgagctcaagg

SEQ ID NO: 20735 - DNA, 20 bp, human
ggtcccgggtcggcgtccac

SEQ ID NO: 20736 - DNA, 20 bp, human
gtggcatgactgagggtcta

SEQ ID NO: 20737 - DNA, 20 bp, human
gcccatgggcggcccagaac

SEQ ID NO: 20738 - DNA, 20 bp, human
gggtggccaggagtccaaag

SEQ ID NO: 20739 - DNA, 20 bp, human
gacggagggacggctgacaa

SEQ ID NO: 20740 - DNA, 20 bp, human
ggtgtgtacaggaccacgga

SEQ ID NO: 20741 - DNA, 20 bp, human
gtgtgcggccatagagaccc

SEQ ID NO: 20742 - DNA, 20 bp, human
gggccctggcaatggtgacc

SEQ ID NO: 20743 - DNA, 20 bp, human
gcctcagcggcccccatggg

SEQ ID NO: 20744 - DNA, 20 bp, human
gccgcacaatagaactcctg

SEQ ID NO: 20745 - DNA, 20 bp, human
ggattttcagcgataaactc

SEQ ID NO: 20746 - DNA, 20 bp, human
gagggatctcgagtgagtag

SEQ ID NO: 20747 - DNA, 20 bp, human
gtagaggtctgagcctggaa

SEQ ID NO: 20748 - DNA, 20 bp, human
gcgatgagccacctgtaagg

SEQ ID NO: 20749 - DNA, 20 bp, human
gtccggtgagatcagagaga

SEQ ID NO: 20750 - DNA, 20 bp, human
gcgcggttggaggtaaggtc

SEQ ID NO: 20751 - DNA, 20 bp, human
gccagtagtgaccgggatag

SEQ ID NO: 20752 - DNA, 20 bp, human
ggtgagcgcggttggaggta

SEQ ID NO: 20753 - DNA, 20 bp, human
gtcttcgacgatcaaagcca

SEQ ID NO: 20754 - DNA, 20 bp, human
ggagtgacccagtagtgacc

SEQ ID NO: 20755 - DNA, 20 bp, human
gcaaaggcccgaccctccac

SEQ ID NO: 20756 - DNA, 20 bp, human
gggatgggacgcatccccgg

SEQ ID NO: 20757 - DNA, 20 bp, human
gtttggaggagcatcccccg

SEQ ID NO: 20758 - DNA, 20 bp, human
ggctcgcccgataaaagctt

SEQ ID NO: 20759 - DNA, 20 bp, human
gtctgcagaatgggtgccac

SEQ ID NO: 20760 - DNA, 20 bp, human
gccaaaagaggcaatggcag

SEQ ID NO: 20761 - DNA, 20 bp, human
gcgcccgataaaagctttgg

SEQ ID NO: 20762 - DNA, 20 bp, human
gactggtccaagcaactatt

SEQ ID NO: 20763 - DNA, 20 bp, human
ggagggatgggacgcatccc

SEQ ID NO: 20764 - DNA, 20 bp, human
gctcctccaaagcttttatc

SEQ ID NO: 20765 - DNA, 20 bp, human
ggagacaaaggatctcagca

SEQ ID NO: 20766 - DNA, 20 bp, human
gactggagtcgaaggccgtg

SEQ ID NO: 20767 - DNA, 20 bp, human
ggctaaagtggaacgtctag

SEQ ID NO: 20768 - DNA, 20 bp, human
gcccaaaacaagcggaagtg

SEQ ID NO: 20769 - DNA, 20 bp, human
gtctgcccagaggatgacag

SEQ ID NO: 20770 - DNA, 20 bp, human
gttcgttggggcagcattgt

SEQ ID NO: 20771 - DNA, 20 bp, human
gctctcacagctcttcgttg

SEQ ID NO: 20772 - DNA, 20 bp, human
ggctctgcccccgccacgag

SEQ ID NO: 20773 - DNA, 20 bp, human
gagcggagttaaacaggagc

SEQ ID NO: 20774 - DNA, 20 bp, human
ggaagcgccgctcgtggcgg

SEQ ID NO: 20775 - DNA, 20 bp, human
gagagagaaatgaggggccg

SEQ ID NO: 20776 - DNA, 20 bp, human
gggacccacgacgaagagga

SEQ ID NO: 20777 - DNA, 20 bp, human
gggtacgcagccgaacgctg

SEQ ID NO: 20778 - DNA, 20 bp, human
gacgctgtggcagatcgcta

SEQ ID NO: 20779 - DNA, 20 bp, human
gcagcgcgcgagcagaagag

SEQ ID NO: 20780 - DNA, 20 bp, human
gcgctgccggggaataatct

SEQ ID NO: 20781 - DNA, 20 bp, human
gggaaggacccacgacgaag

SEQ ID NO: 20782 - DNA, 20 bp, human
gggggcgcgagcgggcacaa

SEQ ID NO: 20783 - DNA, 20 bp, human
gtgccgcccagattattccc

SEQ ID NO: 20784 - DNA, 20 bp, human
gcgcgagcgggcacaaggga

SEQ ID NO: 20785 - DNA, 20 bp, human
gtaatctgggcggcagcggg

SEQ ID NO: 20786 - DNA, 20 bp, human
gcacgggtttcctctcacgt

SEQ ID NO: 20787 - DNA, 20 bp, human
gggggagtcagggtgcgctt

SEQ ID NO: 20788 - DNA, 20 bp, human
gagcctggtcaggagcgtaa

SEQ ID NO: 20789 - DNA, 20 bp, human
gggtcaggagcgtaacggag

SEQ ID NO: 20790 - DNA, 20 bp, human
gcgttggtctcgctaaaggt

SEQ ID NO: 20791 - DNA, 20 bp, human
gtctagacgcgggtgagtgg

SEQ ID NO: 20792 - DNA, 20 bp, human
gagtggtgcgccaacgtgag

SEQ ID NO: 20793 - DNA, 20 bp, human
ggtccctcagagggatatcg

SEQ ID NO: 20794 - DNA, 20 bp, human
ggcaggcggtgttctctcgt

SEQ ID NO: 20795 - DNA, 20 bp, human
ggtgagaggaaacccgtgcg

SEQ ID NO: 20796 - DNA, 20 bp, human
ggagggcaggagcatccagt

SEQ ID NO: 20797 - DNA, 20 bp, human
gcctccgcccagggaccctg

SEQ ID NO: 20798 - DNA, 20 bp, human
gtccagttggagttgacaac

SEQ ID NO: 20799 - DNA, 20 bp, human
gacccagcagaggggactgt

SEQ ID NO: 20800 - DNA, 20 bp, human
gtgctcaggtggatgctgaa

SEQ ID NO: 20801 - DNA, 20 bp, human
gggccagagtcccagaggga

SEQ ID NO: 20802 - DNA, 20 bp, human
gccagtcacccatgctcagg

SEQ ID NO: 20803 - DNA, 20 bp, human
gaagcctggggtgctagagc

SEQ ID NO: 20804 - DNA, 20 bp, human
gtcctgttgtcaactccaac

SEQ ID NO: 20805 - DNA, 20 bp, human
gtggagctctgcatacacac

SEQ ID NO: 20806 - DNA, 20 bp, human
gaacttccgcttcggaccga

SEQ ID NO: 20807 - DNA, 20 bp, human
gtactgccctcggtccgaag

SEQ ID NO: 20808 - DNA, 20 bp, human
gaccgagggcagtaggctct

SEQ ID NO: 20809 - DNA, 20 bp, human
ggaggctggcagggccaata

SEQ ID NO: 20810 - DNA, 20 bp, human
ggcaagcttgatctcctgta

SEQ ID NO: 20811 - DNA, 20 bp, human
gagcttcccaggtgaggacg

SEQ ID NO: 20812 - DNA, 20 bp, human
gtggtgtcctgtgaggccac

SEQ ID NO: 20813 - DNA, 20 bp, human
gtacccagggcctagcggat

SEQ ID NO: 20814 - DNA, 20 bp, human
gcttatgtattggttatctt

SEQ ID NO: 20815 - DNA, 20 bp, human
ggccgagagcctactgccct

SEQ ID NO: 20816 - DNA, 20 bp, human
ggcgcgcaggttccgagcgg

SEQ ID NO: 20817 - DNA, 20 bp, human
ggtcgtcagagcgccggcgc

SEQ ID NO: 20818 - DNA, 20 bp, human
ggacggaggagcccagcaca

SEQ ID NO: 20819 - DNA, 20 bp, human
gtgtcccagacctcagaggt

SEQ ID NO: 20820 - DNA, 20 bp, human
gtcgcggggcgcctaggcct

SEQ ID NO: 20821 - DNA, 20 bp, human
gcgaaactgctggatagggg

SEQ ID NO: 20822 - DNA, 20 bp, human
gtccattgattggcaaccag

SEQ ID NO: 20823 - DNA, 20 bp, human
ggcccgctaaacctcaccgt

SEQ ID NO: 20824 - DNA, 20 bp, human
gctaggcgccccgcgacctg

SEQ ID NO: 20825 - DNA, 20 bp, human
gcggttgcaggccctattcc

SEQ ID NO: 20826 - DNA, 20 bp, human
ggcagcttcagcccaaggtg

SEQ ID NO: 20827 - DNA, 20 bp, human
gtgttggcttggcccctgag

SEQ ID NO: 20828 - DNA, 20 bp, human
ggagaggggaagcagatctg

SEQ ID NO: 20829 - DNA, 20 bp, human
gtccatggtgaggctcctgg

SEQ ID NO: 20830 - DNA, 20 bp, human
gaggctgctacgggatccca

SEQ ID NO: 20831 - DNA, 20 bp, human
ggggcaggccgggcatccct

SEQ ID NO: 20832 - DNA, 20 bp, human
ggtcctcttgcctgggagag

SEQ ID NO: 20833 - DNA, 20 bp, human
gccatcccggagaaggaact

SEQ ID NO: 20834 - DNA, 20 bp, human
gcggacccctgcccaggtat

SEQ ID NO: 20835 - DNA, 20 bp, human
gtcccccaggagcctcacca

SEQ ID NO: 20836 - DNA, 20 bp, human
ggcaccagcgtggaaggcgg

SEQ ID NO: 20837 - DNA, 20 bp, human
gacgccctgagcgagcagag

SEQ ID NO: 20838 - DNA, 20 bp, human
ggcgccgctctgctcgctca

SEQ ID NO: 20839 - DNA, 20 bp, human
ggcgccggcgcgcggaccga

SEQ ID NO: 20840 - DNA, 20 bp, human
gcccgcgctcaaggacggtc

SEQ ID NO: 20841 - DNA, 20 bp, human
ggtaggggtcgcacaccatg

SEQ ID NO: 20842 - DNA, 20 bp, human
gcctgcaccagcgtggaagg

SEQ ID NO: 20843 - DNA, 20 bp, human
gaggcgcccgcgctcaagga

SEQ ID NO: 20844 - DNA, 20 bp, human
gggccgaaagacgctgctag

SEQ ID NO: 20845 - DNA, 20 bp, human
gtgcggcccggcttcccctg

SEQ ID NO: 20846 - DNA, 20 bp, human
gggagccccactaaacccag

SEQ ID NO: 20847 - DNA, 20 bp, human
gtagcgcagtgagggcgccc

SEQ ID NO: 20848 - DNA, 20 bp, human
ggcccggggaggtaatggtg

SEQ ID NO: 20849 - DNA, 20 bp, human
ggaggacgccgccagatagg

SEQ ID NO: 20850 - DNA, 20 bp, human
gcgctccgctgggtttagtg

SEQ ID NO: 20851 - DNA, 20 bp, human
ggccccaccattacctcccc

SEQ ID NO: 20852 - DNA, 20 bp, human
gggggctcctagcgcagtga

SEQ ID NO: 20853 - DNA, 20 bp, human
gacctccccgggcggcaagg

SEQ ID NO: 20854 - DNA, 20 bp, human
gcgcccgcgcgcatgacgtg

SEQ ID NO: 20855 - DNA, 20 bp, human
gtaggaggctgatgacatga

SEQ ID NO: 20856 - DNA, 20 bp, human
gacggcgaggctcagagctg

SEQ ID NO: 20857 - DNA, 20 bp, human
gcggcggcggcgggcacggt

SEQ ID NO: 20858 - DNA, 20 bp, human
gagcagcggcgagcgcctca

SEQ ID NO: 20859 - DNA, 20 bp, human
ggggcacggtcggcacggcg

SEQ ID NO: 20860 - DNA, 20 bp, human
gccgcctcctgagctcgccc

SEQ ID NO: 20861 - DNA, 20 bp, human
gctgcccgggcgagctcagg

SEQ ID NO: 20862 - DNA, 20 bp, human
gggtgcgaaggagctcgcgg

SEQ ID NO: 20863 - DNA, 20 bp, human
ggctgcagccacaggtgcga

SEQ ID NO: 20864 - DNA, 20 bp, human
gtaccacctgccaggagaag

SEQ ID NO: 20865 - DNA, 20 bp, human
ggcgagctccttcgcacctg

SEQ ID NO: 20866 - DNA, 20 bp, human
gccctcgtgggttacgtcag

SEQ ID NO: 20867 - DNA, 20 bp, human
gtcgttaggactgaacggga

SEQ ID NO: 20868 - DNA, 20 bp, human
gctgaacgggagggtactag

SEQ ID NO: 20869 - DNA, 20 bp, human
ggaccgcgcccgcaggagag

SEQ ID NO: 20870 - DNA, 20 bp, human
gcggcgggagccactataag

SEQ ID NO: 20871 - DNA, 20 bp, human
gcctgggcacctgagatccg

SEQ ID NO: 20872 - DNA, 20 bp, human
gccgggcgcgatctcctagt

SEQ ID NO: 20873 - DNA, 20 bp, human
gcgcctctggccgcttatag

SEQ ID NO: 20874 - DNA, 20 bp, human
gtcaaggggaggcccctcgt

SEQ ID NO: 20875 - DNA, 20 bp, human
gcaggatcgttaggactgaa

SEQ ID NO: 20876 - DNA, 20 bp, human
gaggtctctgcgaccagaag

SEQ ID NO: 20877 - DNA, 20 bp, human
gacacctgggccgggacgga

SEQ ID NO: 20878 - DNA, 20 bp, human
gtcgaaagtaaaggaagaga

SEQ ID NO: 20879 - DNA, 20 bp, human
gacggcagtgcagaagagga

SEQ ID NO: 20880 - DNA, 20 bp, human
gctggtggccagggcgggga

SEQ ID NO: 20881 - DNA, 20 bp, human
gcgcaggggcggaaagaccc

SEQ ID NO: 20882 - DNA, 20 bp, human
gccggggcgatgcacagact

SEQ ID NO: 20883 - DNA, 20 bp, human
gcgggtctccctgactgtgg

SEQ ID NO: 20884 - DNA, 20 bp, human
ggcggggatggcagacacct

SEQ ID NO: 20885 - DNA, 20 bp, human
gcgcggtttctcgaaagtaa

SEQ ID NO: 20886 - DNA, 20 bp, human
ggcgtcccggctttcctcag

SEQ ID NO: 20887 - DNA, 20 bp, human
gcagcagccgggcagagcgt

SEQ ID NO: 20888 - DNA, 20 bp, human
gtccggagcaaagaagctct

SEQ ID NO: 20889 - DNA, 20 bp, human
gaggctctcccgcccatgac

SEQ ID NO: 20890 - DNA, 20 bp, human
gtacgaaggtagaagtcgag

SEQ ID NO: 20891 - DNA, 20 bp, human
gcgggcagagcgtcggcccc

SEQ ID NO: 20892 - DNA, 20 bp, human
gggagcaaagaagctctcgg

SEQ ID NO: 20893 - DNA, 20 bp, human
gggctgcccgccacgtccag

SEQ ID NO: 20894 - DNA, 20 bp, human
ggatgggaaaactatgcctg

SEQ ID NO: 20895 - DNA, 20 bp, human
gttgtaacgggtaaaccact

SEQ ID NO: 20896 - DNA, 20 bp, human
gctcgggcagatgccaggac

SEQ ID NO: 20897 - DNA, 20 bp, human
gcccgaggagaccacgctcc

SEQ ID NO: 20898 - DNA, 20 bp, human
ggatgagctaccgcaccccg

SEQ ID NO: 20899 - DNA, 20 bp, human
ggcggagccatcctaaaact

SEQ ID NO: 20900 - DNA, 20 bp, human
gcagcagagctccaggagcg

SEQ ID NO: 20901 - DNA, 20 bp, human
ggtctcctcgggcagatgcc

SEQ ID NO: 20902 - DNA, 20 bp, human
gggctaggtcatctacctcg

SEQ ID NO: 20903 - DNA, 20 bp, human
gttggaggcagctcatctat

SEQ ID NO: 20904 - DNA, 20 bp, human
ggccccagaatgtggtgatc

SEQ ID NO: 20905 - DNA, 20 bp, human
gatcttgacacaggcaaaaa

SEQ ID NO: 20906 - DNA, 20 bp, human
ggatggagggaaggtctcgg

SEQ ID NO: 20907 - DNA, 20 bp, human
gagggaaggtcagctagaga

SEQ ID NO: 20908 - DNA, 20 bp, human
gtggggaggcgtgagggaaa

SEQ ID NO: 20909 - DNA, 20 bp, human
ggaagaggcgggggagagac

SEQ ID NO: 20910 - DNA, 20 bp, human
gcgagcgagagcgaagaggc

SEQ ID NO: 20911 - DNA, 20 bp, human
gtctgaggcggcagcggaca

SEQ ID NO: 20912 - DNA, 20 bp, human
ggcagcccggagccagatcg

SEQ ID NO: 20913 - DNA, 20 bp, human
gtttcgtgaaacaggcacaa

SEQ ID NO: 20914 - DNA, 20 bp, human
gtcggtctgagcccgcgatc

SEQ ID NO: 20915 - DNA, 20 bp, human
gcccggctctgaggcggcag

SEQ ID NO: 20916 - DNA, 20 bp, human
gcagggagcgaaccaggact

SEQ ID NO: 20917 - DNA, 20 bp, human
gcaggactggggtgacggca

SEQ ID NO: 20918 - DNA, 20 bp, human
gcaggcaggcgcgagagggt

SEQ ID NO: 20919 - DNA, 20 bp, human
gagtcgggacccagaatcct

SEQ ID NO: 20920 - DNA, 20 bp, human
gccgagcatccggagagcac

SEQ ID NO: 20921 - DNA, 20 bp, human
gtttcctcttggagtctggg

SEQ ID NO: 20922 - DNA, 20 bp, human
gacagactgcgagaggaccc

SEQ ID NO: 20923 - DNA, 20 bp, human
ggggaggaggaaagcggagc

SEQ ID NO: 20924 - DNA, 20 bp, human
ggagcacaggcaggcgcgag

SEQ ID NO: 20925 - DNA, 20 bp, human
gctactccggaccctccagt

SEQ ID NO: 20926 - DNA, 20 bp, human
gggcagcctctactacccga

SEQ ID NO: 20927 - DNA, 20 bp, human
gccaggctagaccagttctt

SEQ ID NO: 20928 - DNA, 20 bp, human
gctctactacccgagggaaa

SEQ ID NO: 20929 - DNA, 20 bp, human
gtggcatggtaaccatccca

SEQ ID NO: 20930 - DNA, 20 bp, human
gcatcccagggggtgacctg

SEQ ID NO: 20931 - DNA, 20 bp, human
gggagctgggacgctgtagc

SEQ ID NO: 20932 - DNA, 20 bp, human
ggaggaatacccaacagaag

SEQ ID NO: 20933 - DNA, 20 bp, human
gcatcctctgggaaaactgg

SEQ ID NO: 20934 - DNA, 20 bp, human
gtagaggctgcccctctgac

SEQ ID NO: 20935 - DNA, 20 bp, human
gggcagggtggcccagactc

SEQ ID NO: 20936 - DNA, 20 bp, human
gccaggcagggaccaagtgt

SEQ ID NO: 20937 - DNA, 20 bp, human
ggtgtgggaaccaagtcata

SEQ ID NO: 20938 - DNA, 20 bp, human
ggatcacgaactagctctgg

SEQ ID NO: 20939 - DNA, 20 bp, human
gggggaggccacaggacaca

SEQ ID NO: 20940 - DNA, 20 bp, human
gggcctccccaggcgactca

SEQ ID NO: 20941 - DNA, 20 bp, human
ggagaggctgtcccagtcag

SEQ ID NO: 20942 - DNA, 20 bp, human
gagggtccgtgagtcgcctg

SEQ ID NO: 20943 - DNA, 20 bp, human
ggggcacaaaccgggagcag

SEQ ID NO: 20944 - DNA, 20 bp, human
gacgaactagctctgggggt

SEQ ID NO: 20945 - DNA, 20 bp, human
gcccaagcttgaggagcctc

SEQ ID NO: 20946 - DNA, 20 bp, human
gcgttctcccaggctttgag

SEQ ID NO: 20947 - DNA, 20 bp, human
gtctcccaggctttgagcgg

SEQ ID NO: 20948 - DNA, 20 bp, human
gtttgagcggtggcagagag

SEQ ID NO: 20949 - DNA, 20 bp, human
gctgccaccgctcaaagcct

SEQ ID NO: 20950 - DNA, 20 bp, human
gcagcagaagcaacccccag

SEQ ID NO: 20951 - DNA, 20 bp, human
gctgacaccgacactcgcgg

SEQ ID NO: 20952 - DNA, 20 bp, human
gagctatgaaggagcataat

SEQ ID NO: 20953 - DNA, 20 bp, human
gcatactcaagaggagtgtg

SEQ ID NO: 20954 - DNA, 20 bp, human
ggccaaaagacgcctttcta

SEQ ID NO: 20955 - DNA, 20 bp, human
ggttcaaagactccagctgt

SEQ ID NO: 20956 - DNA, 20 bp, human
gatcgagtgaggctcaactc

SEQ ID NO: 20957 - DNA, 20 bp, human
ggttttggggaggacgatat

SEQ ID NO: 20958 - DNA, 20 bp, human
gtaccttgctcttagatggt

SEQ ID NO: 20959 - DNA, 20 bp, human
gactcgatgaatgacttcca

SEQ ID NO: 20960 - DNA, 20 bp, human
ggaatgacttccagggcctt

SEQ ID NO: 20961 - DNA, 20 bp, human
gtttagtcccaaagagccaa

SEQ ID NO: 20962 - DNA, 20 bp, human
ggcgggacttctcaggacct

SEQ ID NO: 20963 - DNA, 20 bp, human
gatcttgtggtaggttagat

SEQ ID NO: 20964 - DNA, 20 bp, human
gaagtcccgcaacttgtcta

SEQ ID NO: 20965 - DNA, 20 bp, human
gacaagttgcgggacttctc

SEQ ID NO: 20966 - DNA, 20 bp, human
gcctctgggattgtagcaca

SEQ ID NO: 20967 - DNA, 20 bp, human
gacggccgggaactccgtgg

SEQ ID NO: 20968 - DNA, 20 bp, human
gctctgccggaggagtccag

SEQ ID NO: 20969 - DNA, 20 bp, human
gcctgcctggcagacaatca

SEQ ID NO: 20970 - DNA, 20 bp, human
ggagcccccctggactcctc

SEQ ID NO: 20971 - DNA, 20 bp, human
ggcttcctgttaccgtctca

SEQ ID NO: 20972 - DNA, 20 bp, human
gcgcccaggcgggcatgaaa

SEQ ID NO: 20973 - DNA, 20 bp, human
gcaggtgggtggaatgtctc

SEQ ID NO: 20974 - DNA, 20 bp, human
ggcagtgggtcattccaggt

SEQ ID NO: 20975 - DNA, 20 bp, human
ggcatccctgagacggtaac

SEQ ID NO: 20976 - DNA, 20 bp, human
gcaggtaagttcatcaggaa

SEQ ID NO: 20977 - DNA, 20 bp, human
gcttgaggaagaggctaaag

SEQ ID NO: 20978 - DNA, 20 bp, human
gtgtgcaaaccaagaatcaa

SEQ ID NO: 20979 - DNA, 20 bp, human
gcgttgttttaggacctaga

SEQ ID NO: 20980 - DNA, 20 bp, human
gaactctgcaattggctggg

SEQ ID NO: 20981 - DNA, 20 bp, human
ggaataagtcataagaatag

SEQ ID NO: 20982 - DNA, 20 bp, human
gtggaactctgcaattggct

SEQ ID NO: 20983 - DNA, 20 bp, human
gataatataagcgttgtttt

SEQ ID NO: 20984 - DNA, 20 bp, human
gattcttatgacttattcta

SEQ ID NO: 20985 - DNA, 20 bp, human
gtctgctggaactctgcaat

SEQ ID NO: 20986 - DNA, 20 bp, human
gggagctccatgtaaccact

SEQ ID NO: 20987 - DNA, 20 bp, human
gcccagtgcagcccaaggtt

SEQ ID NO: 20988 - DNA, 20 bp, human
gttctcccacgcctacccag

SEQ ID NO: 20989 - DNA, 20 bp, human
gcgcctacccagtggttaca

SEQ ID NO: 20990 - DNA, 20 bp, human
gagtgcagcccaaggttggg

SEQ ID NO: 20991 - DNA, 20 bp, human
gctggcttgagaaacgtcag

SEQ ID NO: 20992 - DNA, 20 bp, human
gtgagaagtctagggacatc

SEQ ID NO: 20993 - DNA, 20 bp, human
gtgccctccgaggttgccct

SEQ ID NO: 20994 - DNA, 20 bp, human
ggcaacctcggagggcaccc

SEQ ID NO: 20995 - DNA, 20 bp, human
gtagcacagctcctgtggca

SEQ ID NO: 20996 - DNA, 20 bp, human
gtccagggccccagcaacaa

SEQ ID NO: 20997 - DNA, 20 bp, human
gtgacagactgaactgaaag

SEQ ID NO: 20998 - DNA, 20 bp, human
gcaacaaaggtttctcctct

SEQ ID NO: 20999 - DNA, 20 bp, human
gtccacccagcaacattcac

SEQ ID NO: 21000 - DNA, 20 bp, human
gtccagtgaatgttgctggg

SEQ ID NO: 21001 - DNA, 20 bp, human
gaggctccagtgaatgttgc

SEQ ID NO: 21002 - DNA, 20 bp, human
ggagggaaacagaaacccag

SEQ ID NO: 21003 - DNA, 20 bp, human
gctgaaccatgaggatctgg

SEQ ID NO: 21004 - DNA, 20 bp, human
gaatgaagagagaagctcaa

SEQ ID NO: 21005 - DNA, 20 bp, human
gactctgtgccaggtgctgg

SEQ ID NO: 21006 - DNA, 20 bp, human
gattctcgaggaggctgaag

SEQ ID NO: 21007 - DNA, 20 bp, human
gtctgctagaacactaccac

SEQ ID NO: 21008 - DNA, 20 bp, human
gtagaacactaccactggct

SEQ ID NO: 21009 - DNA, 20 bp, human
gctgtgctaatttacagtgt

SEQ ID NO: 21010 - DNA, 20 bp, human
gtaataagtcatgagaataa

SEQ ID NO: 21011 - DNA, 20 bp, human
gctttcaaaatttattctcg

SEQ ID NO: 21012 - DNA, 20 bp, human
ggaggctgaagaggagacaa

SEQ ID NO: 21013 - DNA, 20 bp, human
gaacactaccactggctagg

SEQ ID NO: 21014 - DNA, 20 bp, human
gcttcttcaacatatattga

SEQ ID NO: 21015 - DNA, 20 bp, human
gtttatttacattcaattta

SEQ ID NO: 21016 - DNA, 20 bp, human
ggcgcggccagcaacaatca

SEQ ID NO: 21017 - DNA, 20 bp, human
gtgtgcgtcggaaggctggg

SEQ ID NO: 21018 - DNA, 20 bp, human
gttcccggacccgacactct

SEQ ID NO: 21019 - DNA, 20 bp, human
ggcaccagctggtctcccgt

SEQ ID NO: 21020 - DNA, 20 bp, human
ggcagggcagggatctgcgt

SEQ ID NO: 21021 - DNA, 20 bp, human
ggctcccagcgaaagcagca

SEQ ID NO: 21022 - DNA, 20 bp, human
gtacccagagtgtcgggtcc

SEQ ID NO: 21023 - DNA, 20 bp, human
ggcccacccctagtcaactt

SEQ ID NO: 21024 - DNA, 20 bp, human
gtgctgtgcgtcggaaggct

SEQ ID NO: 21025 - DNA, 20 bp, human
ggggcgcggcctcaggacgt

SEQ ID NO: 21026 - DNA, 20 bp, human
gcttgggaccagttaatgga

SEQ ID NO: 21027 - DNA, 20 bp, human
gcacccgtgggtctctgaaa

SEQ ID NO: 21028 - DNA, 20 bp, human
ggagagcccaggattcaaca

SEQ ID NO: 21029 - DNA, 20 bp, human
gaaggcccgtgttgaatcct

SEQ ID NO: 21030 - DNA, 20 bp, human
gcagtgcacgaagacgctgt

SEQ ID NO: 21031 - DNA, 20 bp, human
gacgctcttgctgaacctgt

SEQ ID NO: 21032 - DNA, 20 bp, human
gcgtcatgcacagcagggag

SEQ ID NO: 21033 - DNA, 20 bp, human
gggtgagggtttccacccgt

SEQ ID NO: 21034 - DNA, 20 bp, human
ggtctgggagaaaccatctg

SEQ ID NO: 21035 - DNA, 20 bp, human
ggggtgatgggcaaccaggt

SEQ ID NO: 21036 - DNA, 20 bp, human
gagagaactggcccaggata

SEQ ID NO: 21037 - DNA, 20 bp, human
ggatccgagggagcaatggt

SEQ ID NO: 21038 - DNA, 20 bp, human
ggagccgcgctaggactcag

SEQ ID NO: 21039 - DNA, 20 bp, human
gctccctcggatcccagggt

SEQ ID NO: 21040 - DNA, 20 bp, human
gaccccaccctgggatccga

SEQ ID NO: 21041 - DNA, 20 bp, human
ggagtctcgtccaaaggagg

SEQ ID NO: 21042 - DNA, 20 bp, human
gctgggacctgcgagagaac

SEQ ID NO: 21043 - DNA, 20 bp, human
gccccgaccaccctctggga

SEQ ID NO: 21044 - DNA, 20 bp, human
gggagagtctcgtccaaagg

SEQ ID NO: 21045 - DNA, 20 bp, human
gatgcctggacccagagtgt

SEQ ID NO: 21046 - DNA, 20 bp, human
ggaacagaaccaggacaggg

SEQ ID NO: 21047 - DNA, 20 bp, human
gtcctgcagagggagcgtca

SEQ ID NO: 21048 - DNA, 20 bp, human
gagacatgcacactcgggta

SEQ ID NO: 21049 - DNA, 20 bp, human
gtcagtaagttggcggtggg

SEQ ID NO: 21050 - DNA, 20 bp, human
gaatgatagagggctgacaa

SEQ ID NO: 21051 - DNA, 20 bp, human
ggccttgacgctccctctgc

SEQ ID NO: 21052 - DNA, 20 bp, human
ggggcttggggcaatgatag

SEQ ID NO: 21053 - DNA, 20 bp, human
gccccacagttcctagtaaa

SEQ ID NO: 21054 - DNA, 20 bp, human
ggcatgctgggcaacccctc

SEQ ID NO: 21055 - DNA, 20 bp, human
gggttgcccagcatgcccac

SEQ ID NO: 21056 - DNA, 20 bp, human
ggtactctgaggacagtgat

SEQ ID NO: 21057 - DNA, 20 bp, human
gcagcccaagcaggtaatag

SEQ ID NO: 21058 - DNA, 20 bp, human
gtgaggcgagagagaggtac

SEQ ID NO: 21059 - DNA, 20 bp, human
gacaaggaggtctctgccca

SEQ ID NO: 21060 - DNA, 20 bp, human
gtgttcttaaaagtactctg

SEQ ID NO: 21061 - DNA, 20 bp, human
gctgtgatacaagaagacct

SEQ ID NO: 21062 - DNA, 20 bp, human
ggatcaactgcagagtggca

SEQ ID NO: 21063 - DNA, 20 bp, human
gtctaaatgaggcgagagag

SEQ ID NO: 21064 - DNA, 20 bp, human
gctgcagttgatccagcagc

SEQ ID NO: 21065 - DNA, 20 bp, human
ggtatgcatcaagcactcct

SEQ ID NO: 21066 - DNA, 20 bp, human
gagcagcacggccacttccc

SEQ ID NO: 21067 - DNA, 20 bp, human
ggaatgcgcgaggcctggac

SEQ ID NO: 21068 - DNA, 20 bp, human
ggccacttcccgggctgaca

SEQ ID NO: 21069 - DNA, 20 bp, human
ggcgtctctctacctccaaa

SEQ ID NO: 21070 - DNA, 20 bp, human
ggccatgtcagcccgggaag

SEQ ID NO: 21071 - DNA, 20 bp, human
gtctctctacctccaaaggg

SEQ ID NO: 21072 - DNA, 20 bp, human
gagtggccgaggcggttggg

SEQ ID NO: 21073 - DNA, 20 bp, human
gcgcgaggcctggacgggag

SEQ ID NO: 21074 - DNA, 20 bp, human
ggttggggagccaggagacg

SEQ ID NO: 21075 - DNA, 20 bp, human
gcgccgggccgacgtcccac

SEQ ID NO: 21076 - DNA, 20 bp, human
gcagatgttggtagagaaaa

SEQ ID NO: 21077 - DNA, 20 bp, human
gggtagagaaaaaggcatac

SEQ ID NO: 21078 - DNA, 20 bp, human
gggaactgcactaaagaatc

SEQ ID NO: 21079 - DNA, 20 bp, human
gaaaaaagagaactaaaggt

SEQ ID NO: 21080 - DNA, 20 bp, human
gttaccagggtaaccccata

SEQ ID NO: 21081 - DNA, 20 bp, human
ggaagttgaaagccaaaaga

SEQ ID NO: 21082 - DNA, 20 bp, human
gggccagtggaagactgctg

SEQ ID NO: 21083 - DNA, 20 bp, human
ggctgagttataaaagatgt

SEQ ID NO: 21084 - DNA, 20 bp, human
gaacctagctcccctcactg

SEQ ID NO: 21085 - DNA, 20 bp, human
ggttaggagacgaagtaaac

SEQ ID NO: 21086 - DNA, 20 bp, human
gctgggagggacggcaaggt

SEQ ID NO: 21087 - DNA, 20 bp, human
ggtgagccgagacggacgga

SEQ ID NO: 21088 - DNA, 20 bp, human
ggcaggtgagccgagacgga

SEQ ID NO: 21089 - DNA, 20 bp, human
gcatggcccggcctgaggga

SEQ ID NO: 21090 - DNA, 20 bp, human
gctccctctggtggaaacta

SEQ ID NO: 21091 - DNA, 20 bp, human
ggatagaggaggatccccca

SEQ ID NO: 21092 - DNA, 20 bp, human
ggctggccgtccgtccgtct

SEQ ID NO: 21093 - DNA, 20 bp, human
gggtgctggtgggcttggac

SEQ ID NO: 21094 - DNA, 20 bp, human
ggccctcacatgtcgcctca

SEQ ID NO: 21095 - DNA, 20 bp, human
gggctttgggggacacactt

SEQ ID NO: 21096 - DNA, 20 bp, human
gaggccgcagggaggctcgg

SEQ ID NO: 21097 - DNA, 20 bp, human
gcctggccaggaagatccac

SEQ ID NO: 21098 - DNA, 20 bp, human
gtgtagggcaccctccgcta

SEQ ID NO: 21099 - DNA, 20 bp, human
gacccagtgcgggtgaactg

SEQ ID NO: 21100 - DNA, 20 bp, human
ggatgtggagggcgcagtgg

SEQ ID NO: 21101 - DNA, 20 bp, human
ggggccagcctggatgtgga

SEQ ID NO: 21102 - DNA, 20 bp, human
gaatgaaatacctccgggga

SEQ ID NO: 21103 - DNA, 20 bp, human
gtctcgggccagcctggatg

SEQ ID NO: 21104 - DNA, 20 bp, human
ggcagggtggacaggacaaa

SEQ ID NO: 21105 - DNA, 20 bp, human
gccgctaaggctgaagaccg

SEQ ID NO: 21106 - DNA, 20 bp, human
gcgcgtggtgcagtccctgg

SEQ ID NO: 21107 - DNA, 20 bp, human
gcaaagcgtgagaaccctcc

SEQ ID NO: 21108 - DNA, 20 bp, human
ggggcgcgtggtgcagtccc

SEQ ID NO: 21109 - DNA, 20 bp, human
gggtcgccttcctgaaaaag

SEQ ID NO: 21110 - DNA, 20 bp, human
ggaaggcgaccggcagcctc

SEQ ID NO: 21111 - DNA, 20 bp, human
gcccctcgggaagggtaacc

SEQ ID NO: 21112 - DNA, 20 bp, human
gcagagagactgtgggcgcg

SEQ ID NO: 21113 - DNA, 20 bp, human
gcgggaagggtaacctggat

SEQ ID NO: 21114 - DNA, 20 bp, human
ggagaccctggtttcccctc

SEQ ID NO: 21115 - DNA, 20 bp, human
gcccgcggagtagctttgtg

SEQ ID NO: 21116 - DNA, 20 bp, human
gacagccgacctgacctagt

SEQ ID NO: 21117 - DNA, 20 bp, human
gggagggctgggggcctact

SEQ ID NO: 21118 - DNA, 20 bp, human
ggggggagcgaggaacgaca

SEQ ID NO: 21119 - DNA, 20 bp, human
ggtattgcagagccgccaca

SEQ ID NO: 21120 - DNA, 20 bp, human
ggctgggggcctactaggtc

SEQ ID NO: 21121 - DNA, 20 bp, human
gcgacttcaggtgcaagtag

SEQ ID NO: 21122 - DNA, 20 bp, human
gctactcccggcaggccttg

SEQ ID NO: 21123 - DNA, 20 bp, human
gaggcgccaacacgcgaact

SEQ ID NO: 21124 - DNA, 20 bp, human
ggctatcccgcggccagtct

SEQ ID NO: 21125 - DNA, 20 bp, human
gcgccaacacgcgaactggg

SEQ ID NO: 21126 - DNA, 20 bp, human
gggccagcatcatgtgaagg

SEQ ID NO: 21127 - DNA, 20 bp, human
gtcatgtgaaggaggcacct

SEQ ID NO: 21128 - DNA, 20 bp, human
gcatgtgtcttgggccatac

SEQ ID NO: 21129 - DNA, 20 bp, human
gagagcattggcaacccgta

SEQ ID NO: 21130 - DNA, 20 bp, human
gcgtgttctcaccacaggga

SEQ ID NO: 21131 - DNA, 20 bp, human
ggtatcggccaaggtaatat

SEQ ID NO: 21132 - DNA, 20 bp, human
gcggccaaggtaatataggt

SEQ ID NO: 21133 - DNA, 20 bp, human
gaatccattccccaaataag

SEQ ID NO: 21134 - DNA, 20 bp, human
ggacttaatgtcatacccat

SEQ ID NO: 21135 - DNA, 20 bp, human
gtaccttggccgatactgaa

SEQ ID NO: 21136 - DNA, 20 bp, human
gagcaggggtagaactccat

SEQ ID NO: 21137 - DNA, 20 bp, human
gccctcctgatggatcccca

SEQ ID NO: 21138 - DNA, 20 bp, human
gaatgtctttacctttctca

SEQ ID NO: 21139 - DNA, 20 bp, human
gagaacagttaattgttctg

SEQ ID NO: 21140 - DNA, 20 bp, human
gctttgtgggagaagttacc

SEQ ID NO: 21141 - DNA, 20 bp, human
gaaactgaagacctctttgt

SEQ ID NO: 21142 - DNA, 20 bp, human
ggcatttggggtgttctccc

SEQ ID NO: 21143 - DNA, 20 bp, human
gctttttaacaatttggatg

SEQ ID NO: 21144 - DNA, 20 bp, human
gattcctgcctggcaccatg

SEQ ID NO: 21145 - DNA, 20 bp, human
gggcaccatggggatccatc

SEQ ID NO: 21146 - DNA, 20 bp, human
gtgatgataaatggagactg

SEQ ID NO: 21147 - DNA, 20 bp, human
gtcgggaaaagcactcaggg

SEQ ID NO: 21148 - DNA, 20 bp, human
gccccgcagtggtcagaata

SEQ ID NO: 21149 - DNA, 20 bp, human
ggatctctgtacccccgcag

SEQ ID NO: 21150 - DNA, 20 bp, human
gatgtcgggaaaagcactca

SEQ ID NO: 21151 - DNA, 20 bp, human
gtcacacgcctgctctggag

SEQ ID NO: 21152 - DNA, 20 bp, human
gcctgtaacatgatctggta

SEQ ID NO: 21153 - DNA, 20 bp, human
gggaaaagcactcagggcgg

SEQ ID NO: 21154 - DNA, 20 bp, human
ggattgtgcatgaaatctca

SEQ ID NO: 21155 - DNA, 20 bp, human
gacgcctgctctggagaggc

SEQ ID NO: 21156 - DNA, 20 bp, human
ggacccgccaaagcccagac

SEQ ID NO: 21157 - DNA, 20 bp, human
gaggcaaggactgagacctg

SEQ ID NO: 21158 - DNA, 20 bp, human
gagtgagtcgagtcctccag

SEQ ID NO: 21159 - DNA, 20 bp, human
gagcctggcggtgggtctga

SEQ ID NO: 21160 - DNA, 20 bp, human
gacgtccgcgaggctttcca

SEQ ID NO: 21161 - DNA, 20 bp, human
gacgaaagtatgtctcagga

SEQ ID NO: 21162 - DNA, 20 bp, human
gcggctccaaaaccatagag

SEQ ID NO: 21163 - DNA, 20 bp, human
gtaggtagaagtgacaacca

SEQ ID NO: 21164 - DNA, 20 bp, human
ggacggacggcagttcccgg

SEQ ID NO: 21165 - DNA, 20 bp, human
ggcggagagcgcgcaagggt

SEQ ID NO: 21166 - DNA, 20 bp, human
gggtgcagcccggagaaact

SEQ ID NO: 21167 - DNA, 20 bp, human
ggccgggacatcatgacggt

SEQ ID NO: 21168 - DNA, 20 bp, human
ggccaggctccgaagcaagg

SEQ ID NO: 21169 - DNA, 20 bp, human
gtgagtcgatggtaaggacc

SEQ ID NO: 21170 - DNA, 20 bp, human
ggagaaactgggtgagtcga

SEQ ID NO: 21171 - DNA, 20 bp, human
ggctgctctccgccttgctt

SEQ ID NO: 21172 - DNA, 20 bp, human
ggctcggaccttcgccagag

SEQ ID NO: 21173 - DNA, 20 bp, human
gagggcgagggcgaaccgag

SEQ ID NO: 21174 - DNA, 20 bp, human
gactgggtgagtcgatggta

SEQ ID NO: 21175 - DNA, 20 bp, human
gtcggcgccggctcctccag

SEQ ID NO: 21176 - DNA, 20 bp, human
gcctatctaggtaagtcagg

SEQ ID NO: 21177 - DNA, 20 bp, human
gatagagggagtcaaaatgg

SEQ ID NO: 21178 - DNA, 20 bp, human
gaagtcaggaggagctcaaa

SEQ ID NO: 21179 - DNA, 20 bp, human
gctaggattggctgagtcag

SEQ ID NO: 21180 - DNA, 20 bp, human
ggaggaaatctccctagctg

SEQ ID NO: 21181 - DNA, 20 bp, human
gtccctctataccccagcta

SEQ ID NO: 21182 - DNA, 20 bp, human
gagggaggggaggctaggat

SEQ ID NO: 21183 - DNA, 20 bp, human
gttctgggatcagatcaggt

SEQ ID NO: 21184 - DNA, 20 bp, human
gatgggaaatcagagctaca

SEQ ID NO: 21185 - DNA, 20 bp, human
gtaactcacctccactgggt

SEQ ID NO: 21186 - DNA, 20 bp, human
gctcgctgcgacccttgagg

SEQ ID NO: 21187 - DNA, 20 bp, human
gcggctgtctccgccagagg

SEQ ID NO: 21188 - DNA, 20 bp, human
ggcgctgtgtaccgcctcaa

SEQ ID NO: 21189 - DNA, 20 bp, human
gtgcgcggcgagctgctcgg

SEQ ID NO: 21190 - DNA, 20 bp, human
gccccctccagggtaagcta

SEQ ID NO: 21191 - DNA, 20 bp, human
gtggccgacgtctacaggta

SEQ ID NO: 21192 - DNA, 20 bp, human
ggccaggccgtacagcgtat

SEQ ID NO: 21193 - DNA, 20 bp, human
gcccgacccggccccgctag

SEQ ID NO: 21194 - DNA, 20 bp, human
gagccggctgtctccgccag

SEQ ID NO: 21195 - DNA, 20 bp, human
gagcctgcgaggagatgtta

SEQ ID NO: 21196 - DNA, 20 bp, human
gacgacgcgccggaaagcaa

SEQ ID NO: 21197 - DNA, 20 bp, human
ggcggagagggctaccatgg

SEQ ID NO: 21198 - DNA, 20 bp, human
gactgccggagagaaggctc

SEQ ID NO: 21199 - DNA, 20 bp, human
gaagggccgcagccagcacc

SEQ ID NO: 21200 - DNA, 20 bp, human
gagccagcaccgggcggaga

SEQ ID NO: 21201 - DNA, 20 bp, human
gcgccggaaagcaacggcaa

SEQ ID NO: 21202 - DNA, 20 bp, human
gccgccgcggggacacggag

SEQ ID NO: 21203 - DNA, 20 bp, human
gcgtgggcgaggacttccgg

SEQ ID NO: 21204 - DNA, 20 bp, human
gtgaaccggagccttctctc

SEQ ID NO: 21205 - DNA, 20 bp, human
ggaggtggcgagggtctggg

SEQ ID NO: 21206 - DNA, 20 bp, human
ggatgaacatgggcccacag

SEQ ID NO: 21207 - DNA, 20 bp, human
ggtgtccgatgctaaggtca

SEQ ID NO: 21208 - DNA, 20 bp, human
gccagccttgaccttagcat

SEQ ID NO: 21209 - DNA, 20 bp, human
gccaggaaagcgtccactgt

SEQ ID NO: 21210 - DNA, 20 bp, human
gcccctgagccagccaagat

SEQ ID NO: 21211 - DNA, 20 bp, human
gccagtacccagggatgtct

SEQ ID NO: 21212 - DNA, 20 bp, human
gccattacctggatgaacat

SEQ ID NO: 21213 - DNA, 20 bp, human
gatttcagaaaggggtgatg

SEQ ID NO: 21214 - DNA, 20 bp, human
gtccaggtaatgggttcggg

SEQ ID NO: 21215 - DNA, 20 bp, human
ggctcctgcaccacaggacg

SEQ ID NO: 21216 - DNA, 20 bp, human
ggtgcagcgcggcagaatga

SEQ ID NO: 21217 - DNA, 20 bp, human
ggaagtgtcggagaactggg

SEQ ID NO: 21218 - DNA, 20 bp, human
ggcagaggccaacccaggac

SEQ ID NO: 21219 - DNA, 20 bp, human
gttgcttgtaggaagcacca

SEQ ID NO: 21220 - DNA, 20 bp, human
ggacattgtggggtcagccg

SEQ ID NO: 21221 - DNA, 20 bp, human
gtaggatggtccccacactt

SEQ ID NO: 21222 - DNA, 20 bp, human
gttgctcctgcgacattgtg

SEQ ID NO: 21223 - DNA, 20 bp, human
gtgggaggcgtggaggaccc

SEQ ID NO: 21224 - DNA, 20 bp, human
gtggaaccaggtgggacgaa

SEQ ID NO: 21225 - DNA, 20 bp, human
gcaagaagtgtcggagaact

SEQ ID NO: 21226 - DNA, 20 bp, human
gatggtgggagctacttccg

SEQ ID NO: 21227 - DNA, 20 bp, human
gtaagaagggcatcagcaag

SEQ ID NO: 21228 - DNA, 20 bp, human
gtgggagctacttccggggc

SEQ ID NO: 21229 - DNA, 20 bp, human
ggtctctaaaaaaataagaa

SEQ ID NO: 21230 - DNA, 20 bp, human
gtgggctccactgggtgcag

SEQ ID NO: 21231 - DNA, 20 bp, human
ggggctggggagaaacgggg

SEQ ID NO: 21232 - DNA, 20 bp, human
gtccggggctggggagaaac

SEQ ID NO: 21233 - DNA, 20 bp, human
ggagcattaaaccaggtgtg

SEQ ID NO: 21234 - DNA, 20 bp, human
gaaccaggtgtggggctcct

SEQ ID NO: 21235 - DNA, 20 bp, human
gactttttgagagaccaagc

SEQ ID NO: 21236 - DNA, 20 bp, human
gggactgaccaggctgtgat

SEQ ID NO: 21237 - DNA, 20 bp, human
gtggcaggccagaactggac

SEQ ID NO: 21238 - DNA, 20 bp, human
gttgttggccacatctacgg

SEQ ID NO: 21239 - DNA, 20 bp, human
ggaccaggctgtgatgggtg

SEQ ID NO: 21240 - DNA, 20 bp, human
gctggcagagctgccacaca

SEQ ID NO: 21241 - DNA, 20 bp, human
ggcagtgaaaacctctccga

SEQ ID NO: 21242 - DNA, 20 bp, human
gtgcggctgagtttctgggt

SEQ ID NO: 21243 - DNA, 20 bp, human
gagcgctctctggactgacc

SEQ ID NO: 21244 - DNA, 20 bp, human
gatcattaaaaccctcggag

SEQ ID NO: 21245 - DNA, 20 bp, human
gattttgttggccacatcta

SEQ ID NO: 21246 - DNA, 20 bp, human
gaacccgcggagccagaaga

SEQ ID NO: 21247 - DNA, 20 bp, human
ggccgggcaagagatgcgag

SEQ ID NO: 21248 - DNA, 20 bp, human
gagagatgcgagaggctctg

SEQ ID NO: 21249 - DNA, 20 bp, human
gggcctggaccgggagagtg

SEQ ID NO: 21250 - DNA, 20 bp, human
gtttgtttcagggtgcggaa

SEQ ID NO: 21251 - DNA, 20 bp, human
gcctgggggaaggtgactcg

SEQ ID NO: 21252 - DNA, 20 bp, human
gtttcagggtgcggaagggt

SEQ ID NO: 21253 - DNA, 20 bp, human
gcagcgagatggaggcacct

SEQ ID NO: 21254 - DNA, 20 bp, human
gggagatgaggtttgtttca

SEQ ID NO: 21255 - DNA, 20 bp, human
gggagagtgtggttgaggtc

SEQ ID NO: 21256 - DNA, 20 bp, human
ggtgagaggcgccgccggta

SEQ ID NO: 21257 - DNA, 20 bp, human
gacgttccgtgagcagtgag

SEQ ID NO: 21258 - DNA, 20 bp, human
gggtcctcagagaccgctca

SEQ ID NO: 21259 - DNA, 20 bp, human
gtctcctcacgggtccagtg

SEQ ID NO: 21260 - DNA, 20 bp, human
gcggcctacaaggatcttca

SEQ ID NO: 21261 - DNA, 20 bp, human
gcggtagggcagagcgccca

SEQ ID NO: 21262 - DNA, 20 bp, human
ggcgcctcactggacccgtg

SEQ ID NO: 21263 - DNA, 20 bp, human
gcggcgcctctcactgctca

SEQ ID NO: 21264 - DNA, 20 bp, human
gctcaaggggaaaatagggt

SEQ ID NO: 21265 - DNA, 20 bp, human
gtctgacagggaaaaccccg

SEQ ID NO: 21266 - DNA, 20 bp, human
ggccagctcggagtagagag

SEQ ID NO: 21267 - DNA, 20 bp, human
gccagctgggaagacaaaat

SEQ ID NO: 21268 - DNA, 20 bp, human
gatagatcaactctccctaa

SEQ ID NO: 21269 - DNA, 20 bp, human
ggggtctctgtgctctacaa

SEQ ID NO: 21270 - DNA, 20 bp, human
gaaggctgacagtgaactct

SEQ ID NO: 21271 - DNA, 20 bp, human
gatcaagtcaaagaaacctg

SEQ ID NO: 21272 - DNA, 20 bp, human
ggccactctctactccgagc

SEQ ID NO: 21273 - DNA, 20 bp, human
gaaaggtaaggaaacgagag

SEQ ID NO: 21274 - DNA, 20 bp, human
gagggagagttgatctatct

SEQ ID NO: 21275 - DNA, 20 bp, human
ggcttcaggcggggagagga

SEQ ID NO: 21276 - DNA, 20 bp, human
gtacgaaagagaaacccgga

SEQ ID NO: 21277 - DNA, 20 bp, human
gagaaacccggagggcgccg

SEQ ID NO: 21278 - DNA, 20 bp, human
gggagggggtccctaaggag

SEQ ID NO: 21279 - DNA, 20 bp, human
gactcaccccggcgccctcc

SEQ ID NO: 21280 - DNA, 20 bp, human
ggcgcggcgccaccgcctga

SEQ ID NO: 21281 - DNA, 20 bp, human
gcggcgccaccgcctgaggg

SEQ ID NO: 21282 - DNA, 20 bp, human
ggagtgcgagaggcagacaa

SEQ ID NO: 21283 - DNA, 20 bp, human
gggccaggctcgttgggagg

SEQ ID NO: 21284 - DNA, 20 bp, human
gcgcggccaggctcgttggg

SEQ ID NO: 21285 - DNA, 20 bp, human
gacgcgggcccaggcgctgg

SEQ ID NO: 21286 - DNA, 20 bp, human
ggactgcgtcgtgctatgac

SEQ ID NO: 21287 - DNA, 20 bp, human
gttatgtgaaagttagggtg

SEQ ID NO: 21288 - DNA, 20 bp, human
gtagccgctgtgaaaacatt

SEQ ID NO: 21289 - DNA, 20 bp, human
gtcagcacaacccaaacagt

SEQ ID NO: 21290 - DNA, 20 bp, human
gtggcctaatgttttcacag

SEQ ID NO: 21291 - DNA, 20 bp, human
gtgaaacatagaagccgtaa

SEQ ID NO: 21292 - DNA, 20 bp, human
ggaccggactttttcttgaa

SEQ ID NO: 21293 - DNA, 20 bp, human
gatcatcgtacaataccaca

SEQ ID NO: 21294 - DNA, 20 bp, human
ggcataaattaaaatagaag

SEQ ID NO: 21295 - DNA, 20 bp, human
gtccatttatgtgaaagtta

SEQ ID NO: 21296 - DNA, 20 bp, human
gctaggagttgagtacagtg

SEQ ID NO: 21297 - DNA, 20 bp, human
gagtcacaagaggttaaggt

SEQ ID NO: 21298 - DNA, 20 bp, human
gcctggtccctcgtccacag

SEQ ID NO: 21299 - DNA, 20 bp, human
ggttgagtcacaagaggtta

SEQ ID NO: 21300 - DNA, 20 bp, human
gttccctgcaccctggaaag

SEQ ID NO: 21301 - DNA, 20 bp, human
gctgtactcaactcctaggc

SEQ ID NO: 21302 - DNA, 20 bp, human
gaggggagttgagtcacaag

SEQ ID NO: 21303 - DNA, 20 bp, human
gctgcagcgccggtgcctcg

SEQ ID NO: 21304 - DNA, 20 bp, human
ggatgctcttggccatcagg

SEQ ID NO: 21305 - DNA, 20 bp, human
gccctccttctggccctgaa

SEQ ID NO: 21306 - DNA, 20 bp, human
gggccagatacagtccacaa

SEQ ID NO: 21307 - DNA, 20 bp, human
ggcgcttcaacggaggatct

SEQ ID NO: 21308 - DNA, 20 bp, human
gccagcgggcgcttcaacgg

SEQ ID NO: 21309 - DNA, 20 bp, human
ggaggatctgggaataggtc

SEQ ID NO: 21310 - DNA, 20 bp, human
gcagctggctgggtagagct

SEQ ID NO: 21311 - DNA, 20 bp, human
gggcccgctaatcactgcag

SEQ ID NO: 21312 - DNA, 20 bp, human
gaataggtcaggagtccagc

SEQ ID NO: 21313 - DNA, 20 bp, human
ggtgccacctggagtgtgag

SEQ ID NO: 21314 - DNA, 20 bp, human
gaggagcctcggcccagatg

SEQ ID NO: 21315 - DNA, 20 bp, human
gcccagggctctcaagtggg

SEQ ID NO: 21316 - DNA, 20 bp, human
ggaacagcgtcgggacggga

SEQ ID NO: 21317 - DNA, 20 bp, human
gccccaggtgagcggcgagg

SEQ ID NO: 21318 - DNA, 20 bp, human
gctgcaagggccctaccccg

SEQ ID NO: 21319 - DNA, 20 bp, human
gcgaggaacagcgtcgggac

SEQ ID NO: 21320 - DNA, 20 bp, human
gccgccaggtgagccgcctc

SEQ ID NO: 21321 - DNA, 20 bp, human
gagggtagtgctcgccccga

SEQ ID NO: 21322 - DNA, 20 bp, human
ggccccctcgccgctcacct

SEQ ID NO: 21323 - DNA, 20 bp, human
ggcgcaccccggaagtagga

SEQ ID NO: 21324 - DNA, 20 bp, human
gacaaggaagaaccagatcc

SEQ ID NO: 21325 - DNA, 20 bp, human
gtctcgcgggagcgctgcac

SEQ ID NO: 21326 - DNA, 20 bp, human
gcgcacaggggacctcggtg

SEQ ID NO: 21327 - DNA, 20 bp, human
gcccaggtgcccgcgcacag

SEQ ID NO: 21328 - DNA, 20 bp, human
ggacagtcgcgctcgagggg

SEQ ID NO: 21329 - DNA, 20 bp, human
gagctgtggataccaacgga

SEQ ID NO: 21330 - DNA, 20 bp, human
ggtggataccaacggagggt

SEQ ID NO: 21331 - DNA, 20 bp, human
ggcccgcgcacaggggacct

SEQ ID NO: 21332 - DNA, 20 bp, human
gtgcgacagtcgcgctcgag

SEQ ID NO: 21333 - DNA, 20 bp, human
gttctgggttgcagcgagga

SEQ ID NO: 21334 - DNA, 20 bp, human
ggggaggctgcgggtagccc

SEQ ID NO: 21335 - DNA, 20 bp, human
gtttcaaaaggggcgaacgt

SEQ ID NO: 21336 - DNA, 20 bp, human
gcccggccaacgcgtcccgg

SEQ ID NO: 21337 - DNA, 20 bp, human
ggccacacccccgagagaag

SEQ ID NO: 21338 - DNA, 20 bp, human
gcacgctcccgggagaagga

SEQ ID NO: 21339 - DNA, 20 bp, human
gggtgcctgtggcctaggag

SEQ ID NO: 21340 - DNA, 20 bp, human
ggccatgcccgcgggagaag

SEQ ID NO: 21341 - DNA, 20 bp, human
gtcccggcggagcggcgacc

SEQ ID NO: 21342 - DNA, 20 bp, human
gtgcggtgctcacactcatg

SEQ ID NO: 21343 - DNA, 20 bp, human
gcgccccggccaacgcgtcc

SEQ ID NO: 21344 - DNA, 20 bp, human
gctgcgggggtgggtaacct

SEQ ID NO: 21345 - DNA, 20 bp, human
gggcgcgcggtgcttggctg

SEQ ID NO: 21346 - DNA, 20 bp, human
gctcatggctggaaccgcgt

SEQ ID NO: 21347 - DNA, 20 bp, human
ggccccggtgaaccacttgg

SEQ ID NO: 21348 - DNA, 20 bp, human
ggaatggaagacagacacct

SEQ ID NO: 21349 - DNA, 20 bp, human
gaggatgccgccggagctca

SEQ ID NO: 21350 - DNA, 20 bp, human
gggtggccgtggagccgacg

SEQ ID NO: 21351 - DNA, 20 bp, human
gggcgccccggtgaaccact

SEQ ID NO: 21352 - DNA, 20 bp, human
gtggcggggaggggaaccag

SEQ ID NO: 21353 - DNA, 20 bp, human
ggccaccaagtggttcaccg

SEQ ID NO: 21354 - DNA, 20 bp, human
gcggctccacggccaccaag

SEQ ID NO: 21355 - DNA, 20 bp, human
gcggttccagccatgagctc

SEQ ID NO: 21356 - DNA, 20 bp, human
ggtcatatggcttcacctaa

SEQ ID NO: 21357 - DNA, 20 bp, human
gcctaaaggtatgagaagct

SEQ ID NO: 21358 - DNA, 20 bp, human
ggtagtctagctttttgcct

SEQ ID NO: 21359 - DNA, 20 bp, human
ggaaatctatttctattctc

SEQ ID NO: 21360 - DNA, 20 bp, human
gttggggctattttctttgg

SEQ ID NO: 21361 - DNA, 20 bp, human
gttattggggctattttctt

SEQ ID NO: 21362 - DNA, 20 bp, human
gataagaaatacttgaatca

SEQ ID NO: 21363 - DNA, 20 bp, human
gaccaaatgaaaaaaataga

SEQ ID NO: 21364 - DNA, 20 bp, human
gaactactgattcaatttaa

SEQ ID NO: 21365 - DNA, 20 bp, human
ggccttctatttttttcatt

SEQ ID NO: 21366 - DNA, 20 bp, human
ggtgtagcagttccctgtgg

SEQ ID NO: 21367 - DNA, 20 bp, human
gagcgtgtagcagttccctg

SEQ ID NO: 21368 - DNA, 20 bp, human
gggccacacttccacctaga

SEQ ID NO: 21369 - DNA, 20 bp, human
gtgccaatgcaggcatgtcg

SEQ ID NO: 21370 - DNA, 20 bp, human
gttgccccactccatctagg

SEQ ID NO: 21371 - DNA, 20 bp, human
gtctcgaagaagcatgggtc

SEQ ID NO: 21372 - DNA, 20 bp, human
gacccacgacatgcctgcat

SEQ ID NO: 21373 - DNA, 20 bp, human
gacagtgttactgtgacacc

SEQ ID NO: 21374 - DNA, 20 bp, human
gaattcaagaaagaatttaa

SEQ ID NO: 21375 - DNA, 20 bp, human
gttgtggcatgtgtgtggtg

SEQ ID NO: 21376 - DNA, 20 bp, human
gagttagtaacaggagtggg

SEQ ID NO: 21377 - DNA, 20 bp, human
gtagaagaggtatgcagagt

SEQ ID NO: 21378 - DNA, 20 bp, human
ggctgtgtctagtacacagt

SEQ ID NO: 21379 - DNA, 20 bp, human
gggtatgcagagttggaagg

SEQ ID NO: 21380 - DNA, 20 bp, human
gatttgcttgatacagtctg

SEQ ID NO: 21381 - DNA, 20 bp, human
gtgtagttagtaacaggagt

SEQ ID NO: 21382 - DNA, 20 bp, human
gaaatctatagacatgtctg

SEQ ID NO: 21383 - DNA, 20 bp, human
gcctggggggaaatagggag

SEQ ID NO: 21384 - DNA, 20 bp, human
gaaagaaaacacgcaggggt

SEQ ID NO: 21385 - DNA, 20 bp, human
gtggatcaaagaaaacacgc

SEQ ID NO: 21386 - DNA, 20 bp, human
ggaatgggaacttacctggt

SEQ ID NO: 21387 - DNA, 20 bp, human
ggagcccaggggcgatccaa

SEQ ID NO: 21388 - DNA, 20 bp, human
gtggagaatgggaacttacc

SEQ ID NO: 21389 - DNA, 20 bp, human
ggtactactaatgaaaataa

SEQ ID NO: 21390 - DNA, 20 bp, human
gtgggctctctctatccctg

SEQ ID NO: 21391 - DNA, 20 bp, human
gactaactacagtgccaacc

SEQ ID NO: 21392 - DNA, 20 bp, human
gttggactgtcccctctcat

SEQ ID NO: 21393 - DNA, 20 bp, human
ggctctctctatccctgagg

SEQ ID NO: 21394 - DNA, 20 bp, human
ggcgatccaaaggtatctct

SEQ ID NO: 21395 - DNA, 20 bp, human
gagatcagaatcctatgaga

SEQ ID NO: 21396 - DNA, 20 bp, human
ggctggaaagggtcccgggt

SEQ ID NO: 21397 - DNA, 20 bp, human
gctcactggcataagatccc

SEQ ID NO: 21398 - DNA, 20 bp, human
gctcttttaagagggatggg

SEQ ID NO: 21399 - DNA, 20 bp, human
ggagaacagtcttccaaata

SEQ ID NO: 21400 - DNA, 20 bp, human
gtctagtctagaggaacaag

SEQ ID NO: 21401 - DNA, 20 bp, human
gctggtgaagacactcagtc

SEQ ID NO: 21402 - DNA, 20 bp, human
gcttgaatatggagataggg

SEQ ID NO: 21403 - DNA, 20 bp, human
gcaattgtgagtataagtta

SEQ ID NO: 21404 - DNA, 20 bp, human
gtaatgtaggctgctggaaa

SEQ ID NO: 21405 - DNA, 20 bp, human
gtaactcttttaagagggat

SEQ ID NO: 21406 - DNA, 20 bp, human
gggtgcgcaaccggcccaac

SEQ ID NO: 21407 - DNA, 20 bp, human
gcgtaggagggaacacgtac

SEQ ID NO: 21408 - DNA, 20 bp, human
gagacgtcgtcgcctggaag

SEQ ID NO: 21409 - DNA, 20 bp, human
gtgttcttcacacgagcccc

SEQ ID NO: 21410 - DNA, 20 bp, human
gctccaggagtggccttcgt

SEQ ID NO: 21411 - DNA, 20 bp, human
gtgcggcgcttgggaaattg

SEQ ID NO: 21412 - DNA, 20 bp, human
gtgggccggttgcgcacccc

SEQ ID NO: 21413 - DNA, 20 bp, human
gctcctacgaaggccactcc

SEQ ID NO: 21414 - DNA, 20 bp, human
ggatgtaagatctccaggag

SEQ ID NO: 21415 - DNA, 20 bp, human
gaatttgttggctggcttgg

SEQ ID NO: 21416 - DNA, 20 bp, human
ggaatgtgctggaacccacg

SEQ ID NO: 21417 - DNA, 20 bp, human
gaggtgagagacagccccgt

SEQ ID NO: 21418 - DNA, 20 bp, human
gaagagttgccggggaccag

SEQ ID NO: 21419 - DNA, 20 bp, human
gaggtcatcatgattggatg

SEQ ID NO: 21420 - DNA, 20 bp, human
gtgcaggtcagagtggatga

SEQ ID NO: 21421 - DNA, 20 bp, human
ggatgacctctaaagtgtaa

SEQ ID NO: 21422 - DNA, 20 bp, human
gctggggatggaccagacaa

SEQ ID NO: 21423 - DNA, 20 bp, human
gaggacaggctcgaatgtgc

SEQ ID NO: 21424 - DNA, 20 bp, human
gagcagtcaggagaaagagc

SEQ ID NO: 21425 - DNA, 20 bp, human
gctttagaggtcatcatgat

SEQ ID NO: 21426 - DNA, 20 bp, human
gcctgcaccgccgcgtaccc

SEQ ID NO: 21427 - DNA, 20 bp, human
gggcggtcatgagcgggaac

SEQ ID NO: 21428 - DNA, 20 bp, human
gaggccgccccagctggtag

SEQ ID NO: 21429 - DNA, 20 bp, human
gccgggcatggcgtccatgg

SEQ ID NO: 21430 - DNA, 20 bp, human
gtccatggcggcggcgatcg

SEQ ID NO: 21431 - DNA, 20 bp, human
gcgcgctcggcggtcatgag

SEQ ID NO: 21432 - DNA, 20 bp, human
gcgaggcgccccggcccggt

SEQ ID NO: 21433 - DNA, 20 bp, human
gggcaggaatggcagtgggt

SEQ ID NO: 21434 - DNA, 20 bp, human
gaaccggcctctggacgacc

SEQ ID NO: 21435 - DNA, 20 bp, human
gttcgctcccggtcgtccag

SEQ ID NO: 21436 - DNA, 20 bp, human
ggtgagctgcagatagccgg

SEQ ID NO: 21437 - DNA, 20 bp, human
gactatccaggcaaagaccc

SEQ ID NO: 21438 - DNA, 20 bp, human
gggcgacatcccaacaggta

SEQ ID NO: 21439 - DNA, 20 bp, human
gggaaggctggaccggttcg

SEQ ID NO: 21440 - DNA, 20 bp, human
gagcaccagatgccccgaac

SEQ ID NO: 21441 - DNA, 20 bp, human
ggcggtgagctgcagatagc

SEQ ID NO: 21442 - DNA, 20 bp, human
gggtgggtgcatgaagtacc

SEQ ID NO: 21443 - DNA, 20 bp, human
gtcagaggcgacatcccaac

SEQ ID NO: 21444 - DNA, 20 bp, human
gtcggggcatctggtgctca

SEQ ID NO: 21445 - DNA, 20 bp, human
gccgcccctcggggccaggt

SEQ ID NO: 21446 - DNA, 20 bp, human
ggaggctgagtgtcctagag

SEQ ID NO: 21447 - DNA, 20 bp, human
gccctccccggtctacgtca

SEQ ID NO: 21448 - DNA, 20 bp, human
gagtacgcgcctcccccctg

SEQ ID NO: 21449 - DNA, 20 bp, human
ggccgccgccgcctgcgaag

SEQ ID NO: 21450 - DNA, 20 bp, human
gtgcagctggggacacgtcg

SEQ ID NO: 21451 - DNA, 20 bp, human
gcccaagccttcggtcccgg

SEQ ID NO: 21452 - DNA, 20 bp, human
ggagcctcctccccaaaagt

SEQ ID NO: 21453 - DNA, 20 bp, human
ggcggcggtgcagggcgcca

SEQ ID NO: 21454 - DNA, 20 bp, human
ggtgtccccagcctaagcag

SEQ ID NO: 21455 - DNA, 20 bp, human
ggaggggcccgcttcgcagg

SEQ ID NO: 21456 - DNA, 20 bp, human
ggctccctgcccactcccgg

SEQ ID NO: 21457 - DNA, 20 bp, human
gcggcacggaacgtcccccc

SEQ ID NO: 21458 - DNA, 20 bp, human
ggagccccggacacactgtg

SEQ ID NO: 21459 - DNA, 20 bp, human
gtctgccgcacggaagggat

SEQ ID NO: 21460 - DNA, 20 bp, human
ggtccccccgggagtgggca

SEQ ID NO: 21461 - DNA, 20 bp, human
gggctcccatcccttccgtg

SEQ ID NO: 21462 - DNA, 20 bp, human
gtgcccgggtagccgagccg

SEQ ID NO: 21463 - DNA, 20 bp, human
ggggtgtctgccgcacggaa

SEQ ID NO: 21464 - DNA, 20 bp, human
gcgccccggctcggctaccc

SEQ ID NO: 21465 - DNA, 20 bp, human
ggccattgcctgctctgggg

SEQ ID NO: 21466 - DNA, 20 bp, human
gcagccggaagcttactccg

SEQ ID NO: 21467 - DNA, 20 bp, human
gggagcgggagagacgtcct

SEQ ID NO: 21468 - DNA, 20 bp, human
gcagaagagaaggcccgggg

SEQ ID NO: 21469 - DNA, 20 bp, human
gtgggcctcatcctagtact

SEQ ID NO: 21470 - DNA, 20 bp, human
ggattgtgcacagttcttga

SEQ ID NO: 21471 - DNA, 20 bp, human
gtgagagtgaatatacaggt

SEQ ID NO: 21472 - DNA, 20 bp, human
gagcctgggtaccccctccc

SEQ ID NO: 21473 - DNA, 20 bp, human
gaaggtgggaacagaagaga

SEQ ID NO: 21474 - DNA, 20 bp, human
ggggatgggcagatcagtgt

SEQ ID NO: 21475 - DNA, 20 bp, human
gcggacctagtactaggatg

SEQ ID NO: 21476 - DNA, 20 bp, human
ggtctccgcggtccaggcgt

SEQ ID NO: 21477 - DNA, 20 bp, human
gggtggcgctagggatcaca

SEQ ID NO: 21478 - DNA, 20 bp, human
gactccgcagtccgggactg

SEQ ID NO: 21479 - DNA, 20 bp, human
gcccggactgcggagtcagg

SEQ ID NO: 21480 - DNA, 20 bp, human
gcagccccagtcccggactg

SEQ ID NO: 21481 - DNA, 20 bp, human
ggcctccttcgaggagacta

SEQ ID NO: 21482 - DNA, 20 bp, human
gaggtctccgcccaaacagg

SEQ ID NO: 21483 - DNA, 20 bp, human
gcgcacccacgcctggaccg

SEQ ID NO: 21484 - DNA, 20 bp, human
gcagggactagacaccacca

SEQ ID NO: 21485 - DNA, 20 bp, human
gcacggccccatccaagtat

SEQ ID NO: 21486 - DNA, 20 bp, human
gccgcggagggcaatcgcca

SEQ ID NO: 21487 - DNA, 20 bp, human
gggggcgggtccctcaacag

SEQ ID NO: 21488 - DNA, 20 bp, human
gggttccctgaaacgaacca

SEQ ID NO: 21489 - DNA, 20 bp, human
gacatctgctgcaaagtcag

SEQ ID NO: 21490 - DNA, 20 bp, human
ggcccgagaacctgggaccc

SEQ ID NO: 21491 - DNA, 20 bp, human
ggtcccaggttctcgggctc

SEQ ID NO: 21492 - DNA, 20 bp, human
gagtgtctgcctagctaaaa

SEQ ID NO: 21493 - DNA, 20 bp, human
gcgggaaaggcgtttcatat

SEQ ID NO: 21494 - DNA, 20 bp, human
gaatcaagggccagcctgtc

SEQ ID NO: 21495 - DNA, 20 bp, human
gttgccctccgcggcgccgg

SEQ ID NO: 21496 - DNA, 20 bp, human
ggctttggcagggcacgggc

SEQ ID NO: 21497 - DNA, 20 bp, human
gtcggagtacgagtccaaca

SEQ ID NO: 21498 - DNA, 20 bp, human
gaagggctttggcagggcac

SEQ ID NO: 21499 - DNA, 20 bp, human
gcgagagtcaggcatcgcct

SEQ ID NO: 21500 - DNA, 20 bp, human
ggcagtcgcgcctacctaag

SEQ ID NO: 21501 - DNA, 20 bp, human
gcgcagggcgaggcgctcct

SEQ ID NO: 21502 - DNA, 20 bp, human
gcgcgactcgtggtcccagg

SEQ ID NO: 21503 - DNA, 20 bp, human
gccactgcaggggagacaag

SEQ ID NO: 21504 - DNA, 20 bp, human
ggagcgaggagcgcgactcg

SEQ ID NO: 21505 - DNA, 20 bp, human
gtgttaagagacccaaagcc

SEQ ID NO: 21506 - DNA, 20 bp, human
gtatcttacctgtccgagaa

SEQ ID NO: 21507 - DNA, 20 bp, human
gctggccagtgggactgacg

SEQ ID NO: 21508 - DNA, 20 bp, human
gcacgggcttggacaagtgg

SEQ ID NO: 21509 - DNA, 20 bp, human
gccaaaacctgtaacttcca

SEQ ID NO: 21510 - DNA, 20 bp, human
ggggactgacgcggctccag

SEQ ID NO: 21511 - DNA, 20 bp, human
gcaaagtgaatgacttcctg

SEQ ID NO: 21512 - DNA, 20 bp, human
gcatcctctagccaagcctc

SEQ ID NO: 21513 - DNA, 20 bp, human
ggcctggagctttggagtga

SEQ ID NO: 21514 - DNA, 20 bp, human
gtgacgcggctccagaggct

SEQ ID NO: 21515 - DNA, 20 bp, human
gcccagaggggcagagccgg

SEQ ID NO: 21516 - DNA, 20 bp, human
ggtgggctaatccacaccag

SEQ ID NO: 21517 - DNA, 20 bp, human
gcaccaaggtgtcatcccag

SEQ ID NO: 21518 - DNA, 20 bp, human
ggtggacttgaaacacgctt

SEQ ID NO: 21519 - DNA, 20 bp, human
gtgtttcaagtccactggtg

SEQ ID NO: 21520 - DNA, 20 bp, human
gacgtaatcaatgagtaatg

SEQ ID NO: 21521 - DNA, 20 bp, human
gcaatggctcaaaagcaata

SEQ ID NO: 21522 - DNA, 20 bp, human
gggatggcgcaaaagcaata

SEQ ID NO: 21523 - DNA, 20 bp, human
ggcactagtagcactagcct

SEQ ID NO: 21524 - DNA, 20 bp, human
gctcctagaaagaatacggc

SEQ ID NO: 21525 - DNA, 20 bp, human
gggccggccgtattctttct

SEQ ID NO: 21526 - DNA, 20 bp, human
gtcggtgggccctatcaaca

SEQ ID NO: 21527 - DNA, 20 bp, human
gtggctgcgggtcagtaata

SEQ ID NO: 21528 - DNA, 20 bp, human
gggtagacgatgcaagtcaa

SEQ ID NO: 21529 - DNA, 20 bp, human
gagttgcggctggtagagga

SEQ ID NO: 21530 - DNA, 20 bp, human
gagactgggtgggctaaata

SEQ ID NO: 21531 - DNA, 20 bp, human
gagagtcctatcctacgcgg

SEQ ID NO: 21532 - DNA, 20 bp, human
ggatcaagcgaattagccaa

SEQ ID NO: 21533 - DNA, 20 bp, human
gtgctagggccgagctagtg

SEQ ID NO: 21534 - DNA, 20 bp, human
ggggcggggcatggttgcta

SEQ ID NO: 21535 - DNA, 20 bp, human
gctctcatgtaggtgagagg

SEQ ID NO: 21536 - DNA, 20 bp, human
gcgtggctcctgtgcaagat

SEQ ID NO: 21537 - DNA, 20 bp, human
ggaattgctccgcccagcta

SEQ ID NO: 21538 - DNA, 20 bp, human
ggcacaggcccatcttgcac

SEQ ID NO: 21539 - DNA, 20 bp, human
gctccgcccagctaaggccg

SEQ ID NO: 21540 - DNA, 20 bp, human
gcccatgtcagggacggctc

SEQ ID NO: 21541 - DNA, 20 bp, human
ggctggcgcagcggagggtg

SEQ ID NO: 21542 - DNA, 20 bp, human
gaggatgtggaggattttcg

SEQ ID NO: 21543 - DNA, 20 bp, human
gcgtccctgggcccatgtca

SEQ ID NO: 21544 - DNA, 20 bp, human
gcctgggcccatgtcaggga

SEQ ID NO: 21545 - DNA, 20 bp, human
gcagctccgaccgcagtctt

SEQ ID NO: 21546 - DNA, 20 bp, human
gctcgggcagcaccttgtag

SEQ ID NO: 21547 - DNA, 20 bp, human
gccactgcaggaggacgctg

SEQ ID NO: 21548 - DNA, 20 bp, human
ggtcgggcagcaggtagtcg

SEQ ID NO: 21549 - DNA, 20 bp, human
ggaggagcacgcgctcgcac

SEQ ID NO: 21550 - DNA, 20 bp, human
gctgcaggcacaggcggtag

SEQ ID NO: 21551 - DNA, 20 bp, human
gggacgctgtcgtgcacgtc

SEQ ID NO: 21552 - DNA, 20 bp, human
gggccaggcgccactgcagg

SEQ ID NO: 21553 - DNA, 20 bp, human
ggacgctggcgcgcagggag

SEQ ID NO: 21554 - DNA, 20 bp, human
gcggcggggcgcgcatcctg

SEQ ID NO: 21555 - DNA, 20 bp, human
ggtgctgcccgagggccccg

SEQ ID NO: 21556 - DNA, 20 bp, human
gctttgggaatacccaaaag

SEQ ID NO: 21557 - DNA, 20 bp, human
ggtggctgccagggtctgga

SEQ ID NO: 21558 - DNA, 20 bp, human
gaatggtggctgccagggtc

SEQ ID NO: 21559 - DNA, 20 bp, human
gacaatagtcaaattcatag

SEQ ID NO: 21560 - DNA, 20 bp, human
gctgccagggtctggaagga

SEQ ID NO: 21561 - DNA, 20 bp, human
gtgtagatagctcatgtaag

SEQ ID NO: 21562 - DNA, 20 bp, human
gaatattaccagccttaaaa

SEQ ID NO: 21563 - DNA, 20 bp, human
gctatagtaattccactttt

SEQ ID NO: 21564 - DNA, 20 bp, human
gatagaggcaaagagtagaa

SEQ ID NO: 21565 - DNA, 20 bp, human
ggagtagaatggtggctgcc

SEQ ID NO: 21566 - DNA, 20 bp, human
ggagggaatctggcccctag

SEQ ID NO: 21567 - DNA, 20 bp, human
ggcccaagtaccagcctcta

SEQ ID NO: 21568 - DNA, 20 bp, human
gggcccgaaacccccatctc

SEQ ID NO: 21569 - DNA, 20 bp, human
gccgaaacccccatctccgg

SEQ ID NO: 21570 - DNA, 20 bp, human
ggtctctccgccggagatgg

SEQ ID NO: 21571 - DNA, 20 bp, human
gcgctttctgatgaattcag

SEQ ID NO: 21572 - DNA, 20 bp, human
ggcagtgaattgagaccgga

SEQ ID NO: 21573 - DNA, 20 bp, human
ggaatctggcccctagaggc

SEQ ID NO: 21574 - DNA, 20 bp, human
gaccatatggacagtcactc

SEQ ID NO: 21575 - DNA, 20 bp, human
gggacagtgttggaaccata

SEQ ID NO: 21576 - DNA, 20 bp, human
gcagggtaggcgcagtgcgc

SEQ ID NO: 21577 - DNA, 20 bp, human
ggcctgggtccgacggtagt

SEQ ID NO: 21578 - DNA, 20 bp, human
gccgtccgcggacactcaca

SEQ ID NO: 21579 - DNA, 20 bp, human
gccgagccgcgaggaggaac

SEQ ID NO: 21580 - DNA, 20 bp, human
gtccgcggacactcacaggg

SEQ ID NO: 21581 - DNA, 20 bp, human
gccacgactggagccgaaca

SEQ ID NO: 21582 - DNA, 20 bp, human
ggtccgacggtagtgggtag

SEQ ID NO: 21583 - DNA, 20 bp, human
gagcagcgggagaactacct

SEQ ID NO: 21584 - DNA, 20 bp, human
ggtagtgggtagcgggtctc

SEQ ID NO: 21585 - DNA, 20 bp, human
ggaagggccgcgacctcacc

SEQ ID NO: 21586 - DNA, 20 bp, human
gacccggcctgaaaacatgg

SEQ ID NO: 21587 - DNA, 20 bp, human
ggcctgaaaacatggcggac

SEQ ID NO: 21588 - DNA, 20 bp, human
gcagacccggcctgaaaaca

SEQ ID NO: 21589 - DNA, 20 bp, human
gcccggccatttccttacgg

SEQ ID NO: 21590 - DNA, 20 bp, human
ggccagcagcagggaggcgt

SEQ ID NO: 21591 - DNA, 20 bp, human
ggagggttctagactaacga

SEQ ID NO: 21592 - DNA, 20 bp, human
gtgctctagcgttaaaggga

SEQ ID NO: 21593 - DNA, 20 bp, human
gaaatggccggggagctcca

SEQ ID NO: 21594 - DNA, 20 bp, human
gggttctagactaacgaggg

SEQ ID NO: 21595 - DNA, 20 bp, human
gcggataggcgcaggtgagt

SEQ ID NO: 21596 - DNA, 20 bp, human
gatgccacccccaccatagg

SEQ ID NO: 21597 - DNA, 20 bp, human
ggtcggggtgagctccacca

SEQ ID NO: 21598 - DNA, 20 bp, human
gcaaatgccacccccaccat

SEQ ID NO: 21599 - DNA, 20 bp, human
gggataaggcgctgtcatgg

SEQ ID NO: 21600 - DNA, 20 bp, human
ggctcctgcgacacacaccc

SEQ ID NO: 21601 - DNA, 20 bp, human
gcctcactaccacctatggt

SEQ ID NO: 21602 - DNA, 20 bp, human
gggaggataaggcgctgtca

SEQ ID NO: 21603 - DNA, 20 bp, human
gctcgcacagcccagggagt

SEQ ID NO: 21604 - DNA, 20 bp, human
gcagacctcactaccaccta

SEQ ID NO: 21605 - DNA, 20 bp, human
gtcccgcggagccccgagac

SEQ ID NO: 21606 - DNA, 20 bp, human
gggagctggaaaccgagcca

SEQ ID NO: 21607 - DNA, 20 bp, human
gggaggtgggtagatagacc

SEQ ID NO: 21608 - DNA, 20 bp, human
gagacccggagagacggcga

SEQ ID NO: 21609 - DNA, 20 bp, human
gggcccactgagagaggcgg

SEQ ID NO: 21610 - DNA, 20 bp, human
gagccggctgacaacaggta

SEQ ID NO: 21611 - DNA, 20 bp, human
gtggcgaacaacgggcggag

SEQ ID NO: 21612 - DNA, 20 bp, human
gaggaggccagtctctatgg

SEQ ID NO: 21613 - DNA, 20 bp, human
ggtagatagacccggagaga

SEQ ID NO: 21614 - DNA, 20 bp, human
ggggcggggcccactgagag

SEQ ID NO: 21615 - DNA, 20 bp, human
gggcatggcctcaggtggag

SEQ ID NO: 21616 - DNA, 20 bp, human
gctcgcagccgtcatggcag

SEQ ID NO: 21617 - DNA, 20 bp, human
gatgccgcaaaatagctcag

SEQ ID NO: 21618 - DNA, 20 bp, human
ggtggtgcggcatcccgcgg

SEQ ID NO: 21619 - DNA, 20 bp, human
gttgtcgctcgcagccgtca

SEQ ID NO: 21620 - DNA, 20 bp, human
gggcggctgtaggaacaagg

SEQ ID NO: 21621 - DNA, 20 bp, human
gcccagggcttgaggtggga

SEQ ID NO: 21622 - DNA, 20 bp, human
gacccaccaggcggggagag

SEQ ID NO: 21623 - DNA, 20 bp, human
ggtccggtctaacacccacc

SEQ ID NO: 21624 - DNA, 20 bp, human
gtaggaacaaggcggagaag

SEQ ID NO: 21625 - DNA, 20 bp, human
gcaaacagatagactgggag

SEQ ID NO: 21626 - DNA, 20 bp, human
gatggcggccaggcagatct

SEQ ID NO: 21627 - DNA, 20 bp, human
gggcagatctgggcacggac

SEQ ID NO: 21628 - DNA, 20 bp, human
gggccgcccggcagaggcaa

SEQ ID NO: 21629 - DNA, 20 bp, human
gcccggtaggccggagagag

SEQ ID NO: 21630 - DNA, 20 bp, human
gcccggaggccgcccggcag

SEQ ID NO: 21631 - DNA, 20 bp, human
gctgctaacgagggaaactg

SEQ ID NO: 21632 - DNA, 20 bp, human
gggcaaaggttgctggatac

SEQ ID NO: 21633 - DNA, 20 bp, human
ggtgagcgaagagttaaccg

SEQ ID NO: 21634 - DNA, 20 bp, human
gccgggtgctccgcctccca

SEQ ID NO: 21635 - DNA, 20 bp, human
gtgccgccgccggccttggg

SEQ ID NO: 21636 - DNA, 20 bp, human
gtggagacagttaccctacc

SEQ ID NO: 21637 - DNA, 20 bp, human
gagggcgaggtatccgttcc

SEQ ID NO: 21638 - DNA, 20 bp, human
gtggacttacccaggataag

SEQ ID NO: 21639 - DNA, 20 bp, human
ggatgacaggggctaaagta

SEQ ID NO: 21640 - DNA, 20 bp, human
gaagttgaacaagatgacag

SEQ ID NO: 21641 - DNA, 20 bp, human
gataagtggcacagcaaaga

SEQ ID NO: 21642 - DNA, 20 bp, human
gggcagaatggagatctgga

SEQ ID NO: 21643 - DNA, 20 bp, human
gttgctgtgccacttatcct

SEQ ID NO: 21644 - DNA, 20 bp, human
gaatagtgcagaatccagaa

SEQ ID NO: 21645 - DNA, 20 bp, human
gtgagggcagaatggagatc

SEQ ID NO: 21646 - DNA, 20 bp, human
gcgacccggtgggtctacag

SEQ ID NO: 21647 - DNA, 20 bp, human
gcggtgggtctacagcggaa

SEQ ID NO: 21648 - DNA, 20 bp, human
gggcctcggttcaaacgacc

SEQ ID NO: 21649 - DNA, 20 bp, human
ggggtctacagcggaaggga

SEQ ID NO: 21650 - DNA, 20 bp, human
gtcggttcaaacgacccggt

SEQ ID NO: 21651 - DNA, 20 bp, human
gtcctcagtagacctcccgg

SEQ ID NO: 21652 - DNA, 20 bp, human
ggatgggtcttcagaagagg

SEQ ID NO: 21653 - DNA, 20 bp, human
gaagccggtggacaccgtgg

SEQ ID NO: 21654 - DNA, 20 bp, human
gctaaagccggtggacaccg

SEQ ID NO: 21655 - DNA, 20 bp, human
gcgccattaacgaggaggat

SEQ ID NO: 21656 - DNA, 20 bp, human
gccatgtctggtggagagaa

SEQ ID NO: 21657 - DNA, 20 bp, human
gccagcctagatgtctgagg

SEQ ID NO: 21658 - DNA, 20 bp, human
gagaggcagtccagccgcag

SEQ ID NO: 21659 - DNA, 20 bp, human
gatcctccctggacccgaat

SEQ ID NO: 21660 - DNA, 20 bp, human
gtgaggaggagagactgttc

SEQ ID NO: 21661 - DNA, 20 bp, human
gacccgaatgggcacttacc

SEQ ID NO: 21662 - DNA, 20 bp, human
ggagacactctggggcgggt

SEQ ID NO: 21663 - DNA, 20 bp, human
gggaggagagactgttcggg

SEQ ID NO: 21664 - DNA, 20 bp, human
gggggtccccaaaatggatg

SEQ ID NO: 21665 - DNA, 20 bp, human
gctcccagcctagatgtctg

SEQ ID NO: 21666 - DNA, 20 bp, human
gcgagcctaggcgagcaggg

SEQ ID NO: 21667 - DNA, 20 bp, human
gcgccgagcctaggcgagca

SEQ ID NO: 21668 - DNA, 20 bp, human
gcgcgcgggagagcacggat

SEQ ID NO: 21669 - DNA, 20 bp, human
gcgctccaccctgctcgcct

SEQ ID NO: 21670 - DNA, 20 bp, human
gccctcctctgcctctgccg

SEQ ID NO: 21671 - DNA, 20 bp, human
gcgaggcgagcggtgctcta

SEQ ID NO: 21672 - DNA, 20 bp, human
gctcggccggcccctcgtgg

SEQ ID NO: 21673 - DNA, 20 bp, human
gaagcagagggcgacagggc

SEQ ID NO: 21674 - DNA, 20 bp, human
ggaacaaagccgtttatccg

SEQ ID NO: 21675 - DNA, 20 bp, human
gaccctgggctcgatgtaag

SEQ ID NO: 21676 - DNA, 20 bp, human
gatccggacgtaggaggtgg

SEQ ID NO: 21677 - DNA, 20 bp, human
ggtgcgcatccggacgtagg

SEQ ID NO: 21678 - DNA, 20 bp, human
gcgcatccggacgtaggagg

SEQ ID NO: 21679 - DNA, 20 bp, human
gtcagtgcgcatccggacgt

SEQ ID NO: 21680 - DNA, 20 bp, human
gcacccggaagccacagtcg

SEQ ID NO: 21681 - DNA, 20 bp, human
gcagtcggggaacctccggg

SEQ ID NO: 21682 - DNA, 20 bp, human
gtcggaacgtaagacgaagt

SEQ ID NO: 21683 - DNA, 20 bp, human
gatcccgcaagcctcaactc

SEQ ID NO: 21684 - DNA, 20 bp, human
gagtggtctctcaggagtga

SEQ ID NO: 21685 - DNA, 20 bp, human
gccacagtcggggaacctcc

SEQ ID NO: 21686 - DNA, 20 bp, human
ggcaggagaggagctgtcct

SEQ ID NO: 21687 - DNA, 20 bp, human
ggccccgtcagaagacccca

SEQ ID NO: 21688 - DNA, 20 bp, human
gttcggcgcctgcctagctc

SEQ ID NO: 21689 - DNA, 20 bp, human
gactggagagccaacctcaa

SEQ ID NO: 21690 - DNA, 20 bp, human
ggcgcctgcctagctctggc

SEQ ID NO: 21691 - DNA, 20 bp, human
gtctcctgccagagctaggc

SEQ ID NO: 21692 - DNA, 20 bp, human
gcggggccatgcggctactt

SEQ ID NO: 21693 - DNA, 20 bp, human
ggaccagctccggtaagagg

SEQ ID NO: 21694 - DNA, 20 bp, human
gaggtctggtcccgcagtgg

SEQ ID NO: 21695 - DNA, 20 bp, human
gaaaaggtctggtcccgcag

SEQ ID NO: 21696 - DNA, 20 bp, human
gctgggccagagggtaatgc

SEQ ID NO: 21697 - DNA, 20 bp, human
gaggggcctgagacctcccg

SEQ ID NO: 21698 - DNA, 20 bp, human
gtgtctgcagcgtcctcggg

SEQ ID NO: 21699 - DNA, 20 bp, human
ggttcccagagatcccggta

SEQ ID NO: 21700 - DNA, 20 bp, human
gagacgctgcgcgtgcccag

SEQ ID NO: 21701 - DNA, 20 bp, human
gcccagagatcccggtaggg

SEQ ID NO: 21702 - DNA, 20 bp, human
gacgcgcagcgtctgcccaa

SEQ ID NO: 21703 - DNA, 20 bp, human
gggcgcctggaagatgcctg

SEQ ID NO: 21704 - DNA, 20 bp, human
ggggtgtctgcagcgtcctc

SEQ ID NO: 21705 - DNA, 20 bp, human
gctcctccggggcaaggcgg

SEQ ID NO: 21706 - DNA, 20 bp, human
gagagggtaagtctctatac

SEQ ID NO: 21707 - DNA, 20 bp, human
gtctatacgggataaggaca

SEQ ID NO: 21708 - DNA, 20 bp, human
gcggtactgagcaaagaaca

SEQ ID NO: 21709 - DNA, 20 bp, human
gcacagcttgaggctcatgt

SEQ ID NO: 21710 - DNA, 20 bp, human
gttgctgataggagcaagac

SEQ ID NO: 21711 - DNA, 20 bp, human
gtgctgggtattccttgtct

SEQ ID NO: 21712 - DNA, 20 bp, human
gatgagagctgtgggatgaa

SEQ ID NO: 21713 - DNA, 20 bp, human
gtagcacatagacccaagag

SEQ ID NO: 21714 - DNA, 20 bp, human
gtctgaaaaactagcaggtg

SEQ ID NO: 21715 - DNA, 20 bp, human
gtaagtctctatacgggata

SEQ ID NO: 21716 - DNA, 20 bp, human
gttctctggcgggaagagta

SEQ ID NO: 21717 - DNA, 20 bp, human
gaagagggcggcactcgagt

SEQ ID NO: 21718 - DNA, 20 bp, human
ggcccagccgcaagtaacac

SEQ ID NO: 21719 - DNA, 20 bp, human
gcgctctgctccagtcccgc

SEQ ID NO: 21720 - DNA, 20 bp, human
ggggtcttcccagcgcaggc

SEQ ID NO: 21721 - DNA, 20 bp, human
gaagaaggtgcctgcgggac

SEQ ID NO: 21722 - DNA, 20 bp, human
gtataacatgctctggtgtg

SEQ ID NO: 21723 - DNA, 20 bp, human
gtggttgttagtccacattc

SEQ ID NO: 21724 - DNA, 20 bp, human
gaggggagttgtcagtggaa

SEQ ID NO: 21725 - DNA, 20 bp, human
gacgtccgctacaggttcgg

SEQ ID NO: 21726 - DNA, 20 bp, human
gggactcccctgaccctggt

SEQ ID NO: 21727 - DNA, 20 bp, human
gcctctggcacctcttccgt

SEQ ID NO: 21728 - DNA, 20 bp, human
gctccacagagccgcgcata

SEQ ID NO: 21729 - DNA, 20 bp, human
gtgtggagtgcacctggggt

SEQ ID NO: 21730 - DNA, 20 bp, human
ggtgggcgggtcagggcaca

SEQ ID NO: 21731 - DNA, 20 bp, human
gcgcgagtcatgtgaccctc

SEQ ID NO: 21732 - DNA, 20 bp, human
ggaccctggtgggcgggtca

SEQ ID NO: 21733 - DNA, 20 bp, human
gacggccgcaattcagccga

SEQ ID NO: 21734 - DNA, 20 bp, human
gcgggagctgagggaaccct

SEQ ID NO: 21735 - DNA, 20 bp, human
gggctggaaccgggcatcca

SEQ ID NO: 21736 - DNA, 20 bp, human
gtagtccaggcggctctcgg

SEQ ID NO: 21737 - DNA, 20 bp, human
gacatcagcatcgacagcag

SEQ ID NO: 21738 - DNA, 20 bp, human
gcaccacgaacatgtagtag

SEQ ID NO: 21739 - DNA, 20 bp, human
gcagcagtggcagaaacgtc

SEQ ID NO: 21740 - DNA, 20 bp, human
gccgtgggccgctccttccg

SEQ ID NO: 21741 - DNA, 20 bp, human
gccgtagccgaagcctcgga

SEQ ID NO: 21742 - DNA, 20 bp, human
gcggtggggggagtagatag

SEQ ID NO: 21743 - DNA, 20 bp, human
ggccgaagcctcggaaggag

SEQ ID NO: 21744 - DNA, 20 bp, human
gtggggggagtagatagggg

SEQ ID NO: 21745 - DNA, 20 bp, human
gccagtagatcagcctatgg

SEQ ID NO: 21746 - DNA, 20 bp, human
gccatttagccacatgggaa

SEQ ID NO: 21747 - DNA, 20 bp, human
ggcttgcgctcacttccgcc

SEQ ID NO: 21748 - DNA, 20 bp, human
gcagacagtgcggagatgag

SEQ ID NO: 21749 - DNA, 20 bp, human
ggtgggtgggtggaaatatg

SEQ ID NO: 21750 - DNA, 20 bp, human
gcggagatgaggggtactgg

SEQ ID NO: 21751 - DNA, 20 bp, human
gcaaggcgggcgctgaatgg

SEQ ID NO: 21752 - DNA, 20 bp, human
gggcggctcaaccccagccg

SEQ ID NO: 21753 - DNA, 20 bp, human
gggagacgcgatgatgggag

SEQ ID NO: 21754 - DNA, 20 bp, human
gtggggtcctcagcgggatg

SEQ ID NO: 21755 - DNA, 20 bp, human
ggctggggttgagccgccgg

SEQ ID NO: 21756 - DNA, 20 bp, human
gtagggcagcgtccccaccc

SEQ ID NO: 21757 - DNA, 20 bp, human
gcggagagaacagagtcggg

SEQ ID NO: 21758 - DNA, 20 bp, human
ggtcggggggcttaccgcta

SEQ ID NO: 21759 - DNA, 20 bp, human
gtgcaggtccccgggatgag

SEQ ID NO: 21760 - DNA, 20 bp, human
gctggcagctcagaggtgcg

SEQ ID NO: 21761 - DNA, 20 bp, human
gtgcccggagagaacagagt

SEQ ID NO: 21762 - DNA, 20 bp, human
ggcggtccgtgcttctcccc

SEQ ID NO: 21763 - DNA, 20 bp, human
ggctgacactctcagacccg

SEQ ID NO: 21764 - DNA, 20 bp, human
gcccttttagaaccacccag

SEQ ID NO: 21765 - DNA, 20 bp, human
gtagggcagcccctcatccc

SEQ ID NO: 21766 - DNA, 20 bp, human
ggaattcccccgctcgacga

SEQ ID NO: 21767 - DNA, 20 bp, human
gtcgacgacggcgagggtgt

SEQ ID NO: 21768 - DNA, 20 bp, human
ggccccccgagtgcctacaa

SEQ ID NO: 21769 - DNA, 20 bp, human
gtactggcaggcaaattggt

SEQ ID NO: 21770 - DNA, 20 bp, human
gcctcgccgtcgtcgagcgg

SEQ ID NO: 21771 - DNA, 20 bp, human
ggggtgtgggagctactggc

SEQ ID NO: 21772 - DNA, 20 bp, human
gcaggcgccgaaagttgtca

SEQ ID NO: 21773 - DNA, 20 bp, human
gaccattgtaggcactcggg

SEQ ID NO: 21774 - DNA, 20 bp, human
gccgcaggaggcgctcgcct

SEQ ID NO: 21775 - DNA, 20 bp, human
ggctgggggccggggactaa

SEQ ID NO: 21776 - DNA, 20 bp, human
gtgagtctggacaatgggaa

SEQ ID NO: 21777 - DNA, 20 bp, human
ggccagaactcctcagtgaa

SEQ ID NO: 21778 - DNA, 20 bp, human
gggcctgctttatgttcccg

SEQ ID NO: 21779 - DNA, 20 bp, human
gttatgttcccggggcagtg

SEQ ID NO: 21780 - DNA, 20 bp, human
gttgcccgggaaagttctgg

SEQ ID NO: 21781 - DNA, 20 bp, human
gtaaagcaggcctttcactg

SEQ ID NO: 21782 - DNA, 20 bp, human
gggggctgagtctggacaat

SEQ ID NO: 21783 - DNA, 20 bp, human
gtgccccgggaacataaagc

SEQ ID NO: 21784 - DNA, 20 bp, human
gtccaagagaggggtaaagt

SEQ ID NO: 21785 - DNA, 20 bp, human
gcctcctctccagggctggt

SEQ ID NO: 21786 - DNA, 20 bp, human
gtacgggagcaggagactgt

SEQ ID NO: 21787 - DNA, 20 bp, human
ggagctggcgcccagcgtac

SEQ ID NO: 21788 - DNA, 20 bp, human
gcgcggcgcacggagcacgg

SEQ ID NO: 21789 - DNA, 20 bp, human
ggccgggactgggtaagaca

SEQ ID NO: 21790 - DNA, 20 bp, human
gtggagtgtgcaccccagag

SEQ ID NO: 21791 - DNA, 20 bp, human
gagcaggagactgtcggctg

SEQ ID NO: 21792 - DNA, 20 bp, human
ggctccgcgccgagctcagg

SEQ ID NO: 21793 - DNA, 20 bp, human
gcggccgcctgagctcggcg

SEQ ID NO: 21794 - DNA, 20 bp, human
ggccgtgtcttacccagtcc

SEQ ID NO: 21795 - DNA, 20 bp, human
gcgggctccgcgccgagctc

SEQ ID NO: 21796 - DNA, 20 bp, human
gcccctagggaggacaccat

SEQ ID NO: 21797 - DNA, 20 bp, human
ggcccatggtgtcctcccta

SEQ ID NO: 21798 - DNA, 20 bp, human
gcacggctgtgcaagagcag

SEQ ID NO: 21799 - DNA, 20 bp, human
ggacaccatgggcccactga

SEQ ID NO: 21800 - DNA, 20 bp, human
ggctcagggtgctacaccag

SEQ ID NO: 21801 - DNA, 20 bp, human
gggcaaaaaagaaccatcag

SEQ ID NO: 21802 - DNA, 20 bp, human
gacctgggtacaggaacagc

SEQ ID NO: 21803 - DNA, 20 bp, human
gctgcctcctacctgggtac

SEQ ID NO: 21804 - DNA, 20 bp, human
gacccggtctctgtctaagg

SEQ ID NO: 21805 - DNA, 20 bp, human
gaccgccttagacagagacc

SEQ ID NO: 21806 - DNA, 20 bp, human
gcctaagctgggagctgcaa

SEQ ID NO: 21807 - DNA, 20 bp, human
gacagtcacagccatctccg

SEQ ID NO: 21808 - DNA, 20 bp, human
gtctccgaggccgctctcag

SEQ ID NO: 21809 - DNA, 20 bp, human
gagaagggcacgctgctcca

SEQ ID NO: 21810 - DNA, 20 bp, human
ggctgtgactgtcctaagct

SEQ ID NO: 21811 - DNA, 20 bp, human
ggtgcccttctgaaaacctg

SEQ ID NO: 21812 - DNA, 20 bp, human
gaggcgggaaaagcccaacc

SEQ ID NO: 21813 - DNA, 20 bp, human
gggatccctagtgcgtgtga

SEQ ID NO: 21814 - DNA, 20 bp, human
gggacagagacgccacacct

SEQ ID NO: 21815 - DNA, 20 bp, human
ggggatccaggtaagcccag

SEQ ID NO: 21816 - DNA, 20 bp, human
gccacaccgcgggacagacg

SEQ ID NO: 21817 - DNA, 20 bp, human
gcctcgccggagccacaccg

SEQ ID NO: 21818 - DNA, 20 bp, human
ggcggccgggaacccaagat

SEQ ID NO: 21819 - DNA, 20 bp, human
gcgcggccgcgtctgtcccg

SEQ ID NO: 21820 - DNA, 20 bp, human
gacaccacttggcccatctt

SEQ ID NO: 21821 - DNA, 20 bp, human
gtgtatgtgccggtcaagac

SEQ ID NO: 21822 - DNA, 20 bp, human
gagttctgggtgcgctccaa

SEQ ID NO: 21823 - DNA, 20 bp, human
gagggcttccgcctgggcag

SEQ ID NO: 21824 - DNA, 20 bp, human
ggctccaagggcttccgcct

SEQ ID NO: 21825 - DNA, 20 bp, human
ggaacccaagatgggccaag

SEQ ID NO: 21826 - DNA, 20 bp, human
gagggcccgggcagacagaa

SEQ ID NO: 21827 - DNA, 20 bp, human
ggaatgctgaccaaagtggg

SEQ ID NO: 21828 - DNA, 20 bp, human
gtacctatggagcaggtcaa

SEQ ID NO: 21829 - DNA, 20 bp, human
gacctgctccataggtaagt

SEQ ID NO: 21830 - DNA, 20 bp, human
gatggagcaggtcaaaggtg

SEQ ID NO: 21831 - DNA, 20 bp, human
ggcactaggactgacaatcc

SEQ ID NO: 21832 - DNA, 20 bp, human
ggctgctgcccacttaccta

SEQ ID NO: 21833 - DNA, 20 bp, human
gccagaatgctgaccaaagt

SEQ ID NO: 21834 - DNA, 20 bp, human
ggccgggtcatggagagagg

SEQ ID NO: 21835 - DNA, 20 bp, human
ggtttgctgggtgggtatgg

SEQ ID NO: 21836 - DNA, 20 bp, human
gtggtgaccagccctgccat

SEQ ID NO: 21837 - DNA, 20 bp, human
gtgtgggccatcgtccccag

SEQ ID NO: 21838 - DNA, 20 bp, human
gtgggaactatagtttccca

SEQ ID NO: 21839 - DNA, 20 bp, human
gggcagagcagacggagtgt

SEQ ID NO: 21840 - DNA, 20 bp, human
gcaggcccgcaaggagaggc

SEQ ID NO: 21841 - DNA, 20 bp, human
gcagagaaagctggacaagt

SEQ ID NO: 21842 - DNA, 20 bp, human
gtctccttgcgggcctgctt

SEQ ID NO: 21843 - DNA, 20 bp, human
gggatcccaggagcccatat

SEQ ID NO: 21844 - DNA, 20 bp, human
ggcacccaagcaggcccgca

SEQ ID NO: 21845 - DNA, 20 bp, human
gaggccggctgacatggaca

SEQ ID NO: 21846 - DNA, 20 bp, human
ggccggctcgcggagacaca

SEQ ID NO: 21847 - DNA, 20 bp, human
gatgcgtccgcacttggtgg

SEQ ID NO: 21848 - DNA, 20 bp, human
ggagccaatcgcgaatgcag

SEQ ID NO: 21849 - DNA, 20 bp, human
ggctcgcggagacacagggg

SEQ ID NO: 21850 - DNA, 20 bp, human
gggccggctcctgacccgag

SEQ ID NO: 21851 - DNA, 20 bp, human
gcaatcgcgaatgcaggggt

SEQ ID NO: 21852 - DNA, 20 bp, human
gcgcgattggctcccggagg

SEQ ID NO: 21853 - DNA, 20 bp, human
gattcgcgattggctcccgg

SEQ ID NO: 21854 - DNA, 20 bp, human
gaggcgctggtgcagagtta

SEQ ID NO: 21855 - DNA, 20 bp, human
gtataagaactgcaaaggtg

SEQ ID NO: 21856 - DNA, 20 bp, human
gcttcccggaactgaaccaa

SEQ ID NO: 21857 - DNA, 20 bp, human
gctcaaaacggtctctgact

SEQ ID NO: 21858 - DNA, 20 bp, human
gatgtggctagtcctgagag

SEQ ID NO: 21859 - DNA, 20 bp, human
gggttcagttccgggaagtg

SEQ ID NO: 21860 - DNA, 20 bp, human
gaagggcagtcgcaatgctg

SEQ ID NO: 21861 - DNA, 20 bp, human
ggacagcaaggcccccactg

SEQ ID NO: 21862 - DNA, 20 bp, human
ggcccaggcggtggctcccg

SEQ ID NO: 21863 - DNA, 20 bp, human
gccattcgtcggctgtgtgg

SEQ ID NO: 21864 - DNA, 20 bp, human
ggtgctccaggaagactatg

SEQ ID NO: 21865 - DNA, 20 bp, human
gaggcggtggctcccgtggt

SEQ ID NO: 21866 - DNA, 20 bp, human
gtagcgtggagccgccctgc

SEQ ID NO: 21867 - DNA, 20 bp, human
gcatggcggcggacgactgg

SEQ ID NO: 21868 - DNA, 20 bp, human
gggaacggcgccctctgtag

SEQ ID NO: 21869 - DNA, 20 bp, human
gcgcagggcgtggtccgaca

SEQ ID NO: 21870 - DNA, 20 bp, human
ggtctcagttgcccgcaggg

SEQ ID NO: 21871 - DNA, 20 bp, human
ggaggacggtgcagctgcga

SEQ ID NO: 21872 - DNA, 20 bp, human
gagggtctcagttgcccgca

SEQ ID NO: 21873 - DNA, 20 bp, human
gcagggaatcgctgtcccta

SEQ ID NO: 21874 - DNA, 20 bp, human
gccccacaatggcttcccta

SEQ ID NO: 21875 - DNA, 20 bp, human
gggggggtacacgtccatgg

SEQ ID NO: 21876 - DNA, 20 bp, human
gtgtgctgtgggggaacggg

SEQ ID NO: 21877 - DNA, 20 bp, human
ggcgcgcggctccgcttcag

SEQ ID NO: 21878 - DNA, 20 bp, human
gctcgagaacaggcccctgg

SEQ ID NO: 21879 - DNA, 20 bp, human
ggcaagtgggcgcggtcctg

SEQ ID NO: 21880 - DNA, 20 bp, human
gcaaaggccgctggtcccca

SEQ ID NO: 21881 - DNA, 20 bp, human
gtggtccccagggcaacccg

SEQ ID NO: 21882 - DNA, 20 bp, human
ggcgtgtaggaagcagcgag

SEQ ID NO: 21883 - DNA, 20 bp, human
ggctctgggaagtccgcgcg

SEQ ID NO: 21884 - DNA, 20 bp, human
gccaggtggaacacccagag

SEQ ID NO: 21885 - DNA, 20 bp, human
ggtagagtgcgggcacctgg

SEQ ID NO: 21886 - DNA, 20 bp, human
gcggatggtgagtgtgtcgg

SEQ ID NO: 21887 - DNA, 20 bp, human
gagtgtgtcggggggcttgg

SEQ ID NO: 21888 - DNA, 20 bp, human
gttgcggatggtgagtgtgt

SEQ ID NO: 21889 - DNA, 20 bp, human
gggtaagcgcgggatgggat

SEQ ID NO: 21890 - DNA, 20 bp, human
gggagaggtaagcgcgggat

SEQ ID NO: 21891 - DNA, 20 bp, human
gaccatccgcaaccggaacg

SEQ ID NO: 21892 - DNA, 20 bp, human
gaaccggaacgcggaagcaa

SEQ ID NO: 21893 - DNA, 20 bp, human
gttggaggagaggtaagcgc

SEQ ID NO: 21894 - DNA, 20 bp, human
gttagcagaacctcctgaag

SEQ ID NO: 21895 - DNA, 20 bp, human
gtccgcgttccggttgcgga

SEQ ID NO: 21896 - DNA, 20 bp, human
gcatgcaggacacctccacc

SEQ ID NO: 21897 - DNA, 20 bp, human
gggacacctccacccggccc

SEQ ID NO: 21898 - DNA, 20 bp, human
gtaagagtctaaggccgaga

SEQ ID NO: 21899 - DNA, 20 bp, human
gcatgccgcgtgggtcactg

SEQ ID NO: 21900 - DNA, 20 bp, human
gcgccaaactgctacaaagt

SEQ ID NO: 21901 - DNA, 20 bp, human
gtcatatcctgcctgagcct

SEQ ID NO: 21902 - DNA, 20 bp, human
gggagtcttgtgaaatcgcg

SEQ ID NO: 21903 - DNA, 20 bp, human
ggtggactcaccgcgctgct

SEQ ID NO: 21904 - DNA, 20 bp, human
gtgggtcactgtggatttca

SEQ ID NO: 21905 - DNA, 20 bp, human
gagaggcaattaagagtcta

SEQ ID NO: 21906 - DNA, 20 bp, human
ggcgcaccgggagcgttgag

SEQ ID NO: 21907 - DNA, 20 bp, human
ggtcgccgaagagcagatgg

SEQ ID NO: 21908 - DNA, 20 bp, human
gggtgaggagcgtgccaagg

SEQ ID NO: 21909 - DNA, 20 bp, human
ggcatggccgccagtccctg

SEQ ID NO: 21910 - DNA, 20 bp, human
gagggcccgcgggagcgaag

SEQ ID NO: 21911 - DNA, 20 bp, human
ggggcccagcccggcttggg

SEQ ID NO: 21912 - DNA, 20 bp, human
ggtgaggcgagggggtcgga

SEQ ID NO: 21913 - DNA, 20 bp, human
gcgacagagccccccaagcc

SEQ ID NO: 21914 - DNA, 20 bp, human
ggtgcgggtcggtggaaccg

SEQ ID NO: 21915 - DNA, 20 bp, human
ggccagtccctgcggcgtca

SEQ ID NO: 21916 - DNA, 20 bp, human
gccctgctagagccacacag

SEQ ID NO: 21917 - DNA, 20 bp, human
gtcttgggcagaccttggag

SEQ ID NO: 21918 - DNA, 20 bp, human
ggctgccagtctgaaagagt

SEQ ID NO: 21919 - DNA, 20 bp, human
ggtgtgctgagtcctctgtg

SEQ ID NO: 21920 - DNA, 20 bp, human
gaggtcgtggcctatatggg

SEQ ID NO: 21921 - DNA, 20 bp, human
gatccctcgggcccagaacc

SEQ ID NO: 21922 - DNA, 20 bp, human
gagtaggtcgtggcctatat

SEQ ID NO: 21923 - DNA, 20 bp, human
ggaggctgcaggctacggta

SEQ ID NO: 21924 - DNA, 20 bp, human
gctcaggttcagggataagt

SEQ ID NO: 21925 - DNA, 20 bp, human
gcacccagcacctcccatat

SEQ ID NO: 21926 - DNA, 20 bp, human
gcgagtcttacctcttcatg

SEQ ID NO: 21927 - DNA, 20 bp, human
ggaagaggtaagactcggac

SEQ ID NO: 21928 - DNA, 20 bp, human
gggtaagactcggacaggct

SEQ ID NO: 21929 - DNA, 20 bp, human
ggctgcagtctggcactctg

SEQ ID NO: 21930 - DNA, 20 bp, human
gggggaactggggggtgacc

SEQ ID NO: 21931 - DNA, 20 bp, human
gccccactacactccaaagt

SEQ ID NO: 21932 - DNA, 20 bp, human
gcagggatgagcagcttcag

SEQ ID NO: 21933 - DNA, 20 bp, human
gccaacgtgacctcaggcaa

SEQ ID NO: 21934 - DNA, 20 bp, human
gtgaaaggtctggggaactg

SEQ ID NO: 21935 - DNA, 20 bp, human
gccagccactgccatctgaa

SEQ ID NO: 21936 - DNA, 20 bp, human
ggcaggcgccgcgaagggag

SEQ ID NO: 21937 - DNA, 20 bp, human
ggtagcttggccaggttgtg

SEQ ID NO: 21938 - DNA, 20 bp, human
ggttccggcacaatcgagta

SEQ ID NO: 21939 - DNA, 20 bp, human
gtgtgccggaacgaggacga

SEQ ID NO: 21940 - DNA, 20 bp, human
gacaatcgagtagggcagtg

SEQ ID NO: 21941 - DNA, 20 bp, human
gccggtcctgcggcgcgctg

SEQ ID NO: 21942 - DNA, 20 bp, human
ggacgcggcctgggaggata

SEQ ID NO: 21943 - DNA, 20 bp, human
gacagagcaggcgccgcgaa

SEQ ID NO: 21944 - DNA, 20 bp, human
gctgggaggataaggtacgg

SEQ ID NO: 21945 - DNA, 20 bp, human
ggactcggggaacggaagac

SEQ ID NO: 21946 - DNA, 20 bp, human
gctggagctgcggatgaggt

SEQ ID NO: 21947 - DNA, 20 bp, human
ggcgtcgctgctagtcagca

SEQ ID NO: 21948 - DNA, 20 bp, human
ggagccgtggcgccctgcaa

SEQ ID NO: 21949 - DNA, 20 bp, human
ggcattgcagcctaaaaggg

SEQ ID NO: 21950 - DNA, 20 bp, human
gcgtcctggagctgcggatg

SEQ ID NO: 21951 - DNA, 20 bp, human
gtgcggcagcgcgtggagtg

SEQ ID NO: 21952 - DNA, 20 bp, human
gtaagaacggagctccaatc

SEQ ID NO: 21953 - DNA, 20 bp, human
gagcagcgacgcaaggactg

SEQ ID NO: 21954 - DNA, 20 bp, human
gcaatctggatgctcgaggg

SEQ ID NO: 21955 - DNA, 20 bp, human
gcgcgtggagtgcggcgtcc

SEQ ID NO: 21956 - DNA, 20 bp, human
ggaggcagcggcaatgaaca

SEQ ID NO: 21957 - DNA, 20 bp, human
gcaacgccgagcacgaggaa

SEQ ID NO: 21958 - DNA, 20 bp, human
gccaggcccggccccgacag

SEQ ID NO: 21959 - DNA, 20 bp, human
gggcatgagtgcggtagtga

SEQ ID NO: 21960 - DNA, 20 bp, human
gcgaacgggaaggaaccggg

SEQ ID NO: 21961 - DNA, 20 bp, human
gacagggtcgtggggaggag

SEQ ID NO: 21962 - DNA, 20 bp, human
gggcaatgaacagggtcgtg

SEQ ID NO: 21963 - DNA, 20 bp, human
gggaggctcagagatgctac

SEQ ID NO: 21964 - DNA, 20 bp, human
gccttgcggggtgcaccccg

SEQ ID NO: 21965 - DNA, 20 bp, human
gccgcgaagcgattgtccgg

SEQ ID NO: 21966 - DNA, 20 bp, human
gctgtgctgagtgtcctcac

SEQ ID NO: 21967 - DNA, 20 bp, human
gctgggttggaggactaagt

SEQ ID NO: 21968 - DNA, 20 bp, human
gtggccgttggaacagacaa

SEQ ID NO: 21969 - DNA, 20 bp, human
gacagtgtgggcaaccggac

SEQ ID NO: 21970 - DNA, 20 bp, human
gccagacttcaaggagtggg

SEQ ID NO: 21971 - DNA, 20 bp, human
gtgaagtctggccatttggg

SEQ ID NO: 21972 - DNA, 20 bp, human
gtgtgggcaaccggacagga

SEQ ID NO: 21973 - DNA, 20 bp, human
gctaagtagggacaagaaag

SEQ ID NO: 21974 - DNA, 20 bp, human
gccttgaagtctggccattt

SEQ ID NO: 21975 - DNA, 20 bp, human
gcagagacagtgtggagccg

SEQ ID NO: 21976 - DNA, 20 bp, human
gtctgcgccatgaggcctgg

SEQ ID NO: 21977 - DNA, 20 bp, human
gaaacctctcagcaccgcgg

SEQ ID NO: 21978 - DNA, 20 bp, human
gcccagggccagagcttgcg

SEQ ID NO: 21979 - DNA, 20 bp, human
ggggcccaccacgaagacgt

SEQ ID NO: 21980 - DNA, 20 bp, human
gtggtgggcccaacaggaga

SEQ ID NO: 21981 - DNA, 20 bp, human
gcagaaacctctcagcaccg

SEQ ID NO: 21982 - DNA, 20 bp, human
gctaaactcgaggggcagag

SEQ ID NO: 21983 - DNA, 20 bp, human
ggtgcgctgaggatggtcag

SEQ ID NO: 21984 - DNA, 20 bp, human
ggcctggcaaccggtctccc

SEQ ID NO: 21985 - DNA, 20 bp, human
gatcgaccactaaactcgag

SEQ ID NO: 21986 - DNA, 20 bp, human
ggcagtcacgaccgtgagag

SEQ ID NO: 21987 - DNA, 20 bp, human
gcttgggtctggaaagagtt

SEQ ID NO: 21988 - DNA, 20 bp, human
gcagcaattcgaaacaggat

SEQ ID NO: 21989 - DNA, 20 bp, human
gtaagcacatccaggctgtg

SEQ ID NO: 21990 - DNA, 20 bp, human
ggtctggaaagagttgggaa

SEQ ID NO: 21991 - DNA, 20 bp, human
gcgcctaccgagcgcctaaa

SEQ ID NO: 21992 - DNA, 20 bp, human
ggagacgctggcgaaagcat

SEQ ID NO: 21993 - DNA, 20 bp, human
ggaccgtgagagtggagagc

SEQ ID NO: 21994 - DNA, 20 bp, human
gggtctccagcctatatccg

SEQ ID NO: 21995 - DNA, 20 bp, human
gggagagcaggtggactgca

SEQ ID NO: 21996 - DNA, 20 bp, human
gagcagagccaacgtgtcag

SEQ ID NO: 21997 - DNA, 20 bp, human
ggccgattggcggctcggtg

SEQ ID NO: 21998 - DNA, 20 bp, human
gcggatcctgagccgattgg

SEQ ID NO: 21999 - DNA, 20 bp, human
gggccgccatgaagctgacg

SEQ ID NO: 22000 - DNA, 20 bp, human
ggggcccgcgtcgtcagggg

SEQ ID NO: 22001 - DNA, 20 bp, human
ggggcgacgcgagcccgctg

SEQ ID NO: 22002 - DNA, 20 bp, human
ggcggccgcccaggcccgac

SEQ ID NO: 22003 - DNA, 20 bp, human
gttgggcgccgctgacacgt

SEQ ID NO: 22004 - DNA, 20 bp, human
ggcggggcccgcgtcgtcag

SEQ ID NO: 22005 - DNA, 20 bp, human
gccggcctcctgatcccggg

SEQ ID NO: 22006 - DNA, 20 bp, human
ggccattgcggtgaggacag

SEQ ID NO: 22007 - DNA, 20 bp, human
gcctcggcgtaagtcctcag

SEQ ID NO: 22008 - DNA, 20 bp, human
ggtggcctcgaggctcgctg

SEQ ID NO: 22009 - DNA, 20 bp, human
gtgaggacagcggggtcgga

SEQ ID NO: 22010 - DNA, 20 bp, human
gcccgctgtcctcaccgcaa

SEQ ID NO: 22011 - DNA, 20 bp, human
ggatgccgcagcgagcctcg

SEQ ID NO: 22012 - DNA, 20 bp, human
gaggagcgggagctgacccg

SEQ ID NO: 22013 - DNA, 20 bp, human
gcgcaggtgctgtctggatg

SEQ ID NO: 22014 - DNA, 20 bp, human
gtccagacagcacctgcgag

SEQ ID NO: 22015 - DNA, 20 bp, human
gaggaagaggggccgacctt

SEQ ID NO: 22016 - DNA, 20 bp, human
gctgctgaggtggatctcag

SEQ ID NO: 22017 - DNA, 20 bp, human
ggaaaggcgggagctccaag

SEQ ID NO: 22018 - DNA, 20 bp, human
gacacgggctcggtcgggaa

SEQ ID NO: 22019 - DNA, 20 bp, human
gctggtggacacaaagccca

SEQ ID NO: 22020 - DNA, 20 bp, human
ggttcccagggtcccggcaa

SEQ ID NO: 22021 - DNA, 20 bp, human
gtttgtgtccaccaggacag

SEQ ID NO: 22022 - DNA, 20 bp, human
gagcagacacgggctcggtc

SEQ ID NO: 22023 - DNA, 20 bp, human
gcgggctcggtcgggaaagg

SEQ ID NO: 22024 - DNA, 20 bp, human
gcagggtcccggcaagggtg

SEQ ID NO: 22025 - DNA, 20 bp, human
ggatctcaggggatccgcaa

SEQ ID NO: 22026 - DNA, 20 bp, human
gctgcaggagacgactgtag

SEQ ID NO: 22027 - DNA, 20 bp, human
gtgcagggctggcgaaaggt

SEQ ID NO: 22028 - DNA, 20 bp, human
gcgagtaacagaaccaggga

SEQ ID NO: 22029 - DNA, 20 bp, human
gtccctcaggcagcaggaga

SEQ ID NO: 22030 - DNA, 20 bp, human
gctgatgagtccagcatggt

SEQ ID NO: 22031 - DNA, 20 bp, human
ggcaggagagggaacaatgc

SEQ ID NO: 22032 - DNA, 20 bp, human
gcccacaggccgccatgaga

SEQ ID NO: 22033 - DNA, 20 bp, human
gcatgagagggactcacccc

SEQ ID NO: 22034 - DNA, 20 bp, human
gggacaggcaggtcggtcat

SEQ ID NO: 22035 - DNA, 20 bp, human
gtcagcaggagcccaagcac

SEQ ID NO: 22036 - DNA, 20 bp, human
gggtggcccgggtctataat

SEQ ID NO: 22037 - DNA, 20 bp, human
ggcgagccgcacctgagcag

SEQ ID NO: 22038 - DNA, 20 bp, human
gtgggattccggactgtgag

SEQ ID NO: 22039 - DNA, 20 bp, human
gggttaaccggagatgaata

SEQ ID NO: 22040 - DNA, 20 bp, human
gaccgcgggctagggagcgt

SEQ ID NO: 22041 - DNA, 20 bp, human
ggggttgaaacgggacacta

SEQ ID NO: 22042 - DNA, 20 bp, human
gagacaggccggatcttctc

SEQ ID NO: 22043 - DNA, 20 bp, human
gcctccagctcggtactccc

SEQ ID NO: 22044 - DNA, 20 bp, human
ggcgcctgggagtaccgagc

SEQ ID NO: 22045 - DNA, 20 bp, human
gctaacagccgctcacagtc

SEQ ID NO: 22046 - DNA, 20 bp, human
gaggatccgtggccaggcag

SEQ ID NO: 22047 - DNA, 20 bp, human
gagccagggtgaaggatccg

SEQ ID NO: 22048 - DNA, 20 bp, human
ggagaggcgaggcctcacgg

SEQ ID NO: 22049 - DNA, 20 bp, human
gggccacggatccttcaccc

SEQ ID NO: 22050 - DNA, 20 bp, human
gcactccacagacctctgcc

SEQ ID NO: 22051 - DNA, 20 bp, human
gtctgtggagtggagaggcg

SEQ ID NO: 22052 - DNA, 20 bp, human
gaagaaggtgaccctgacaa

SEQ ID NO: 22053 - DNA, 20 bp, human
gtggcaggaactgtgacggt

SEQ ID NO: 22054 - DNA, 20 bp, human
gatctgagagttccaccgtg

SEQ ID NO: 22055 - DNA, 20 bp, human
gcaagccagggtggaatgcg

SEQ ID NO: 22056 - DNA, 20 bp, human
gctgcggccggaaacaatag

SEQ ID NO: 22057 - DNA, 20 bp, human
ggaacccgagccgcacggaa

SEQ ID NO: 22058 - DNA, 20 bp, human
gcccgagccgcacggaacgg

SEQ ID NO: 22059 - DNA, 20 bp, human
gcggccggaaacaatagtgg

SEQ ID NO: 22060 - DNA, 20 bp, human
gtacaccgaaggccgagcgg

SEQ ID NO: 22061 - DNA, 20 bp, human
gaactacaccgaaggccgag

SEQ ID NO: 22062 - DNA, 20 bp, human
gccaccaccgccgttccgtg

SEQ ID NO: 22063 - DNA, 20 bp, human
gccggcttgggcccctccgg

SEQ ID NO: 22064 - DNA, 20 bp, human
gggcggaacgatgggactgg

SEQ ID NO: 22065 - DNA, 20 bp, human
gtccggggcaactacaccga

SEQ ID NO: 22066 - DNA, 20 bp, human
gaggcaatggcgggaaaggg

SEQ ID NO: 22067 - DNA, 20 bp, human
ggcctccccacccaccgcaa

SEQ ID NO: 22068 - DNA, 20 bp, human
ggggggatgagcacactcag

SEQ ID NO: 22069 - DNA, 20 bp, human
ggaccagcttggaagcttag

SEQ ID NO: 22070 - DNA, 20 bp, human
gtatccgcctaccaagacag

SEQ ID NO: 22071 - DNA, 20 bp, human
ggcagctagtccaagactcc

SEQ ID NO: 22072 - DNA, 20 bp, human
gtccccacccaccgcaaggg

SEQ ID NO: 22073 - DNA, 20 bp, human
gcacatggcgggggtcgtcg

SEQ ID NO: 22074 - DNA, 20 bp, human
gtcggggaagcggctctgtg

SEQ ID NO: 22075 - DNA, 20 bp, human
gtaagtggggtcccctgtct

SEQ ID NO: 22076 - DNA, 20 bp, human
gggacctgcgagctgctcag

SEQ ID NO: 22077 - DNA, 20 bp, human
gagatggaggtagtgaccaa

SEQ ID NO: 22078 - DNA, 20 bp, human
gcagggaagtctcctcggga

SEQ ID NO: 22079 - DNA, 20 bp, human
ggtggcagggaagtctcctc

SEQ ID NO: 22080 - DNA, 20 bp, human
gcgtcggggaacagagatta

SEQ ID NO: 22081 - DNA, 20 bp, human
gcaggcgctgggtcagaatg

SEQ ID NO: 22082 - DNA, 20 bp, human
ggcgtttctatagtagcgag

SEQ ID NO: 22083 - DNA, 20 bp, human
gagaagtgggctcccggagg

SEQ ID NO: 22084 - DNA, 20 bp, human
ggggaacagagattagggac

SEQ ID NO: 22085 - DNA, 20 bp, human
gggtagtgaccaaaggaact

SEQ ID NO: 22086 - DNA, 20 bp, human
gaagccagacccccaggcgt

SEQ ID NO: 22087 - DNA, 20 bp, human
gggaagcgcgggctaagggc

SEQ ID NO: 22088 - DNA, 20 bp, human
gggtcgcccatggccgggag

SEQ ID NO: 22089 - DNA, 20 bp, human
gcgggttccgaactaagatg

SEQ ID NO: 22090 - DNA, 20 bp, human
gggctccttcgcgtccccta

SEQ ID NO: 22091 - DNA, 20 bp, human
gcatgggcgacccggcgacc

SEQ ID NO: 22092 - DNA, 20 bp, human
ggagaaaaccagctgagaca

SEQ ID NO: 22093 - DNA, 20 bp, human
gaattgcagacttcaggtcg

SEQ ID NO: 22094 - DNA, 20 bp, human
gtcgccgggtcgcccatggc

SEQ ID NO: 22095 - DNA, 20 bp, human
gagcgggaagcgcgggctaa

SEQ ID NO: 22096 - DNA, 20 bp, human
ggggccagccgcacagtcgg

SEQ ID NO: 22097 - DNA, 20 bp, human
gacaccgagccgcggccaca

SEQ ID NO: 22098 - DNA, 20 bp, human
ggacgcgtgtgcaggggccc

SEQ ID NO: 22099 - DNA, 20 bp, human
gagcggcagacaccgagccg

SEQ ID NO: 22100 - DNA, 20 bp, human
gagccgcacagtcggaggaa

SEQ ID NO: 22101 - DNA, 20 bp, human
gccctgctgcccgagctcgg

SEQ ID NO: 22102 - DNA, 20 bp, human
gggggaggacgcgtgtgcag

SEQ ID NO: 22103 - DNA, 20 bp, human
gccagcgagggtgtgtatgg

SEQ ID NO: 22104 - DNA, 20 bp, human
gcggcctccccgccgagggg

SEQ ID NO: 22105 - DNA, 20 bp, human
gacagggccagccgcacagt

SEQ ID NO: 22106 - DNA, 20 bp, human
ggagcaggcgttcccgactc

SEQ ID NO: 22107 - DNA, 20 bp, human
ggattcgcgtagcctcaggt

SEQ ID NO: 22108 - DNA, 20 bp, human
ggtcgggaacgcctgctcct

SEQ ID NO: 22109 - DNA, 20 bp, human
gtacgagctcacaaggccca

SEQ ID NO: 22110 - DNA, 20 bp, human
gcctctgagggcgagagtcc

SEQ ID NO: 22111 - DNA, 20 bp, human
gtgaccctcttgccggagtc

SEQ ID NO: 22112 - DNA, 20 bp, human
ggttcccgactccggcaaga

SEQ ID NO: 22113 - DNA, 20 bp, human
gatccgtagccacagaccgt

SEQ ID NO: 22114 - DNA, 20 bp, human
gactgaggcccgcagaccga

SEQ ID NO: 22115 - DNA, 20 bp, human
ggtgaggccaggcaaggagc

SEQ ID NO: 22116 - DNA, 20 bp, human
gatttgcccatatgtgacta

SEQ ID NO: 22117 - DNA, 20 bp, human
gctctgccttagtcacatat

SEQ ID NO: 22118 - DNA, 20 bp, human
gtgtattcagccgaacatgg

SEQ ID NO: 22119 - DNA, 20 bp, human
gctgccggcctccatttcct

SEQ ID NO: 22120 - DNA, 20 bp, human
gaagtgtattcagccgaaca

SEQ ID NO: 22121 - DNA, 20 bp, human
gttagatgtgggctcaatgc

SEQ ID NO: 22122 - DNA, 20 bp, human
gcttcttggtgcatggcagt

SEQ ID NO: 22123 - DNA, 20 bp, human
gtaagagcaacagaacaatt

SEQ ID NO: 22124 - DNA, 20 bp, human
gatttaaggcaactgaaata

SEQ ID NO: 22125 - DNA, 20 bp, human
gttttcgctagcttagtaag

SEQ ID NO: 22126 - DNA, 20 bp, human
gtccctccggaagaccccgg

SEQ ID NO: 22127 - DNA, 20 bp, human
gcgcgccggtcgcccagaca

SEQ ID NO: 22128 - DNA, 20 bp, human
gcagacatggcggacggcag

SEQ ID NO: 22129 - DNA, 20 bp, human
gccctccctccggaagaccc

SEQ ID NO: 22130 - DNA, 20 bp, human
gacctagccggggactgacg

SEQ ID NO: 22131 - DNA, 20 bp, human
ggcggccggcctgcgaacag

SEQ ID NO: 22132 - DNA, 20 bp, human
ggtcggagccgggaaccacc

SEQ ID NO: 22133 - DNA, 20 bp, human
gctcgccgtggacgtagtag

SEQ ID NO: 22134 - DNA, 20 bp, human
gcattggctggcggactgag

SEQ ID NO: 22135 - DNA, 20 bp, human
gccggcgctcctcccagtcg

SEQ ID NO: 22136 - DNA, 20 bp, human
gccctgggaaagccggctat

SEQ ID NO: 22137 - DNA, 20 bp, human
gaagctgaggatgtctctga

SEQ ID NO: 22138 - DNA, 20 bp, human
gaagccggctatgggcagga

SEQ ID NO: 22139 - DNA, 20 bp, human
gacggccagctaccgactga

SEQ ID NO: 22140 - DNA, 20 bp, human
gggagctcctcctccttcta

SEQ ID NO: 22141 - DNA, 20 bp, human
gcacaaggacagaatgtagt

SEQ ID NO: 22142 - DNA, 20 bp, human
ggtcggtagctggccgtaga

SEQ ID NO: 22143 - DNA, 20 bp, human
gagggactgcaaaggggtgg

SEQ ID NO: 22144 - DNA, 20 bp, human
gagtcagtttgctccccatt

SEQ ID NO: 22145 - DNA, 20 bp, human
gcatcttcggcgtcttcggg

SEQ ID NO: 22146 - DNA, 20 bp, human
gggaggtggcggcagaataa

SEQ ID NO: 22147 - DNA, 20 bp, human
gtagctggtctatgaggtca

SEQ ID NO: 22148 - DNA, 20 bp, human
gacaatttcgctgaaggctg

SEQ ID NO: 22149 - DNA, 20 bp, human
gcagtatcagattcataaca

SEQ ID NO: 22150 - DNA, 20 bp, human
ggttgtatcaactcccactg

SEQ ID NO: 22151 - DNA, 20 bp, human
gccaaactagctggtctatg

SEQ ID NO: 22152 - DNA, 20 bp, human
gtggcagtttttgcaccttt

SEQ ID NO: 22153 - DNA, 20 bp, human
gtgggttataagcatcagcc

SEQ ID NO: 22154 - DNA, 20 bp, human
gcgccacctcccaaactagc

SEQ ID NO: 22155 - DNA, 20 bp, human
gacagttacaatttcgctga

SEQ ID NO: 22156 - DNA, 20 bp, human
gactggccctgtgtcgaaga

SEQ ID NO: 22157 - DNA, 20 bp, human
ggcgccagtgcccccgtaga

SEQ ID NO: 22158 - DNA, 20 bp, human
ggctgcctagtacaaattat

SEQ ID NO: 22159 - DNA, 20 bp, human
gtcgaagaaggaacgtactt

SEQ ID NO: 22160 - DNA, 20 bp, human
gccagtgcccccgtagaggg

SEQ ID NO: 22161 - DNA, 20 bp, human
gacgttccttcttcgacaca

SEQ ID NO: 22162 - DNA, 20 bp, human
gtgacgctacgcgagcgagt

SEQ ID NO: 22163 - DNA, 20 bp, human
gtctgccaataatttgtact

SEQ ID NO: 22164 - DNA, 20 bp, human
gggggcactggcgcggaaac

SEQ ID NO: 22165 - DNA, 20 bp, human
ggccgctgcggccggccggt

SEQ ID NO: 22166 - DNA, 20 bp, human
gccgcacacctgcggaacag

SEQ ID NO: 22167 - DNA, 20 bp, human
gcggcgtctgggaagttcct

SEQ ID NO: 22168 - DNA, 20 bp, human
ggagcagcgcgtcggacccc

SEQ ID NO: 22169 - DNA, 20 bp, human
gcagccccgggccggaacgg

SEQ ID NO: 22170 - DNA, 20 bp, human
gtcgcggccctggccacggt

SEQ ID NO: 22171 - DNA, 20 bp, human
gcggcagccccgggccggaa

SEQ ID NO: 22172 - DNA, 20 bp, human
gcgcaagccccgcacacctg

SEQ ID NO: 22173 - DNA, 20 bp, human
gcgcccactgcgccaggtac

SEQ ID NO: 22174 - DNA, 20 bp, human
gcgctcccgactcggcgtct

SEQ ID NO: 22175 - DNA, 20 bp, human
ggccaggtacaggcctaccg

SEQ ID NO: 22176 - DNA, 20 bp, human
gctggtctgcagagacgctg

SEQ ID NO: 22177 - DNA, 20 bp, human
gccgcgcggtgggaggagtc

SEQ ID NO: 22178 - DNA, 20 bp, human
gtgtggcacccactagtcct

SEQ ID NO: 22179 - DNA, 20 bp, human
gcccgggccatgctcccccg

SEQ ID NO: 22180 - DNA, 20 bp, human
gctgagtgcccaggactagt

SEQ ID NO: 22181 - DNA, 20 bp, human
ggaggagaggaggtcctcgg

SEQ ID NO: 22182 - DNA, 20 bp, human
ggagcagcgaggcggcgaag

SEQ ID NO: 22183 - DNA, 20 bp, human
ggcggcgaagaggatcagca

SEQ ID NO: 22184 - DNA, 20 bp, human
ggggccccgccggaccctgg

SEQ ID NO: 22185 - DNA, 20 bp, human
ggaggaggtgggctcccccg

SEQ ID NO: 22186 - DNA, 20 bp, human
gcaggaagatggctattgaa

SEQ ID NO: 22187 - DNA, 20 bp, human
gtacagctggggcagaaggt

SEQ ID NO: 22188 - DNA, 20 bp, human
gcggaggcatcccagattaa

SEQ ID NO: 22189 - DNA, 20 bp, human
ggtacctagctcccacaagg

SEQ ID NO: 22190 - DNA, 20 bp, human
ggatggctattgaaaggcag

SEQ ID NO: 22191 - DNA, 20 bp, human
ggcatcccagattaagggag

SEQ ID NO: 22192 - DNA, 20 bp, human
gcaactaactgctacagctg

SEQ ID NO: 22193 - DNA, 20 bp, human
gggtacaatgcagtgatcca

SEQ ID NO: 22194 - DNA, 20 bp, human
ggggagttcctcagactcac

SEQ ID NO: 22195 - DNA, 20 bp, human
gattgtacctagctcccaca

SEQ ID NO: 22196 - DNA, 20 bp, human
gctttgctacaatacctctc

SEQ ID NO: 22197 - DNA, 20 bp, human
gaccggtaggatgactgtag

SEQ ID NO: 22198 - DNA, 20 bp, human
gtattggagggaaggcgtct

SEQ ID NO: 22199 - DNA, 20 bp, human
gggccctccagagaatagaa

SEQ ID NO: 22200 - DNA, 20 bp, human
gcgtaagaaggaagtagcca

SEQ ID NO: 22201 - DNA, 20 bp, human
gaagtagccagggaaccaga

SEQ ID NO: 22202 - DNA, 20 bp, human
gtgagatgaaggttaccggt

SEQ ID NO: 22203 - DNA, 20 bp, human
ggttttccggagactgttag

SEQ ID NO: 22204 - DNA, 20 bp, human
gaaagcgtaataggagagca

SEQ ID NO: 22205 - DNA, 20 bp, human
gccacggcgcctgcgttccc

SEQ ID NO: 22206 - DNA, 20 bp, human
ggaccaggagaggcgcttag

SEQ ID NO: 22207 - DNA, 20 bp, human
gctgggacaccgaccaggag

SEQ ID NO: 22208 - DNA, 20 bp, human
gtctgcctgggacaccgacc

SEQ ID NO: 22209 - DNA, 20 bp, human
ggctggcagtccttgaacac

SEQ ID NO: 22210 - DNA, 20 bp, human
gctggagtcctgcgtcagat

SEQ ID NO: 22211 - DNA, 20 bp, human
gtgccttaggccagccaggg

SEQ ID NO: 22212 - DNA, 20 bp, human
gctccgccctggctggccta

SEQ ID NO: 22213 - DNA, 20 bp, human
ggctgaggactagactgcta

SEQ ID NO: 22214 - DNA, 20 bp, human
gacgattgcaaggcaatcgt

SEQ ID NO: 22215 - DNA, 20 bp, human
gctctgccttaggccagcca

SEQ ID NO: 22216 - DNA, 20 bp, human
gctggccgcagtactgaagg

SEQ ID NO: 22217 - DNA, 20 bp, human
ggcgcagcgccggggcacgg

SEQ ID NO: 22218 - DNA, 20 bp, human
gggaagaggtgcgcctgcgg

SEQ ID NO: 22219 - DNA, 20 bp, human
ggcacggcggcggcccggat

SEQ ID NO: 22220 - DNA, 20 bp, human
gctcctggccgcagtactga

SEQ ID NO: 22221 - DNA, 20 bp, human
gactcgagcgtgcaaggggc

SEQ ID NO: 22222 - DNA, 20 bp, human
gagtactgcggccaggagag

SEQ ID NO: 22223 - DNA, 20 bp, human
gctgctgcagcccctcgacg

SEQ ID NO: 22224 - DNA, 20 bp, human
gcggcgggatgcagaattcg

SEQ ID NO: 22225 - DNA, 20 bp, human
ggaaggtggcgcctcggcag

SEQ ID NO: 22226 - DNA, 20 bp, human
gccagggaggagccacaggt

SEQ ID NO: 22227 - DNA, 20 bp, human
gcgcggccggagcttcgatg

SEQ ID NO: 22228 - DNA, 20 bp, human
ggttccgcgctcagtcccag

SEQ ID NO: 22229 - DNA, 20 bp, human
ggccggagcttcgatgcggg

SEQ ID NO: 22230 - DNA, 20 bp, human
gcgtactcggaggaatacgg

SEQ ID NO: 22231 - DNA, 20 bp, human
gatgctcaaaaccagagtgg

SEQ ID NO: 22232 - DNA, 20 bp, human
gggccgtactcggaggaata

SEQ ID NO: 22233 - DNA, 20 bp, human
ggcggagctgggacaccccg

SEQ ID NO: 22234 - DNA, 20 bp, human
ggccgcccgcatcgaagctc

SEQ ID NO: 22235 - DNA, 20 bp, human
ggccgcgctctgactctccg

SEQ ID NO: 22236 - DNA, 20 bp, human
gagtccaggtggaagagcgg

SEQ ID NO: 22237 - DNA, 20 bp, human
gtgaggcagcgagcaggtcg

SEQ ID NO: 22238 - DNA, 20 bp, human
gcttcgcggcccgccaggtg

SEQ ID NO: 22239 - DNA, 20 bp, human
gcagaggcgcaggtccgggg

SEQ ID NO: 22240 - DNA, 20 bp, human
gcggcagaggcgcaggtccg

SEQ ID NO: 22241 - DNA, 20 bp, human
gaactgcgggatgcgatccg

SEQ ID NO: 22242 - DNA, 20 bp, human
gggtggaagagcggcggcgt

SEQ ID NO: 22243 - DNA, 20 bp, human
ggcagttcttcatcccgcct

SEQ ID NO: 22244 - DNA, 20 bp, human
gcgggcccccgacagcgaca

SEQ ID NO: 22245 - DNA, 20 bp, human
ggcagcacgctctcgcgcgt

SEQ ID NO: 22246 - DNA, 20 bp, human
gtctgcaggagcccaagaag

SEQ ID NO: 22247 - DNA, 20 bp, human
gcgaaaccgagaccatgcca

SEQ ID NO: 22248 - DNA, 20 bp, human
gtgggagagctggacaacca

SEQ ID NO: 22249 - DNA, 20 bp, human
gtcggtttcggcctcttctt

SEQ ID NO: 22250 - DNA, 20 bp, human
gggtgggtagatccttcaca

SEQ ID NO: 22251 - DNA, 20 bp, human
gaagggagggcagtcgaggg

SEQ ID NO: 22252 - DNA, 20 bp, human
gacaaccacggccgaaggga

SEQ ID NO: 22253 - DNA, 20 bp, human
gggagcgccaagccctgtga

SEQ ID NO: 22254 - DNA, 20 bp, human
ggccgaagggagggcagtcg

SEQ ID NO: 22255 - DNA, 20 bp, human
gagacaagcaggggcggcag

SEQ ID NO: 22256 - DNA, 20 bp, human
ggccaatgtgacgggatcag

SEQ ID NO: 22257 - DNA, 20 bp, human
gatcaggggcagacccattt

SEQ ID NO: 22258 - DNA, 20 bp, human
gccggtgagtggggaatgag

SEQ ID NO: 22259 - DNA, 20 bp, human
gctgctctgcttcccttcgg

SEQ ID NO: 22260 - DNA, 20 bp, human
ggaatgagtggcggagagtg

SEQ ID NO: 22261 - DNA, 20 bp, human
gaagcaaccttaatacccag

SEQ ID NO: 22262 - DNA, 20 bp, human
gcccttcggaggaaaatttc

SEQ ID NO: 22263 - DNA, 20 bp, human
gctgcaaattgggaaacggg

SEQ ID NO: 22264 - DNA, 20 bp, human
gttcaggctgaaggtttagc

SEQ ID NO: 22265 - DNA, 20 bp, human
ggggttgccactgggtatta

SEQ ID NO: 22266 - DNA, 20 bp, human
gcccctggtgtcagctccat

SEQ ID NO: 22267 - DNA, 20 bp, human
gggtctagggattagttcag

SEQ ID NO: 22268 - DNA, 20 bp, human
gacctatggagctgacacca

SEQ ID NO: 22269 - DNA, 20 bp, human
gaagcatggcttcgatgcaa

SEQ ID NO: 22270 - DNA, 20 bp, human
gcctcaaagagtgaaatatg

SEQ ID NO: 22271 - DNA, 20 bp, human
gcaaactgatgccctggtct

SEQ ID NO: 22272 - DNA, 20 bp, human
gtcacaatgcgttaaatctg

SEQ ID NO: 22273 - DNA, 20 bp, human
gctgatgggaacttcctagt

SEQ ID NO: 22274 - DNA, 20 bp, human
gatctgacactagtcaacag

SEQ ID NO: 22275 - DNA, 20 bp, human
gggaacttcctagttggctc

SEQ ID NO: 22276 - DNA, 20 bp, human
gctgtttactttcagttggt

SEQ ID NO: 22277 - DNA, 20 bp, human
gtacagactagcacagaagc

SEQ ID NO: 22278 - DNA, 20 bp, human
gaggtatggggttgtctgtc

SEQ ID NO: 22279 - DNA, 20 bp, human
ggaaacaatagtgttaacat

SEQ ID NO: 22280 - DNA, 20 bp, human
gatgacatgatagcaggtat

SEQ ID NO: 22281 - DNA, 20 bp, human
gacaatagtgttaacatggg

SEQ ID NO: 22282 - DNA, 20 bp, human
gctttctgtttactttcagt

SEQ ID NO: 22283 - DNA, 20 bp, human
gctgtagatgacatgatagc

SEQ ID NO: 22284 - DNA, 20 bp, human
gcattctatgaaaaagtgtt

SEQ ID NO: 22285 - DNA, 20 bp, human
ggagatgaactttattatcc

SEQ ID NO: 22286 - DNA, 20 bp, human
ggagggaccgcggctgagac

SEQ ID NO: 22287 - DNA, 20 bp, human
ggacaggctgctgcaccagg

SEQ ID NO: 22288 - DNA, 20 bp, human
gtagcccacggagccacggt

SEQ ID NO: 22289 - DNA, 20 bp, human
ggcacccaccgtggctccgt

SEQ ID NO: 22290 - DNA, 20 bp, human
gggtagggcgacctgtcacc

SEQ ID NO: 22291 - DNA, 20 bp, human
gccggccccgcgcacagacc

SEQ ID NO: 22292 - DNA, 20 bp, human
gcctaccagagcgcgtacga

SEQ ID NO: 22293 - DNA, 20 bp, human
ggcggcctggggacttggca

SEQ ID NO: 22294 - DNA, 20 bp, human
gtcaggtgccagctgccgcc

SEQ ID NO: 22295 - DNA, 20 bp, human
ggcgggaagccgcacgctgg

SEQ ID NO: 22296 - DNA, 20 bp, human
gtacgcagctggtaacccag

SEQ ID NO: 22297 - DNA, 20 bp, human
gggagggccaggcgtccgaa

SEQ ID NO: 22298 - DNA, 20 bp, human
gaggtgctgcgagggagaac

SEQ ID NO: 22299 - DNA, 20 bp, human
ggggcgaggggcgcacttcg

SEQ ID NO: 22300 - DNA, 20 bp, human
gcgcgcgggggaggcagcca

SEQ ID NO: 22301 - DNA, 20 bp, human
gaggacagcaggccgcgcgg

SEQ ID NO: 22302 - DNA, 20 bp, human
ggggcaaccttgggcaagga

SEQ ID NO: 22303 - DNA, 20 bp, human
gtgagggtggagagagtacc

SEQ ID NO: 22304 - DNA, 20 bp, human
gatgccaggctgattgatag

SEQ ID NO: 22305 - DNA, 20 bp, human
ggagtaccggggtcaagggg

SEQ ID NO: 22306 - DNA, 20 bp, human
gctcaacggcctcggaacag

SEQ ID NO: 22307 - DNA, 20 bp, human
gggccctgcagtcaacggag

SEQ ID NO: 22308 - DNA, 20 bp, human
gctacctcacaggatcgtgt

SEQ ID NO: 22309 - DNA, 20 bp, human
gtcgtcagctaagggccccg

SEQ ID NO: 22310 - DNA, 20 bp, human
gccccgtttgtaaaaggccg

SEQ ID NO: 22311 - DNA, 20 bp, human
gggcagaagcatcacctcgc

SEQ ID NO: 22312 - DNA, 20 bp, human
gtgagcgtcccggagtcggg

SEQ ID NO: 22313 - DNA, 20 bp, human
gcagcggaggaagaccgccg

SEQ ID NO: 22314 - DNA, 20 bp, human
gaacggcctcggaacagcgg

SEQ ID NO: 22315 - DNA, 20 bp, human
gggcttgccaaaccacaagt

SEQ ID NO: 22316 - DNA, 20 bp, human
ggcggtgaactgccaggcag

SEQ ID NO: 22317 - DNA, 20 bp, human
gaagctggcggtgaactgcc

SEQ ID NO: 22318 - DNA, 20 bp, human
gttcaggaccgagctcttca

SEQ ID NO: 22319 - DNA, 20 bp, human
gcagtgcggcaaagagaccg

SEQ ID NO: 22320 - DNA, 20 bp, human
gtcagaaagtgtccccgatg

SEQ ID NO: 22321 - DNA, 20 bp, human
gttggggaaggccacattga

SEQ ID NO: 22322 - DNA, 20 bp, human
gcacaaagcatcggtaatca

SEQ ID NO: 22323 - DNA, 20 bp, human
gctgcttgcgtgcaccgtag

SEQ ID NO: 22324 - DNA, 20 bp, human
gcaaatcagataagaaagct

SEQ ID NO: 22325 - DNA, 20 bp, human
gcattgtatgtgccacatcg

SEQ ID NO: 22326 - DNA, 20 bp, human
gccttccaggtggacaggtg

SEQ ID NO: 22327 - DNA, 20 bp, human
gctccctgagggtcctggga

SEQ ID NO: 22328 - DNA, 20 bp, human
gggcagccttccaggtggac

SEQ ID NO: 22329 - DNA, 20 bp, human
gatctggcccagggcaacag

SEQ ID NO: 22330 - DNA, 20 bp, human
gcataagactccctacaggt

SEQ ID NO: 22331 - DNA, 20 bp, human
gtgcccggcctgcaactcaa

SEQ ID NO: 22332 - DNA, 20 bp, human
gtgcccccgcggaggagtag

SEQ ID NO: 22333 - DNA, 20 bp, human
gtggccgggaagaactcgct

SEQ ID NO: 22334 - DNA, 20 bp, human
gcgtgagcactaaacgccgg

SEQ ID NO: 22335 - DNA, 20 bp, human
gtgggaaggcggcacgagac

SEQ ID NO: 22336 - DNA, 20 bp, human
gtgtgaggcagtgagaccta

SEQ ID NO: 22337 - DNA, 20 bp, human
gtgtgcggcggcgtgatgtt

SEQ ID NO: 22338 - DNA, 20 bp, human
ggcggcggcgtgatgttggg

SEQ ID NO: 22339 - DNA, 20 bp, human
gcgggtagcgggataaagtt

SEQ ID NO: 22340 - DNA, 20 bp, human
gtgaggatcgagctaggggt

SEQ ID NO: 22341 - DNA, 20 bp, human
gagagattggtgtttttgtg

SEQ ID NO: 22342 - DNA, 20 bp, human
gcagaacttcttatgtgcgg

SEQ ID NO: 22343 - DNA, 20 bp, human
gagtggagatgaaatacctt

SEQ ID NO: 22344 - DNA, 20 bp, human
gcggccctcagtcctctgat

SEQ ID NO: 22345 - DNA, 20 bp, human
gtaggggtgggtgtaaatga

SEQ ID NO: 22346 - DNA, 20 bp, human
gaactggggtagcaaacgag

SEQ ID NO: 22347 - DNA, 20 bp, human
gttttagagacccagggtgt

SEQ ID NO: 22348 - DNA, 20 bp, human
ggaccgagagtgcaggaact

SEQ ID NO: 22349 - DNA, 20 bp, human
gggagtcggacggccccgca

SEQ ID NO: 22350 - DNA, 20 bp, human
ggacggggccgactcaccag

SEQ ID NO: 22351 - DNA, 20 bp, human
ggggcagcgaccgagagtgc

SEQ ID NO: 22352 - DNA, 20 bp, human
gtcccaagccgaggcgacag

SEQ ID NO: 22353 - DNA, 20 bp, human
gcggcaggcaccggtgtgaa

SEQ ID NO: 22354 - DNA, 20 bp, human
ggcatcacagagttctccga

SEQ ID NO: 22355 - DNA, 20 bp, human
gactggccaccgggagccct

SEQ ID NO: 22356 - DNA, 20 bp, human
ggtgcgccagtggaagcggg

SEQ ID NO: 22357 - DNA, 20 bp, human
gcagtgtgcggtaagtcaga

SEQ ID NO: 22358 - DNA, 20 bp, human
ggacttaccgcacactgggt

SEQ ID NO: 22359 - DNA, 20 bp, human
gggagacagcacgccagtga

SEQ ID NO: 22360 - DNA, 20 bp, human
ggatggagtccaggccctcg

SEQ ID NO: 22361 - DNA, 20 bp, human
gacctgacacgcagaagcag

SEQ ID NO: 22362 - DNA, 20 bp, human
gagcacgccagtgagggaga

SEQ ID NO: 22363 - DNA, 20 bp, human
gtggcaggcgcgtctgtgag

SEQ ID NO: 22364 - DNA, 20 bp, human
ggcgtgtcaggtgttactcg

SEQ ID NO: 22365 - DNA, 20 bp, human
ggattccctttcaagacgta

SEQ ID NO: 22366 - DNA, 20 bp, human
gcaggtcggggcttacacac

SEQ ID NO: 22367 - DNA, 20 bp, human
gggtctcctggcgacgacca

SEQ ID NO: 22368 - DNA, 20 bp, human
gcgaccatggcgggggatgt

SEQ ID NO: 22369 - DNA, 20 bp, human
gctcctggcgacgaccatgg

SEQ ID NO: 22370 - DNA, 20 bp, human
ggtgaggagaaggaactcct

SEQ ID NO: 22371 - DNA, 20 bp, human
ggcttgtaaagaggagtccc

SEQ ID NO: 22372 - DNA, 20 bp, human
gccgcccacatcccccgcca

SEQ ID NO: 22373 - DNA, 20 bp, human
gcaggaatgcttgggaaata

SEQ ID NO: 22374 - DNA, 20 bp, human
ggagtgtccgtggttgccga

SEQ ID NO: 22375 - DNA, 20 bp, human
ggtagccgactggggtctcc

SEQ ID NO: 22376 - DNA, 20 bp, human
ggacagggctctccgggctg

SEQ ID NO: 22377 - DNA, 20 bp, human
gccaggctctgaaggcgcag

SEQ ID NO: 22378 - DNA, 20 bp, human
ggagctcagagtggccgatg

SEQ ID NO: 22379 - DNA, 20 bp, human
gcggagagccctgtccccat

SEQ ID NO: 22380 - DNA, 20 bp, human
ggctctgaaggcgcagcggg

SEQ ID NO: 22381 - DNA, 20 bp, human
gagagtggccgatggggaca

SEQ ID NO: 22382 - DNA, 20 bp, human
gcaggccccccaggctctga

SEQ ID NO: 22383 - DNA, 20 bp, human
gctcagggagctgcctgcga

SEQ ID NO: 22384 - DNA, 20 bp, human
ggggagttcaaaacgaaact

SEQ ID NO: 22385 - DNA, 20 bp, human
ggtggccctatggccagcag

SEQ ID NO: 22386 - DNA, 20 bp, human
gtgggactttgtctaagggg

SEQ ID NO: 22387 - DNA, 20 bp, human
gtaaaagcctctgggagact

SEQ ID NO: 22388 - DNA, 20 bp, human
ggagcagggtcaccaaatgg

SEQ ID NO: 22389 - DNA, 20 bp, human
gcctgtgaaacacagcccag

SEQ ID NO: 22390 - DNA, 20 bp, human
gccagctggtaaaagcctct

SEQ ID NO: 22391 - DNA, 20 bp, human
gagcccagaggagttctcat

SEQ ID NO: 22392 - DNA, 20 bp, human
gttcagcgttgagaggacct

SEQ ID NO: 22393 - DNA, 20 bp, human
gagatgggaacaggaattga

SEQ ID NO: 22394 - DNA, 20 bp, human
gaccagagtggcaggacact

SEQ ID NO: 22395 - DNA, 20 bp, human
gggaggggttcgggggataa

SEQ ID NO: 22396 - DNA, 20 bp, human
ggaggacccaatggacatgg

SEQ ID NO: 22397 - DNA, 20 bp, human
gggcagccttagagagtcgg

SEQ ID NO: 22398 - DNA, 20 bp, human
ggagcagcaggtctgcaggt

SEQ ID NO: 22399 - DNA, 20 bp, human
gctgggagctggagctcgtc

SEQ ID NO: 22400 - DNA, 20 bp, human
ggggagcccccgactctcta

SEQ ID NO: 22401 - DNA, 20 bp, human
gcccctgtgggtggatgccg

SEQ ID NO: 22402 - DNA, 20 bp, human
ggcctcggcatccacccaca

SEQ ID NO: 22403 - DNA, 20 bp, human
gaggtgagcagcaggtctgc

SEQ ID NO: 22404 - DNA, 20 bp, human
gatctgggccctggacccct

SEQ ID NO: 22405 - DNA, 20 bp, human
gccagaggccacccagccgg

SEQ ID NO: 22406 - DNA, 20 bp, human
gtggagccggcctcccccta

SEQ ID NO: 22407 - DNA, 20 bp, human
gtgaccacaggagagcccta

SEQ ID NO: 22408 - DNA, 20 bp, human
gaaagggcatagatgaccac

SEQ ID NO: 22409 - DNA, 20 bp, human
gaggacaagtcagagtctag

SEQ ID NO: 22410 - DNA, 20 bp, human
gacaggagagccctaggggg

SEQ ID NO: 22411 - DNA, 20 bp, human
gccaccagcagccccataca

SEQ ID NO: 22412 - DNA, 20 bp, human
gcctgggagtgccatgtatg

SEQ ID NO: 22413 - DNA, 20 bp, human
gaatccagcgtgggacaggc

SEQ ID NO: 22414 - DNA, 20 bp, human
gtcagaatccagcgtgggac

SEQ ID NO: 22415 - DNA, 20 bp, human
ggagagccctagggggaggc

SEQ ID NO: 22416 - DNA, 20 bp, human
ggtacaaaccagccaatcag

SEQ ID NO: 22417 - DNA, 20 bp, human
gggaggcgaattagtccgag

SEQ ID NO: 22418 - DNA, 20 bp, human
gaagccgcaccgcgtcccgg

SEQ ID NO: 22419 - DNA, 20 bp, human
gcggtggagcggcccctgag

SEQ ID NO: 22420 - DNA, 20 bp, human
gccgccgccgggacgcggtg

SEQ ID NO: 22421 - DNA, 20 bp, human
ggcaaagtagcgcccctcag

SEQ ID NO: 22422 - DNA, 20 bp, human
gtggatgcggcggagggatc

SEQ ID NO: 22423 - DNA, 20 bp, human
gctccgccgcatccagataa

SEQ ID NO: 22424 - DNA, 20 bp, human
gtgctcgggccgcgctgtcc

SEQ ID NO: 22425 - DNA, 20 bp, human
ggcgcggaggagcatcgtgg

SEQ ID NO: 22426 - DNA, 20 bp, human
gttcagcctagagagagagg

SEQ ID NO: 22427 - DNA, 20 bp, human
gaggttcagcctagagagag

SEQ ID NO: 22428 - DNA, 20 bp, human
gagtcttccggcagatggag

SEQ ID NO: 22429 - DNA, 20 bp, human
gaggtcttcccttattgagg

SEQ ID NO: 22430 - DNA, 20 bp, human
gtaggaagagggaacgagag

SEQ ID NO: 22431 - DNA, 20 bp, human
gaccgcttccacctcaataa

SEQ ID NO: 22432 - DNA, 20 bp, human
gaccaggtcttcccttattg

SEQ ID NO: 22433 - DNA, 20 bp, human
gccggcagatggagcggaaa

SEQ ID NO: 22434 - DNA, 20 bp, human
gagctccggttgctaggagg

SEQ ID NO: 22435 - DNA, 20 bp, human
gaaggcctgggattagagag

SEQ ID NO: 22436 - DNA, 20 bp, human
gctggacacagaccgggtag

SEQ ID NO: 22437 - DNA, 20 bp, human
gctgagtcccaggagaatca

SEQ ID NO: 22438 - DNA, 20 bp, human
gggtgggaagaggactgctg

SEQ ID NO: 22439 - DNA, 20 bp, human
gccacctgtggagtaaacct

SEQ ID NO: 22440 - DNA, 20 bp, human
ggagcctacagagggatgag

SEQ ID NO: 22441 - DNA, 20 bp, human
gggtgcaagtctggagagga

SEQ ID NO: 22442 - DNA, 20 bp, human
ggagacagctggacacagac

SEQ ID NO: 22443 - DNA, 20 bp, human
ggaggggtgcaagtctggag

SEQ ID NO: 22444 - DNA, 20 bp, human
gacacagaccgggtagaggc

SEQ ID NO: 22445 - DNA, 20 bp, human
gcctgtggagtaaaccttgg

SEQ ID NO: 22446 - DNA, 20 bp, human
gcaacacatagtagcaggag

SEQ ID NO: 22447 - DNA, 20 bp, human
gtcattgagagagatagtca

SEQ ID NO: 22448 - DNA, 20 bp, human
gagtagcaggagaggtgctc

SEQ ID NO: 22449 - DNA, 20 bp, human
gcagggcaacacatagtagc

SEQ ID NO: 22450 - DNA, 20 bp, human
ggagtgaagctgagtgaaag

SEQ ID NO: 22451 - DNA, 20 bp, human
gtgttgccctggtgctgctt

SEQ ID NO: 22452 - DNA, 20 bp, human
gaaggcttaaaagtaattta

SEQ ID NO: 22453 - DNA, 20 bp, human
gtaaggtgtatttctcagct

SEQ ID NO: 22454 - DNA, 20 bp, human
gataacattctcattatcat

SEQ ID NO: 22455 - DNA, 20 bp, human
gccagattgacttctaaatg

SEQ ID NO: 22456 - DNA, 20 bp, human
gccgcctccatcaggagccg

SEQ ID NO: 22457 - DNA, 20 bp, human
ggggcggcgcggagctctgt

SEQ ID NO: 22458 - DNA, 20 bp, human
gcggcgcggagctctgtggg

SEQ ID NO: 22459 - DNA, 20 bp, human
gctgcgtccccggctcctga

SEQ ID NO: 22460 - DNA, 20 bp, human
ggttgttggggccgtcgagg

SEQ ID NO: 22461 - DNA, 20 bp, human
ggaaccttaggagtaagaag

SEQ ID NO: 22462 - DNA, 20 bp, human
ggctgttgttggggccgtcg

SEQ ID NO: 22463 - DNA, 20 bp, human
gggcggctggacatgaacca

SEQ ID NO: 22464 - DNA, 20 bp, human
ggcgggagtcagggactgtc

SEQ ID NO: 22465 - DNA, 20 bp, human
ggcggagctctgtgggcggg

SEQ ID NO: 22466 - DNA, 20 bp, human
gcagccggcggctcaacggt

SEQ ID NO: 22467 - DNA, 20 bp, human
gagagcggttcggaggtgga

SEQ ID NO: 22468 - DNA, 20 bp, human
ggcggaggggttcctgaggg

SEQ ID NO: 22469 - DNA, 20 bp, human
gggagcctgaacccccacat

SEQ ID NO: 22470 - DNA, 20 bp, human
ggaggaaggaacagataccc

SEQ ID NO: 22471 - DNA, 20 bp, human
ggctgaggcgacgacgtcag

SEQ ID NO: 22472 - DNA, 20 bp, human
gctccccggggacccagcga

SEQ ID NO: 22473 - DNA, 20 bp, human
gaaccaggcagcagccacga

SEQ ID NO: 22474 - DNA, 20 bp, human
ggggatgtgcaggtaactcg

SEQ ID NO: 22475 - DNA, 20 bp, human
gaatagaggacgtgatgctg

SEQ ID NO: 22476 - DNA, 20 bp, human
gtccgccccacggtaaacag

SEQ ID NO: 22477 - DNA, 20 bp, human
gggaggagatggagccacgt

SEQ ID NO: 22478 - DNA, 20 bp, human
gagtccagggggcacgtagg

SEQ ID NO: 22479 - DNA, 20 bp, human
gccctgtgcgccggacggaa

SEQ ID NO: 22480 - DNA, 20 bp, human
gatgagtccagggggcacgt

SEQ ID NO: 22481 - DNA, 20 bp, human
ggcattgaactcggtcagta

SEQ ID NO: 22482 - DNA, 20 bp, human
gtacccgggcatgagtccag

SEQ ID NO: 22483 - DNA, 20 bp, human
gcttcaaccccaaagtccgg

SEQ ID NO: 22484 - DNA, 20 bp, human
gcacctggcaacggccacgg

SEQ ID NO: 22485 - DNA, 20 bp, human
ggccccacggtaaacagcgg

SEQ ID NO: 22486 - DNA, 20 bp, human
gcgctgctcactaacagcag

SEQ ID NO: 22487 - DNA, 20 bp, human
gagaggagcagccaagtccc

SEQ ID NO: 22488 - DNA, 20 bp, human
gggagcagccaagtcccagg

SEQ ID NO: 22489 - DNA, 20 bp, human
gtccccagcgtcatagcagg

SEQ ID NO: 22490 - DNA, 20 bp, human
gagaacaacaacaggacgac

SEQ ID NO: 22491 - DNA, 20 bp, human
gcaattcggccaggatgtca

SEQ ID NO: 22492 - DNA, 20 bp, human
ggactacaagctgaaatcat

SEQ ID NO: 22493 - DNA, 20 bp, human
gggaaccaaaccacagctaa

SEQ ID NO: 22494 - DNA, 20 bp, human
ggtcagggcggaagtgaaag

SEQ ID NO: 22495 - DNA, 20 bp, human
gccctccccagcgtcatagc

SEQ ID NO: 22496 - DNA, 20 bp, human
gggcacagcacgaagaccag

SEQ ID NO: 22497 - DNA, 20 bp, human
gccgcggcggccgcagaggg

SEQ ID NO: 22498 - DNA, 20 bp, human
gctggaagggcggctcggca

SEQ ID NO: 22499 - DNA, 20 bp, human
gccgcctgcgggagatgctg

SEQ ID NO: 22500 - DNA, 20 bp, human
ggcgccaccgccccgagagg

SEQ ID NO: 22501 - DNA, 20 bp, human
gtccagctcgcgctccatgc

SEQ ID NO: 22502 - DNA, 20 bp, human
gctgctgcgggacttcgcac

SEQ ID NO: 22503 - DNA, 20 bp, human
gcttccaccaacgcctggaa

SEQ ID NO: 22504 - DNA, 20 bp, human
gcgctgcccgcctctcgggg

SEQ ID NO: 22505 - DNA, 20 bp, human
gagatgctgcgggacgtgcg

SEQ ID NO: 22506 - DNA, 20 bp, human
gctggtacttgggactgggt

SEQ ID NO: 22507 - DNA, 20 bp, human
gtttcctccatgggcctcta

SEQ ID NO: 22508 - DNA, 20 bp, human
ggtgccgtagaggcccatgg

SEQ ID NO: 22509 - DNA, 20 bp, human
gtctacggcaccaggcagcg

SEQ ID NO: 22510 - DNA, 20 bp, human
ggaagctggtacttgggact

SEQ ID NO: 22511 - DNA, 20 bp, human
gctggtgccgtagaggccca

SEQ ID NO: 22512 - DNA, 20 bp, human
ggcaacagccctccagttgg

SEQ ID NO: 22513 - DNA, 20 bp, human
gtctgactgctgtgtcgagg

SEQ ID NO: 22514 - DNA, 20 bp, human
gacagggacgcagccctgcc

SEQ ID NO: 22515 - DNA, 20 bp, human
ggatccagcatggacagtcc

SEQ ID NO: 22516 - DNA, 20 bp, human
ggcctgcgcagtcagatccg

SEQ ID NO: 22517 - DNA, 20 bp, human
gggccggattccagactcgt

SEQ ID NO: 22518 - DNA, 20 bp, human
ggacgacgtcaacatgtcct

SEQ ID NO: 22519 - DNA, 20 bp, human
gacaaatgggcgaagtactg

SEQ ID NO: 22520 - DNA, 20 bp, human
gtcctcggatctgactgcgc

SEQ ID NO: 22521 - DNA, 20 bp, human
gagactcgtgggggaaaggc

SEQ ID NO: 22522 - DNA, 20 bp, human
gagggttcgggcgagctatt

SEQ ID NO: 22523 - DNA, 20 bp, human
gagcagtgcattagacaaat

SEQ ID NO: 22524 - DNA, 20 bp, human
gcttaaaatcctgctctggc

SEQ ID NO: 22525 - DNA, 20 bp, human
gcacacagatgttagggttc

SEQ ID NO: 22526 - DNA, 20 bp, human
gggtggggacaacggaagta

SEQ ID NO: 22527 - DNA, 20 bp, human
gcaatacaggcctgacacta

SEQ ID NO: 22528 - DNA, 20 bp, human
ggggacgccgggaacaggtg

SEQ ID NO: 22529 - DNA, 20 bp, human
gccaactctcgaccaactcc

SEQ ID NO: 22530 - DNA, 20 bp, human
gacgccgggagtagccgaag

SEQ ID NO: 22531 - DNA, 20 bp, human
gtgcgcaagcggtcccacgt

SEQ ID NO: 22532 - DNA, 20 bp, human
gcgaaggggacgccgggaac

SEQ ID NO: 22533 - DNA, 20 bp, human
gccgcgtgccgtccccacaa

SEQ ID NO: 22534 - DNA, 20 bp, human
gcatcagggaccatctccgg

SEQ ID NO: 22535 - DNA, 20 bp, human
ggccccgcccgagcccacgt

SEQ ID NO: 22536 - DNA, 20 bp, human
gaccccaagatgctaccagg

SEQ ID NO: 22537 - DNA, 20 bp, human
gccaagatgctaccaggtgg

SEQ ID NO: 22538 - DNA, 20 bp, human
gagaaaagaaaagggccagg

SEQ ID NO: 22539 - DNA, 20 bp, human
gtaccaggtggtggtcggtt

SEQ ID NO: 22540 - DNA, 20 bp, human
gtatgaaggccactggtcac

SEQ ID NO: 22541 - DNA, 20 bp, human
ggaaaccccaagatgctacc

SEQ ID NO: 22542 - DNA, 20 bp, human
gtatcctagtgtaatagatg

SEQ ID NO: 22543 - DNA, 20 bp, human
gatactagcggatgtctggg

SEQ ID NO: 22544 - DNA, 20 bp, human
gtgtccagtatgaaggccac

SEQ ID NO: 22545 - DNA, 20 bp, human
gactggacacatgcactggt

SEQ ID NO: 22546 - DNA, 20 bp, human
gcagggccagcccctttcaa

SEQ ID NO: 22547 - DNA, 20 bp, human
gcctggcaggaaaccgagag

SEQ ID NO: 22548 - DNA, 20 bp, human
gggctggccctgctggtaaa

SEQ ID NO: 22549 - DNA, 20 bp, human
gtgtcccagtcagcctgtgt

SEQ ID NO: 22550 - DNA, 20 bp, human
gctggcagcctgcacatccg

SEQ ID NO: 22551 - DNA, 20 bp, human
ggctctcaggctctagaatg

SEQ ID NO: 22552 - DNA, 20 bp, human
gaggctgcaatttagattct

SEQ ID NO: 22553 - DNA, 20 bp, human
gttgcctacacaggctgact

SEQ ID NO: 22554 - DNA, 20 bp, human
gcaagatacaccgttgaaag

SEQ ID NO: 22555 - DNA, 20 bp, human
gagaaaaccagaggatgatc

SEQ ID NO: 22556 - DNA, 20 bp, human
gcatccgcatttgcgaccag

SEQ ID NO: 22557 - DNA, 20 bp, human
gccgcatttgcgaccagggg

SEQ ID NO: 22558 - DNA, 20 bp, human
gatctcgcaggagtcctcac

SEQ ID NO: 22559 - DNA, 20 bp, human
gttgcgaccaggggcggctg

SEQ ID NO: 22560 - DNA, 20 bp, human
ggggcggctgcggtggagac

SEQ ID NO: 22561 - DNA, 20 bp, human
gtaagtgggactccgagcct

SEQ ID NO: 22562 - DNA, 20 bp, human
gtggcctgcggtgcatgctc

SEQ ID NO: 22563 - DNA, 20 bp, human
gtggctgggatgggcgaact

SEQ ID NO: 22564 - DNA, 20 bp, human
gggactagttggaaaagtga

SEQ ID NO: 22565 - DNA, 20 bp, human
gccaactagtccttagagaa

SEQ ID NO: 22566 - DNA, 20 bp, human
gtgcccaggcgactgttagg

SEQ ID NO: 22567 - DNA, 20 bp, human
gcagtcgcctgggcaaccac

SEQ ID NO: 22568 - DNA, 20 bp, human
gtcgtgcgccatcgccaacg

SEQ ID NO: 22569 - DNA, 20 bp, human
ggactgttaggtggcttacg

SEQ ID NO: 22570 - DNA, 20 bp, human
gggttgcccaggcgactgtt

SEQ ID NO: 22571 - DNA, 20 bp, human
gggtcggtgtcgggaacagt

SEQ ID NO: 22572 - DNA, 20 bp, human
gggaagccacgtcggtactc

SEQ ID NO: 22573 - DNA, 20 bp, human
gagccacctaacagtcgcct

SEQ ID NO: 22574 - DNA, 20 bp, human
ggtgggcaccgtgcaggtgt

SEQ ID NO: 22575 - DNA, 20 bp, human
gtagtaagtctcttacatgg

SEQ ID NO: 22576 - DNA, 20 bp, human
gggcaacttgcttaacctag

SEQ ID NO: 22577 - DNA, 20 bp, human
ggacgtcaccccccacctct

SEQ ID NO: 22578 - DNA, 20 bp, human
gtgcttaacctagaggtggg

SEQ ID NO: 22579 - DNA, 20 bp, human
gggccccagcgaccctgcgg

SEQ ID NO: 22580 - DNA, 20 bp, human
gcgtctgcaaagccaaggag

SEQ ID NO: 22581 - DNA, 20 bp, human
gtgccggtagcgctgtgtga

SEQ ID NO: 22582 - DNA, 20 bp, human
gagcagggcggcgatcacga

SEQ ID NO: 22583 - DNA, 20 bp, human
gacttgcttaacctagaggt

SEQ ID NO: 22584 - DNA, 20 bp, human
gagcgctgtgtgaggggtct

SEQ ID NO: 22585 - DNA, 20 bp, human
ggtcctccgcagggtcgctg

SEQ ID NO: 22586 - DNA, 20 bp, human
gactgcgctggttaacttca

SEQ ID NO: 22587 - DNA, 20 bp, human
gagaaggaggacaacttggg

SEQ ID NO: 22588 - DNA, 20 bp, human
gggccctgggaggctagtgg

SEQ ID NO: 22589 - DNA, 20 bp, human
gcggcgggcgggacgcacgg

SEQ ID NO: 22590 - DNA, 20 bp, human
gttgctgttgagggggacat

SEQ ID NO: 22591 - DNA, 20 bp, human
ggacgcacggaggactgcgc

SEQ ID NO: 22592 - DNA, 20 bp, human
gggtagttatcggccctggg

SEQ ID NO: 22593 - DNA, 20 bp, human
gggggaggaagccctctcac

SEQ ID NO: 22594 - DNA, 20 bp, human
gaagccctctcacaggagat

SEQ ID NO: 22595 - DNA, 20 bp, human
ggattcttcaacgttcactg

SEQ ID NO: 22596 - DNA, 20 bp, human
gggattaattccaaacgtca

SEQ ID NO: 22597 - DNA, 20 bp, human
ggaatcatcaaggcaatgaa

SEQ ID NO: 22598 - DNA, 20 bp, human
gacgatgggttgaatcatca

SEQ ID NO: 22599 - DNA, 20 bp, human
ggtccctggcaacaactgat

SEQ ID NO: 22600 - DNA, 20 bp, human
gtctccccacccctcgtccc

SEQ ID NO: 22601 - DNA, 20 bp, human
gtgactgtggttgacaacca

SEQ ID NO: 22602 - DNA, 20 bp, human
gccacagtcatcgtcacgat

SEQ ID NO: 22603 - DNA, 20 bp, human
gtggtctgctgaggaagccc

SEQ ID NO: 22604 - DNA, 20 bp, human
gattggagttaatctgagca

SEQ ID NO: 22605 - DNA, 20 bp, human
gggttgacaaccaaggactg

SEQ ID NO: 22606 - DNA, 20 bp, human
gagatgtgaggctctatcca

SEQ ID NO: 22607 - DNA, 20 bp, human
gattaggggacggagatgtg

SEQ ID NO: 22608 - DNA, 20 bp, human
gcttcactcactcttcaggt

SEQ ID NO: 22609 - DNA, 20 bp, human
gtcagccaagtggcagcatg

SEQ ID NO: 22610 - DNA, 20 bp, human
ggaaacccatgagttacagg

SEQ ID NO: 22611 - DNA, 20 bp, human
gggctaactcttctcgatta

SEQ ID NO: 22612 - DNA, 20 bp, human
ggaggtgggtgactggtgaa

SEQ ID NO: 22613 - DNA, 20 bp, human
gccatgggcgcgcagctgcc

SEQ ID NO: 22614 - DNA, 20 bp, human
ggcacgtccggacagccgtg

SEQ ID NO: 22615 - DNA, 20 bp, human
gggctgtccggacgtgccat

SEQ ID NO: 22616 - DNA, 20 bp, human
gccgagagaactgaaagtca

SEQ ID NO: 22617 - DNA, 20 bp, human
gaagccctaaggttggagtg

SEQ ID NO: 22618 - DNA, 20 bp, human
gcagccacactccaacctta

SEQ ID NO: 22619 - DNA, 20 bp, human
gcatggtatgggaaaacctg

SEQ ID NO: 22620 - DNA, 20 bp, human
gttctagaacaggcttgacc

SEQ ID NO: 22621 - DNA, 20 bp, human
gaggtgggagacctgtcaga

SEQ ID NO: 22622 - DNA, 20 bp, human
ggtggctggtgagttcggga

SEQ ID NO: 22623 - DNA, 20 bp, human
gggtgagttcgggaaggatg

SEQ ID NO: 22624 - DNA, 20 bp, human
gggcccagagaacatggtat

SEQ ID NO: 22625 - DNA, 20 bp, human
ggctgagaacagactttaca

SEQ ID NO: 22626 - DNA, 20 bp, human
gtgcagggtcagagggacag

SEQ ID NO: 22627 - DNA, 20 bp, human
ggcaccatgggacccacctc

SEQ ID NO: 22628 - DNA, 20 bp, human
gggacctgaggtgggtccca

SEQ ID NO: 22629 - DNA, 20 bp, human
gcataaacacccaaactctc

SEQ ID NO: 22630 - DNA, 20 bp, human
gcaggtccctgtagaattca

SEQ ID NO: 22631 - DNA, 20 bp, human
gacaaacagggctggttctg

SEQ ID NO: 22632 - DNA, 20 bp, human
ggagtcataaccactcacat

SEQ ID NO: 22633 - DNA, 20 bp, human
gatgcaccctgaattctaca

SEQ ID NO: 22634 - DNA, 20 bp, human
gctggagctggctttttatc

SEQ ID NO: 22635 - DNA, 20 bp, human
gagtttgggtgtttatgggt

SEQ ID NO: 22636 - DNA, 20 bp, human
gcttcactgtggctaagtgt

SEQ ID NO: 22637 - DNA, 20 bp, human
gaggactcgtggagacatcc

SEQ ID NO: 22638 - DNA, 20 bp, human
gggggaccagacaggactcg

SEQ ID NO: 22639 - DNA, 20 bp, human
gaaactgagacagtagctga

SEQ ID NO: 22640 - DNA, 20 bp, human
gacagtgaagtcatgaagta

SEQ ID NO: 22641 - DNA, 20 bp, human
gcaagtcatcaggtaggtct

SEQ ID NO: 22642 - DNA, 20 bp, human
gtgtctccacgagtcctgtc

SEQ ID NO: 22643 - DNA, 20 bp, human
gagctgaaggcttcagcacc

SEQ ID NO: 22644 - DNA, 20 bp, human
gaacagagtcagtagcaata

SEQ ID NO: 22645 - DNA, 20 bp, human
gcagctggaatcaaagttca

SEQ ID NO: 22646 - DNA, 20 bp, human
gcgcggccgtcaggcagtca

SEQ ID NO: 22647 - DNA, 20 bp, human
gagctggtgccttcccggaa

SEQ ID NO: 22648 - DNA, 20 bp, human
ggtggagtcggacagtgggt

SEQ ID NO: 22649 - DNA, 20 bp, human
ggtgagtggagtcggacagt

SEQ ID NO: 22650 - DNA, 20 bp, human
gctcacaggcccgccctccg

SEQ ID NO: 22651 - DNA, 20 bp, human
gcgggctcggtgagtggagt

SEQ ID NO: 22652 - DNA, 20 bp, human
gtgcgctaaggccccggcgt

SEQ ID NO: 22653 - DNA, 20 bp, human
gagaggaggaaacctaatga

SEQ ID NO: 22654 - DNA, 20 bp, human
ggtccgcggtgctgaaggaa

SEQ ID NO: 22655 - DNA, 20 bp, human
gagggcagatgactctgaga

SEQ ID NO: 22656 - DNA, 20 bp, human
gacgtccagcgaccggaggt

SEQ ID NO: 22657 - DNA, 20 bp, human
ggcaccgcagccatcatgcg

SEQ ID NO: 22658 - DNA, 20 bp, human
gcgggtgagcaagggttccc

SEQ ID NO: 22659 - DNA, 20 bp, human
gccgcagccatcatgcgagg

SEQ ID NO: 22660 - DNA, 20 bp, human
gcgaagacccgggtgagcaa

SEQ ID NO: 22661 - DNA, 20 bp, human
gggattctcacacggttcca

SEQ ID NO: 22662 - DNA, 20 bp, human
gaggcggggggacttacgaa

SEQ ID NO: 22663 - DNA, 20 bp, human
gaaccgtgtgagaatcccta

SEQ ID NO: 22664 - DNA, 20 bp, human
gaggggcgcggggcacgtag

SEQ ID NO: 22665 - DNA, 20 bp, human
gccggcgcctcactcaccaa

SEQ ID NO: 22666 - DNA, 20 bp, human
ggctctgccggcctgagcta

SEQ ID NO: 22667 - DNA, 20 bp, human
ggcctgagctagggtgggta

SEQ ID NO: 22668 - DNA, 20 bp, human
gctgccggcctgagctaggg

SEQ ID NO: 22669 - DNA, 20 bp, human
gcgatgttaacagagcccca

SEQ ID NO: 22670 - DNA, 20 bp, human
ggtagggccgggacccacgg

SEQ ID NO: 22671 - DNA, 20 bp, human
gtgctcctgtgcaagaaggg

SEQ ID NO: 22672 - DNA, 20 bp, human
ggagccagcgctcgcggatg

SEQ ID NO: 22673 - DNA, 20 bp, human
ggccccagggcacgagttaa

SEQ ID NO: 22674 - DNA, 20 bp, human
gtgttaacatcgcctcccaa

SEQ ID NO: 22675 - DNA, 20 bp, human
gccggcagagccagcgctcg

SEQ ID NO: 22676 - DNA, 20 bp, human
ggacttaaaaggacacagta

SEQ ID NO: 22677 - DNA, 20 bp, human
gtcactcagccagctaacag

SEQ ID NO: 22678 - DNA, 20 bp, human
ggtatggcatgggctactcc

SEQ ID NO: 22679 - DNA, 20 bp, human
gaaaggacacagtatggcat

SEQ ID NO: 22680 - DNA, 20 bp, human
gtaatgtccacagcccaccg

SEQ ID NO: 22681 - DNA, 20 bp, human
gtgtgtgtttgtccagtggt

SEQ ID NO: 22682 - DNA, 20 bp, human
gaccataacagaacatcgat

SEQ ID NO: 22683 - DNA, 20 bp, human
gaacagaacatcgataggcc

SEQ ID NO: 22684 - DNA, 20 bp, human
gtcagccagctaacaggggc

SEQ ID NO: 22685 - DNA, 20 bp, human
gggtagtagagtttagaatt

SEQ ID NO: 22686 - DNA, 20 bp, human
gagggctgctgcagagtcca

SEQ ID NO: 22687 - DNA, 20 bp, human
gagccccagggtccccggac

SEQ ID NO: 22688 - DNA, 20 bp, human
gccagctgccacattaccac

SEQ ID NO: 22689 - DNA, 20 bp, human
gctgctgaatctgccccaca

SEQ ID NO: 22690 - DNA, 20 bp, human
gggcagactgaagctggcca

SEQ ID NO: 22691 - DNA, 20 bp, human
gtgctgttcctgtggtaatg

SEQ ID NO: 22692 - DNA, 20 bp, human
gcggagaagagcctgggaca

SEQ ID NO: 22693 - DNA, 20 bp, human
ggacttgggaagcagcaaca

SEQ ID NO: 22694 - DNA, 20 bp, human
gccacctgacccctaggtca

SEQ ID NO: 22695 - DNA, 20 bp, human
gcaggctgctagcactcacc

SEQ ID NO: 22696 - DNA, 20 bp, human
gctgtcccggcctgagacaa

SEQ ID NO: 22697 - DNA, 20 bp, human
gttccacaggaagcacatct

SEQ ID NO: 22698 - DNA, 20 bp, human
gggcagagtgaaggctccca

SEQ ID NO: 22699 - DNA, 20 bp, human
gctagcaccagacagcacac

SEQ ID NO: 22700 - DNA, 20 bp, human
gcctgaagccttggggtcag

SEQ ID NO: 22701 - DNA, 20 bp, human
gggcaggcccgtgtgctgtc

SEQ ID NO: 22702 - DNA, 20 bp, human
gcaggtccagaaagagctgg

SEQ ID NO: 22703 - DNA, 20 bp, human
gttccccagcaggatgtata

SEQ ID NO: 22704 - DNA, 20 bp, human
gggccatatacatcctgctg

SEQ ID NO: 22705 - DNA, 20 bp, human
gcagaccccgtgcgtggtag

SEQ ID NO: 22706 - DNA, 20 bp, human
gcctagaccagtcagggacg

SEQ ID NO: 22707 - DNA, 20 bp, human
gcagccagagcctcttgcgg

SEQ ID NO: 22708 - DNA, 20 bp, human
gtggcaacctagaccagtca

SEQ ID NO: 22709 - DNA, 20 bp, human
ggttcagccagagcctcttg

SEQ ID NO: 22710 - DNA, 20 bp, human
gtcagggacgcggcaggaaa

SEQ ID NO: 22711 - DNA, 20 bp, human
gcaccgtctgaacagactaa

SEQ ID NO: 22712 - DNA, 20 bp, human
gcaagtgctggccacactaa

SEQ ID NO: 22713 - DNA, 20 bp, human
ggaagttcttctctcagcct

SEQ ID NO: 22714 - DNA, 20 bp, human
ggcctggctaggcactctta

SEQ ID NO: 22715 - DNA, 20 bp, human
gatggaagagcctccgcaag

SEQ ID NO: 22716 - DNA, 20 bp, human
gcaggaggccgggaacatgg

SEQ ID NO: 22717 - DNA, 20 bp, human
gcgccagccggaggagctca

SEQ ID NO: 22718 - DNA, 20 bp, human
gatccttgctgggctgtagg

SEQ ID NO: 22719 - DNA, 20 bp, human
ggctcagggccgctcgcagg

SEQ ID NO: 22720 - DNA, 20 bp, human
gctgtagggggcacctcaaa

SEQ ID NO: 22721 - DNA, 20 bp, human
gcgccgtctgccgacaagga

SEQ ID NO: 22722 - DNA, 20 bp, human
gtgagacgcagcccagctcg

SEQ ID NO: 22723 - DNA, 20 bp, human
gtctgccgacaaggacggaa

SEQ ID NO: 22724 - DNA, 20 bp, human
gaatgctctaatggaccagg

SEQ ID NO: 22725 - DNA, 20 bp, human
gggctccattccgtccttgt

SEQ ID NO: 22726 - DNA, 20 bp, human
gctagagagagtataccata

SEQ ID NO: 22727 - DNA, 20 bp, human
gcttcgaaaatacgtagagt

SEQ ID NO: 22728 - DNA, 20 bp, human
gcatgctggctagaatctag

SEQ ID NO: 22729 - DNA, 20 bp, human
gaatacgtagagtaggatac

SEQ ID NO: 22730 - DNA, 20 bp, human
gtgagtttgcacagcaagag

SEQ ID NO: 22731 - DNA, 20 bp, human
gctgaggatgtgtaccaaga

SEQ ID NO: 22732 - DNA, 20 bp, human
gggctagaatctagtggaca

SEQ ID NO: 22733 - DNA, 20 bp, human
gcgaagcagtcatcgccata

SEQ ID NO: 22734 - DNA, 20 bp, human
ggtgttcaataagttctgga

SEQ ID NO: 22735 - DNA, 20 bp, human
ggtacacatcctcagaatgc

SEQ ID NO: 22736 - DNA, 20 bp, human
gcagtactcacctgggacaa

SEQ ID NO: 22737 - DNA, 20 bp, human
gtctacttgtagaaaggtga

SEQ ID NO: 22738 - DNA, 20 bp, human
gagtactgcctggctgccac

SEQ ID NO: 22739 - DNA, 20 bp, human
gtgaaactatagcggctatg

SEQ ID NO: 22740 - DNA, 20 bp, human
gtaccaaactgtggccaaag

SEQ ID NO: 22741 - DNA, 20 bp, human
gggaaccccatgagcctacc

SEQ ID NO: 22742 - DNA, 20 bp, human
ggccacagtaacagaactcc

SEQ ID NO: 22743 - DNA, 20 bp, human
gaaaatcaccagtggcagcc

SEQ ID NO: 22744 - DNA, 20 bp, human
gaggatgtcatcttgtagct

SEQ ID NO: 22745 - DNA, 20 bp, human
gtgcagcttacataccactt

SEQ ID NO: 22746 - DNA, 20 bp, human
gctggtcttaggcttagaag

SEQ ID NO: 22747 - DNA, 20 bp, human
gcgaggctagaggcagatag

SEQ ID NO: 22748 - DNA, 20 bp, human
ggagccagtgaagtcaggga

SEQ ID NO: 22749 - DNA, 20 bp, human
ggaagagagccagtgaagtc

SEQ ID NO: 22750 - DNA, 20 bp, human
ggagagtgacacctggtctt

SEQ ID NO: 22751 - DNA, 20 bp, human
ggagctgctgacgaagtgtg

SEQ ID NO: 22752 - DNA, 20 bp, human
gggctggggcagaaagatcg

SEQ ID NO: 22753 - DNA, 20 bp, human
gggcagaaagatcgaggctg

SEQ ID NO: 22754 - DNA, 20 bp, human
ggtgcgggaggcgaggctag

SEQ ID NO: 22755 - DNA, 20 bp, human
gatggtcccagacactaagg

SEQ ID NO: 22756 - DNA, 20 bp, human
gcatgctggctagaatctag

SEQ ID NO: 22757 - DNA, 20 bp, human
ggaatctagtggacaaggta

SEQ ID NO: 22758 - DNA, 20 bp, human
ggtagagatatggggatcat

SEQ ID NO: 22759 - DNA, 20 bp, human
gggctagaatctagtggaca

SEQ ID NO: 22760 - DNA, 20 bp, human
gtttgtgcactggagctggt

SEQ ID NO: 22761 - DNA, 20 bp, human
ggagctggtgggtagagata

SEQ ID NO: 22762 - DNA, 20 bp, human
gctgaggatgtgtaccaaga

SEQ ID NO: 22763 - DNA, 20 bp, human
ggtacacatcctcagaatgc

SEQ ID NO: 22764 - DNA, 20 bp, human
gaggcctgatttccggagtg

SEQ ID NO: 22765 - DNA, 20 bp, human
gtgcttgctgtgagtctttg

SEQ ID NO: 22766 - DNA, 20 bp, human
gtaagctgccatgatggatg

SEQ ID NO: 22767 - DNA, 20 bp, human
gtagcagtgcgggatcttcc

SEQ ID NO: 22768 - DNA, 20 bp, human
gtcccctgccccatccatca

SEQ ID NO: 22769 - DNA, 20 bp, human
gagacgattttgctcagagg

SEQ ID NO: 22770 - DNA, 20 bp, human
gtactgtgggtagtgaacct

SEQ ID NO: 22771 - DNA, 20 bp, human
gtgatgcccaggcaaggccg

SEQ ID NO: 22772 - DNA, 20 bp, human
gtgtgggtagtgaacctagg

SEQ ID NO: 22773 - DNA, 20 bp, human
ggggcaaaaggccacaggat

SEQ ID NO: 22774 - DNA, 20 bp, human
gggccgaggcagtctgcaga

SEQ ID NO: 22775 - DNA, 20 bp, human
gagcctagctgccgcaagag

SEQ ID NO: 22776 - DNA, 20 bp, human
ggactgggggggaaagacaa

SEQ ID NO: 22777 - DNA, 20 bp, human
gctcaggaccgccaaggtaa

SEQ ID NO: 22778 - DNA, 20 bp, human
gcgacggagaacaacaagaa

SEQ ID NO: 22779 - DNA, 20 bp, human
ggcgggcccagtgggccgta

SEQ ID NO: 22780 - DNA, 20 bp, human
gtccatccccgggactgggg

SEQ ID NO: 22781 - DNA, 20 bp, human
gtcccggggatggagatgtc

SEQ ID NO: 22782 - DNA, 20 bp, human
ggaacatagactatccgcaa

SEQ ID NO: 22783 - DNA, 20 bp, human
gggcagcgcttgttgattca

SEQ ID NO: 22784 - DNA, 20 bp, human
gaggaccgccaaggtaaggg

SEQ ID NO: 22785 - DNA, 20 bp, human
gtgtcgcccctacggcccac

SEQ ID NO: 22786 - DNA, 20 bp, human
gggagctctcggtgctcgag

SEQ ID NO: 22787 - DNA, 20 bp, human
ggctcgtctactggctgtga

SEQ ID NO: 22788 - DNA, 20 bp, human
gttgggccaggtccatgtgc

SEQ ID NO: 22789 - DNA, 20 bp, human
gccggcagggaaagtctgag

SEQ ID NO: 22790 - DNA, 20 bp, human
gccctgccggcacatggacc

SEQ ID NO: 22791 - DNA, 20 bp, human
gagagctccagctcgtctac

SEQ ID NO: 22792 - DNA, 20 bp, human
gtctactggctgtgagggtt

SEQ ID NO: 22793 - DNA, 20 bp, human
gggcgctttaggaatcctag

SEQ ID NO: 22794 - DNA, 20 bp, human
gccggcggcgggacagtagt

SEQ ID NO: 22795 - DNA, 20 bp, human
ggaatcctagtggtgaggtg

SEQ ID NO: 22796 - DNA, 20 bp, human
gcggcgcctccgagagatca

SEQ ID NO: 22797 - DNA, 20 bp, human
gccggctgctggccaacgca

SEQ ID NO: 22798 - DNA, 20 bp, human
gttcttccctgatctctcgg

SEQ ID NO: 22799 - DNA, 20 bp, human
gctcaccaagcgctctacaa

SEQ ID NO: 22800 - DNA, 20 bp, human
gcccaacctcaggcaatgag

SEQ ID NO: 22801 - DNA, 20 bp, human
gcctccgcgactgccaggga

SEQ ID NO: 22802 - DNA, 20 bp, human
gctgaggttgggcccgaaca

SEQ ID NO: 22803 - DNA, 20 bp, human
gttgaggccagcaggactcc

SEQ ID NO: 22804 - DNA, 20 bp, human
ggtagagcgcttggtgagat

SEQ ID NO: 22805 - DNA, 20 bp, human
gtcatgagcgagattcacag

SEQ ID NO: 22806 - DNA, 20 bp, human
ggagggatgattctgcgagg

SEQ ID NO: 22807 - DNA, 20 bp, human
gctgggccgcttggaatctg

SEQ ID NO: 22808 - DNA, 20 bp, human
gccggggacagtaacgccta

SEQ ID NO: 22809 - DNA, 20 bp, human
gttactgtccccggtccagg

SEQ ID NO: 22810 - DNA, 20 bp, human
gcctgccgccacctggaccg

SEQ ID NO: 22811 - DNA, 20 bp, human
gtggagagagctgtctcata

SEQ ID NO: 22812 - DNA, 20 bp, human
gcgctgcagctgcgaggtgt

SEQ ID NO: 22813 - DNA, 20 bp, human
ggagagctgtctcatagggt

SEQ ID NO: 22814 - DNA, 20 bp, human
ggaggggagatgccaggagt

SEQ ID NO: 22815 - DNA, 20 bp, human
gcccaggagcgcagtccacc

SEQ ID NO: 22816 - DNA, 20 bp, human
gccgcccgcccgcaacggga

SEQ ID NO: 22817 - DNA, 20 bp, human
gagctaccggcaggaacccc

SEQ ID NO: 22818 - DNA, 20 bp, human
ggacgtgcgttgctgcttgt

SEQ ID NO: 22819 - DNA, 20 bp, human
gagccagcgcgcacaagcaa

SEQ ID NO: 22820 - DNA, 20 bp, human
ggcgcacaagcaagggtgtg

SEQ ID NO: 22821 - DNA, 20 bp, human
gccaagacccggagagctac

SEQ ID NO: 22822 - DNA, 20 bp, human
gaaggagggactcacggaag

SEQ ID NO: 22823 - DNA, 20 bp, human
ggagggcgagggcacccccg

SEQ ID NO: 22824 - DNA, 20 bp, human
gaggaaccccgggcgagaga

SEQ ID NO: 22825 - DNA, 20 bp, human
ggacccggagagctaccggc

SEQ ID NO: 22826 - DNA, 20 bp, human
gggagtgcacaggccagcag

SEQ ID NO: 22827 - DNA, 20 bp, human
ggcgggtgaggacaaggacg

SEQ ID NO: 22828 - DNA, 20 bp, human
gtgccgactcgccaaagggg

SEQ ID NO: 22829 - DNA, 20 bp, human
gtgcgctgcgggtgaggaca

SEQ ID NO: 22830 - DNA, 20 bp, human
gcctaccggcaccccccctt

SEQ ID NO: 22831 - DNA, 20 bp, human
gccttcaaaggcccggtcaa

SEQ ID NO: 22832 - DNA, 20 bp, human
ggtgacgccgacccatccaa

SEQ ID NO: 22833 - DNA, 20 bp, human
ggaataactaactccttcaa

SEQ ID NO: 22834 - DNA, 20 bp, human
gagcaggacccacaaccctc

SEQ ID NO: 22835 - DNA, 20 bp, human
gcaccccccctttggcgagt

SEQ ID NO: 22836 - DNA, 20 bp, human
gttgtctgtggctccgcgac

SEQ ID NO: 22837 - DNA, 20 bp, human
gccgctggcctaggaaaagc

SEQ ID NO: 22838 - DNA, 20 bp, human
ggccagcgggcggttgtctg

SEQ ID NO: 22839 - DNA, 20 bp, human
ggggagatggagctgaccag

SEQ ID NO: 22840 - DNA, 20 bp, human
gtcgtgcttggcccagactt

SEQ ID NO: 22841 - DNA, 20 bp, human
gactgggcgccccgtcacgt

SEQ ID NO: 22842 - DNA, 20 bp, human
gagaggagaaaggtatagac

SEQ ID NO: 22843 - DNA, 20 bp, human
gagtaccaggtaacccgaaa

SEQ ID NO: 22844 - DNA, 20 bp, human
ggcgagtggcgtgaccctga

SEQ ID NO: 22845 - DNA, 20 bp, human
ggccacagacaaccgcccgc

SEQ ID NO: 22846 - DNA, 20 bp, human
gggagaagcgacgtctgggt

SEQ ID NO: 22847 - DNA, 20 bp, human
ggagtcacgccagcacgcgg

SEQ ID NO: 22848 - DNA, 20 bp, human
gcccgggagaagcgacgtct

SEQ ID NO: 22849 - DNA, 20 bp, human
gcgggagtcacgccagcacg

SEQ ID NO: 22850 - DNA, 20 bp, human
gctccgcgcggagccgacac

SEQ ID NO: 22851 - DNA, 20 bp, human
ggacgagatgaaatcccgtg

SEQ ID NO: 22852 - DNA, 20 bp, human
ggaggctgccagcccggacc

SEQ ID NO: 22853 - DNA, 20 bp, human
gggtcgctgccggaactctg

SEQ ID NO: 22854 - DNA, 20 bp, human
ggctgcgaccgggtccgggc

SEQ ID NO: 22855 - DNA, 20 bp, human
gggcgtcccccggaccgcgg

SEQ ID NO: 22856 - DNA, 20 bp, human
gcgagtaccggcagatttca

SEQ ID NO: 22857 - DNA, 20 bp, human
gcgtgagcctggctgtcggc

SEQ ID NO: 22858 - DNA, 20 bp, human
gccccgcccagcgagcctca

SEQ ID NO: 22859 - DNA, 20 bp, human
gcagcccgcagagcgagtac

SEQ ID NO: 22860 - DNA, 20 bp, human
gctctggaaatagtcgtcag

SEQ ID NO: 22861 - DNA, 20 bp, human
ggcccctgaggctcgctggg

SEQ ID NO: 22862 - DNA, 20 bp, human
gagagcgcgagggacaggcc

SEQ ID NO: 22863 - DNA, 20 bp, human
gtcgcgctctcagagtgact

SEQ ID NO: 22864 - DNA, 20 bp, human
ggcagcaaacggcagagcaa

SEQ ID NO: 22865 - DNA, 20 bp, human
gggcgctccaagcctcctcg

SEQ ID NO: 22866 - DNA, 20 bp, human
gaggagcagaaaagttactg

SEQ ID NO: 22867 - DNA, 20 bp, human
gcaataagcagagaatgtct

SEQ ID NO: 22868 - DNA, 20 bp, human
gtctgcttattgagccccat

SEQ ID NO: 22869 - DNA, 20 bp, human
gactaaatacatcaaaaggt

SEQ ID NO: 22870 - DNA, 20 bp, human
gtttagtttagcaagtatca

SEQ ID NO: 22871 - DNA, 20 bp, human
gagatatgaagttgcctatg

SEQ ID NO: 22872 - DNA, 20 bp, human
gacagtcctttctaaacccg

SEQ ID NO: 22873 - DNA, 20 bp, human
ggatggcaactgaacatcca

SEQ ID NO: 22874 - DNA, 20 bp, human
gttttgcctcgggtttagaa

SEQ ID NO: 22875 - DNA, 20 bp, human
gcagagaatgtctaggctga

SEQ ID NO: 22876 - DNA, 20 bp, human
gtgtccaggaaggcgtgcag

SEQ ID NO: 22877 - DNA, 20 bp, human
gacgccttcctggacaacgt

SEQ ID NO: 22878 - DNA, 20 bp, human
gagccgcatggactcctcgt

SEQ ID NO: 22879 - DNA, 20 bp, human
gcacctacgaggagtccatg

SEQ ID NO: 22880 - DNA, 20 bp, human
gcagctgcccagctacgagg

SEQ ID NO: 22881 - DNA, 20 bp, human
gtggcagcacgacctccccg

SEQ ID NO: 22882 - DNA, 20 bp, human
gtgcgacgcgaccaacgcca

SEQ ID NO: 22883 - DNA, 20 bp, human
ggacgcgaccaacgccacgg

SEQ ID NO: 22884 - DNA, 20 bp, human
ggctctgctgcgcgacgagg

SEQ ID NO: 22885 - DNA, 20 bp, human
gcagcccacgttgtccagga

SEQ ID NO: 22886 - DNA, 20 bp, human
gcctcccctagcattccagg

SEQ ID NO: 22887 - DNA, 20 bp, human
gtcgcctcctggaatgctag

SEQ ID NO: 22888 - DNA, 20 bp, human
gaaagctatgcactgcgcag

SEQ ID NO: 22889 - DNA, 20 bp, human
gggcagagagggcagcactg

SEQ ID NO: 22890 - DNA, 20 bp, human
gtcctgagatgcagtcctac

SEQ ID NO: 22891 - DNA, 20 bp, human
ggccagtaggactgcatctc

SEQ ID NO: 22892 - DNA, 20 bp, human
gctatgcactgcgcagaggc

SEQ ID NO: 22893 - DNA, 20 bp, human
gcaggtgtataatgaggaaa

SEQ ID NO: 22894 - DNA, 20 bp, human
gtaagaaatgtcccctgagt

SEQ ID NO: 22895 - DNA, 20 bp, human
gattcgccaggtgtataatg

SEQ ID NO: 22896 - DNA, 20 bp, human
gcacgcctggaagacaataa

SEQ ID NO: 22897 - DNA, 20 bp, human
gggtacaaccagagggccag

SEQ ID NO: 22898 - DNA, 20 bp, human
gatcttgaggtcacccctgg

SEQ ID NO: 22899 - DNA, 20 bp, human
ggcaaagtgttaggaagact

SEQ ID NO: 22900 - DNA, 20 bp, human
gataccctccaaaagacaag

SEQ ID NO: 22901 - DNA, 20 bp, human
gaccatcttgaggtcacccc

SEQ ID NO: 22902 - DNA, 20 bp, human
gtttcctcttgtcttttgga

SEQ ID NO: 22903 - DNA, 20 bp, human
gagtgctttagtaggctcct

SEQ ID NO: 22904 - DNA, 20 bp, human
gtcagggtcctattccaggt

SEQ ID NO: 22905 - DNA, 20 bp, human
gtaactaggaataaatgggg

SEQ ID NO: 22906 - DNA, 20 bp, human
gtggctggaggatccaagag

SEQ ID NO: 22907 - DNA, 20 bp, human
gcccagagcagcctcatggc

SEQ ID NO: 22908 - DNA, 20 bp, human
gctggccaagctaggcctcg

SEQ ID NO: 22909 - DNA, 20 bp, human
gcccgaggacaggtagtgaa

SEQ ID NO: 22910 - DNA, 20 bp, human
gcaggatgtgccccgaggac

SEQ ID NO: 22911 - DNA, 20 bp, human
gctgctctgggggctgatct

SEQ ID NO: 22912 - DNA, 20 bp, human
gggacccgattcaggagtga

SEQ ID NO: 22913 - DNA, 20 bp, human
gagagaacaagagcaacctg

SEQ ID NO: 22914 - DNA, 20 bp, human
gctcggggcagagttgactc

SEQ ID NO: 22915 - DNA, 20 bp, human
gaatgtcccctgctccccaa

SEQ ID NO: 22916 - DNA, 20 bp, human
gtggctggaggatccaagag

SEQ ID NO: 22917 - DNA, 20 bp, human
gcccagagcagcctcatggc

SEQ ID NO: 22918 - DNA, 20 bp, human
gctggccaagctaggcctcg

SEQ ID NO: 22919 - DNA, 20 bp, human
gcccgaggacaggtagtgaa

SEQ ID NO: 22920 - DNA, 20 bp, human
gcaggatgtgccccgaggac

SEQ ID NO: 22921 - DNA, 20 bp, human
gagagaacaagagcaacctg

SEQ ID NO: 22922 - DNA, 20 bp, human
gaatgtcccctgctccccaa

SEQ ID NO: 22923 - DNA, 20 bp, human
gggacccgattcaggagtga

SEQ ID NO: 22924 - DNA, 20 bp, human
gctgctctgggggctgatct

SEQ ID NO: 22925 - DNA, 20 bp, human
gtcaggagtgagggagagca

SEQ ID NO: 22926 - DNA, 20 bp, human
gaccaggactacatagatca

SEQ ID NO: 22927 - DNA, 20 bp, human
gtatgataaactctgatctg

SEQ ID NO: 22928 - DNA, 20 bp, human
gcaactctgatgtgggaagg

SEQ ID NO: 22929 - DNA, 20 bp, human
gcttgcctcaactctgatgt

SEQ ID NO: 22930 - DNA, 20 bp, human
ggccttgatctatgtagtcc

SEQ ID NO: 22931 - DNA, 20 bp, human
gcaattaccagtcaacttca

SEQ ID NO: 22932 - DNA, 20 bp, human
gagactctatgatgatatct

SEQ ID NO: 22933 - DNA, 20 bp, human
gctcaactaccaaaggtcgg

SEQ ID NO: 22934 - DNA, 20 bp, human
gaaaacttgaggttcagata

SEQ ID NO: 22935 - DNA, 20 bp, human
gttggggaagcttggaggaa

SEQ ID NO: 22936 - DNA, 20 bp, human
gctgtaaggaagctggtata

SEQ ID NO: 22937 - DNA, 20 bp, human
gtgctgggaagccctaactc

SEQ ID NO: 22938 - DNA, 20 bp, human
ggaagttggactgtaaacat

SEQ ID NO: 22939 - DNA, 20 bp, human
gactttggagctctcagctt

SEQ ID NO: 22940 - DNA, 20 bp, human
gagaacagctgtaaggaagc

SEQ ID NO: 22941 - DNA, 20 bp, human
gggatggtaaaagagttgcc

SEQ ID NO: 22942 - DNA, 20 bp, human
gtggccagagttacagaagt

SEQ ID NO: 22943 - DNA, 20 bp, human
gcactgaagacgaaagctca

SEQ ID NO: 22944 - DNA, 20 bp, human
gtctctgtccctccagagtt

SEQ ID NO: 22945 - DNA, 20 bp, human
gctgaataccagatatccta

SEQ ID NO: 22946 - DNA, 20 bp, human
gtggctggaggatccaagag

SEQ ID NO: 22947 - DNA, 20 bp, human
gcccagagcagcctcatggc

SEQ ID NO: 22948 - DNA, 20 bp, human
gctgctctgggggctgatct

SEQ ID NO: 22949 - DNA, 20 bp, human
ggcccccacaagcagcagga

SEQ ID NO: 22950 - DNA, 20 bp, human
gacaagcagcaggagggcat

SEQ ID NO: 22951 - DNA, 20 bp, human
gagagaacaagagcaacctg

SEQ ID NO: 22952 - DNA, 20 bp, human
gctgggcttctgcagagata

SEQ ID NO: 22953 - DNA, 20 bp, human
gcttggatcctccagccatg

SEQ ID NO: 22954 - DNA, 20 bp, human
gcccgaggacaggtagtgaa

SEQ ID NO: 22955 - DNA, 20 bp, human
gctggccaagctaggcctcg

SEQ ID NO: 22956 - DNA, 20 bp, human
gtggctggaggatccaagag

SEQ ID NO: 22957 - DNA, 20 bp, human
gcccagagcagcctcatggc

SEQ ID NO: 22958 - DNA, 20 bp, human
ggcccccacaagcagcagga

SEQ ID NO: 22959 - DNA, 20 bp, human
gctgctctgggggctgatct

SEQ ID NO: 22960 - DNA, 20 bp, human
gctgggcttctgcagagata

SEQ ID NO: 22961 - DNA, 20 bp, human
gacaagcagcaggagggcat

SEQ ID NO: 22962 - DNA, 20 bp, human
gagagaacaagagcaacctg

SEQ ID NO: 22963 - DNA, 20 bp, human
gcttggatcctccagccatg

SEQ ID NO: 22964 - DNA, 20 bp, human
gcccgaggacaggtagtgaa

SEQ ID NO: 22965 - DNA, 20 bp, human
gcatcccgcctccaggacct

SEQ ID NO: 22966 - DNA, 20 bp, human
gaacaaccagggagccacac

SEQ ID NO: 22967 - DNA, 20 bp, human
gttactccaaggagcctgtg

SEQ ID NO: 22968 - DNA, 20 bp, human
gttctcacactcttactcca

SEQ ID NO: 22969 - DNA, 20 bp, human
ggagtaagagtgtgagaaac

SEQ ID NO: 22970 - DNA, 20 bp, human
gtaacatatcttaacaacca

SEQ ID NO: 22971 - DNA, 20 bp, human
gacatattatgaggctggga

SEQ ID NO: 22972 - DNA, 20 bp, human
gaatctaagagaattgatgt

SEQ ID NO: 22973 - DNA, 20 bp, human
gtcagtctagacatattatg

SEQ ID NO: 22974 - DNA, 20 bp, human
gatcaattctcttagattaa

SEQ ID NO: 22975 - DNA, 20 bp, human
ggcttaagtgcagagattta

SEQ ID NO: 22976 - DNA, 20 bp, human
gccgcgccgggagacgctag

SEQ ID NO: 22977 - DNA, 20 bp, human
gcctacctggggccagacgg

SEQ ID NO: 22978 - DNA, 20 bp, human
gggaggagggcacagatcta

SEQ ID NO: 22979 - DNA, 20 bp, human
gcggcgcggctgcccgaggc

SEQ ID NO: 22980 - DNA, 20 bp, human
gcggagccgctagcgtctcc

SEQ ID NO: 22981 - DNA, 20 bp, human
ggagcccgccgagctcgcag

SEQ ID NO: 22982 - DNA, 20 bp, human
gcccgaggccggcgaagcca

SEQ ID NO: 22983 - DNA, 20 bp, human
gaggcgactcggagagaagt

SEQ ID NO: 22984 - DNA, 20 bp, human
ggttgaaagttcattagtta

SEQ ID NO: 22985 - DNA, 20 bp, human
gcggccgctgcgagctcggc

SEQ ID NO: 22986 - DNA, 20 bp, human
gcctgggaaaaacggtgaag

SEQ ID NO: 22987 - DNA, 20 bp, human
gcgcgggagaaattcgaaag

SEQ ID NO: 22988 - DNA, 20 bp, human
ggtgtttctcgggatttcct

SEQ ID NO: 22989 - DNA, 20 bp, human
gttgtgcaatttgacaggtg

SEQ ID NO: 22990 - DNA, 20 bp, human
ggtgaggtgaagtgtttctc

SEQ ID NO: 22991 - DNA, 20 bp, human
gggattttgtgcaatttgac

SEQ ID NO: 22992 - DNA, 20 bp, human
gtcggactgcttgtagtaag

SEQ ID NO: 22993 - DNA, 20 bp, human
gaagcaaggcctgggaaaaa

SEQ ID NO: 22994 - DNA, 20 bp, human
gtgttatccgaactatttag

SEQ ID NO: 22995 - DNA, 20 bp, human
gttgctttgcaatttcgagt

SEQ ID NO: 22996 - DNA, 20 bp, human
gcgcaatggatcaggaagag

SEQ ID NO: 22997 - DNA, 20 bp, human
ggccgaagcgtccctagcaa

SEQ ID NO: 22998 - DNA, 20 bp, human
gtcggccgaggataccgcaa

SEQ ID NO: 22999 - DNA, 20 bp, human
ggagtccaggaaatcttcat

SEQ ID NO: 23000 - DNA, 20 bp, human
gaggtctgctgagaagtctc

SEQ ID NO: 23001 - DNA, 20 bp, human
gcgcgggcacactcacactg

SEQ ID NO: 23002 - DNA, 20 bp, human
ggaactcgaggagggaccga

SEQ ID NO: 23003 - DNA, 20 bp, human
ggaggataccgcaatggatc

SEQ ID NO: 23004 - DNA, 20 bp, human
gcccacgaagcgggaactcg

SEQ ID NO: 23005 - DNA, 20 bp, human
gcgaagcgggaactcgagga

SEQ ID NO: 23006 - DNA, 20 bp, human
gcagcataccagtaaccagt

SEQ ID NO: 23007 - DNA, 20 bp, human
ggactgctcagtagaagcca

SEQ ID NO: 23008 - DNA, 20 bp, human
gtggttactggtatgctggt

SEQ ID NO: 23009 - DNA, 20 bp, human
gcagacactgcttctcctac

SEQ ID NO: 23010 - DNA, 20 bp, human
gtgcttctcctactggttac

SEQ ID NO: 23011 - DNA, 20 bp, human
gttactggtatgctggttgg

SEQ ID NO: 23012 - DNA, 20 bp, human
gacagtgctgtaattcaaag

SEQ ID NO: 23013 - DNA, 20 bp, human
gcagagctattgctgagacg

SEQ ID NO: 23014 - DNA, 20 bp, human
ggtacaaatactagttatta

SEQ ID NO: 23015 - DNA, 20 bp, human
gttatgggaacgtataatca

SEQ ID NO: 23016 - DNA, 20 bp, human
ggcgctttgggtgacagcca

SEQ ID NO: 23017 - DNA, 20 bp, human
gcgagggctcaacaagcagc

SEQ ID NO: 23018 - DNA, 20 bp, human
gttgagccctcggcctgggg

SEQ ID NO: 23019 - DNA, 20 bp, human
gtcgcccagccagattgatt

SEQ ID NO: 23020 - DNA, 20 bp, human
gagcagaattccccgatccg

SEQ ID NO: 23021 - DNA, 20 bp, human
gcctgcagagcgcgaaacag

SEQ ID NO: 23022 - DNA, 20 bp, human
ggcctttccggcagtacctg

SEQ ID NO: 23023 - DNA, 20 bp, human
gtgaacccggaagcggttgg

SEQ ID NO: 23024 - DNA, 20 bp, human
gagcgcgaaacagcggccct

SEQ ID NO: 23025 - DNA, 20 bp, human
gggctgggcgaatgaaccat

SEQ ID NO: 23026 - DNA, 20 bp, human
gcagctccggtaacctttcc

SEQ ID NO: 23027 - DNA, 20 bp, human
gtggaagcctgcgatcgagc

SEQ ID NO: 23028 - DNA, 20 bp, human
gaccgaaatgctagatacag

SEQ ID NO: 23029 - DNA, 20 bp, human
gctgacaagccctccaggta

SEQ ID NO: 23030 - DNA, 20 bp, human
gcagcggaaggagaaacgga

SEQ ID NO: 23031 - DNA, 20 bp, human
gcccccgtgaaaggtagagg

SEQ ID NO: 23032 - DNA, 20 bp, human
gcggagggctgagataatgg

SEQ ID NO: 23033 - DNA, 20 bp, human
ggatacagcggaaggagaaa

SEQ ID NO: 23034 - DNA, 20 bp, human
gcaaaggcgccttacctgga

SEQ ID NO: 23035 - DNA, 20 bp, human
gggttaccggagctgcgatt

SEQ ID NO: 23036 - DNA, 20 bp, human
gcgccgcaccggaaactgag

SEQ ID NO: 23037 - DNA, 20 bp, human
ggtgagtggcgcagtcgggt

SEQ ID NO: 23038 - DNA, 20 bp, human
gtgcggcgaacaccaaagtc

SEQ ID NO: 23039 - DNA, 20 bp, human
gagctgcaggagcgagatgg

SEQ ID NO: 23040 - DNA, 20 bp, human
gcctgcgcgctgggaagagt

SEQ ID NO: 23041 - DNA, 20 bp, human
gagccagaggtccaaccagt

SEQ ID NO: 23042 - DNA, 20 bp, human
gctccgctcagtttccggtg

SEQ ID NO: 23043 - DNA, 20 bp, human
gcgaagctgcaggagcgaga

SEQ ID NO: 23044 - DNA, 20 bp, human
gacttctttggagactccca

SEQ ID NO: 23045 - DNA, 20 bp, human
gtcgagatggtctccgggag

SEQ ID NO: 23046 - DNA, 20 bp, human
ggcgggtgcggcggatccca

SEQ ID NO: 23047 - DNA, 20 bp, human
gtcccagggcagccttcggg

SEQ ID NO: 23048 - DNA, 20 bp, human
gctgtcagcggcgggtgcgg

SEQ ID NO: 23049 - DNA, 20 bp, human
ggaccacgccgcgacgcacc

SEQ ID NO: 23050 - DNA, 20 bp, human
ggtcgccgggagcggttaga

SEQ ID NO: 23051 - DNA, 20 bp, human
gggcgagccagtgacaggag

SEQ ID NO: 23052 - DNA, 20 bp, human
ggggagccagtgcccacgcg

SEQ ID NO: 23053 - DNA, 20 bp, human
gccggcggggcgcgctccgg

SEQ ID NO: 23054 - DNA, 20 bp, human
gggcgctgcctggtgcgtcg

SEQ ID NO: 23055 - DNA, 20 bp, human
ggtcctccggcggctgtccg

SEQ ID NO: 23056 - DNA, 20 bp, human
ggcgcggcggccaaactggt

SEQ ID NO: 23057 - DNA, 20 bp, human
ggtgagaacctggatgacag

SEQ ID NO: 23058 - DNA, 20 bp, human
ggaggttgggcctcactacc

SEQ ID NO: 23059 - DNA, 20 bp, human
gctggtgggacagtgtctcc

SEQ ID NO: 23060 - DNA, 20 bp, human
gcttggcgcggcggccaaac

SEQ ID NO: 23061 - DNA, 20 bp, human
gagacactgtcccaccagtt

SEQ ID NO: 23062 - DNA, 20 bp, human
gctagggatagaagccagac

SEQ ID NO: 23063 - DNA, 20 bp, human
gaaacctagaactcctccag

SEQ ID NO: 23064 - DNA, 20 bp, human
gccagaggtacagccttggt

SEQ ID NO: 23065 - DNA, 20 bp, human
gtggctggctgtcaagcaat

SEQ ID NO: 23066 - DNA, 20 bp, human
ggaacgtgtaggcagctggg

SEQ ID NO: 23067 - DNA, 20 bp, human
gcccctcccccagaacgtgt

SEQ ID NO: 23068 - DNA, 20 bp, human
gaggaagtcagcctgaaagg

SEQ ID NO: 23069 - DNA, 20 bp, human
ggagaaaggagaccgaacac

SEQ ID NO: 23070 - DNA, 20 bp, human
gtcagggaaacggagaaatg

SEQ ID NO: 23071 - DNA, 20 bp, human
gactggagcattaagaaccc

SEQ ID NO: 23072 - DNA, 20 bp, human
gaggccccgcccatttatca

SEQ ID NO: 23073 - DNA, 20 bp, human
gacctggaaagacctctaaa

SEQ ID NO: 23074 - DNA, 20 bp, human
gtcttttcagccgaggtcac

SEQ ID NO: 23075 - DNA, 20 bp, human
gcgaagcttttctcaaacac

SEQ ID NO: 23076 - DNA, 20 bp, human
gtacggcgagattaagctca

SEQ ID NO: 23077 - DNA, 20 bp, human
gattataggaggttgcaaaa

SEQ ID NO: 23078 - DNA, 20 bp, human
gtctgtttcaatattatagg

SEQ ID NO: 23079 - DNA, 20 bp, human
gaatgtcacaggctactaag

SEQ ID NO: 23080 - DNA, 20 bp, human
gtcctgctgtaaacatacca

SEQ ID NO: 23081 - DNA, 20 bp, human
ggaatctgtttcaatattat

SEQ ID NO: 23082 - DNA, 20 bp, human
gacataccaaggaaagcaac

SEQ ID NO: 23083 - DNA, 20 bp, human
gagataataactaacatctg

SEQ ID NO: 23084 - DNA, 20 bp, human
ggacagcctgttgctttcct

SEQ ID NO: 23085 - DNA, 20 bp, human
gaggctagattcaggagacc

SEQ ID NO: 23086 - DNA, 20 bp, human
gtatgcagatcatcccggga

SEQ ID NO: 23087 - DNA, 20 bp, human
gctcgctgagagcaggaggg

SEQ ID NO: 23088 - DNA, 20 bp, human
ggcaggagggaggcgtgtgt

SEQ ID NO: 23089 - DNA, 20 bp, human
gggcacagggaagggtcccg

SEQ ID NO: 23090 - DNA, 20 bp, human
gctaacagagactggttcaa

SEQ ID NO: 23091 - DNA, 20 bp, human
gcggagccagcgaatgagag

SEQ ID NO: 23092 - DNA, 20 bp, human
gggctccaactcctccccgg

SEQ ID NO: 23093 - DNA, 20 bp, human
gtggtccgtagcctccgggg

SEQ ID NO: 23094 - DNA, 20 bp, human
ggccgcgtctcgctgagagc

SEQ ID NO: 23095 - DNA, 20 bp, human
gaggcacttggctttggagg

SEQ ID NO: 23096 - DNA, 20 bp, human
gcataaatgtaggaggctgg

SEQ ID NO: 23097 - DNA, 20 bp, human
gagagaaacgaaagaataca

SEQ ID NO: 23098 - DNA, 20 bp, human
ggaggtaagttcataaatgt

SEQ ID NO: 23099 - DNA, 20 bp, human
gctgttaagataatctacgt

SEQ ID NO: 23100 - DNA, 20 bp, human
ggtaagttcataaatgtagg

SEQ ID NO: 23101 - DNA, 20 bp, human
gagacccttaacagaatagt

SEQ ID NO: 23102 - DNA, 20 bp, human
ggttcataaatgtaggaggc

SEQ ID NO: 23103 - DNA, 20 bp, human
gagggccaactattctgtta

SEQ ID NO: 23104 - DNA, 20 bp, human
gtgcaaggaaggtaagtaaa

SEQ ID NO: 23105 - DNA, 20 bp, human
gagcagcagagagacataga

SEQ ID NO: 23106 - DNA, 20 bp, human
gctggtgcaggtcacaagca

SEQ ID NO: 23107 - DNA, 20 bp, human
gagccaacatctactactgt

SEQ ID NO: 23108 - DNA, 20 bp, human
gacggttaagactttagcca

SEQ ID NO: 23109 - DNA, 20 bp, human
gcagagtctttcgttctttc

SEQ ID NO: 23110 - DNA, 20 bp, human
gagaagaaaatccagtagca

SEQ ID NO: 23111 - DNA, 20 bp, human
gaaagtcttaaccgtgctac

SEQ ID NO: 23112 - DNA, 20 bp, human
gctaatgactctttatgaca

SEQ ID NO: 23113 - DNA, 20 bp, human
gagtagtagatgttggcttt

SEQ ID NO: 23114 - DNA, 20 bp, human
gttcccacagtagtagatgt

SEQ ID NO: 23115 - DNA, 20 bp, human
gtggtatgatacagatgcca

SEQ ID NO: 23116 - DNA, 20 bp, human
ggcgcctctgggaagaccgg

SEQ ID NO: 23117 - DNA, 20 bp, human
gtgagacccacgaggagact

SEQ ID NO: 23118 - DNA, 20 bp, human
gccgccgccggtcttcccag

SEQ ID NO: 23119 - DNA, 20 bp, human
gcgagtggttaaaagacagt

SEQ ID NO: 23120 - DNA, 20 bp, human
gtcggttcggcttctcgggt

SEQ ID NO: 23121 - DNA, 20 bp, human
gcacgctctggggcgcagaa

SEQ ID NO: 23122 - DNA, 20 bp, human
gtcggcgcctctgggaagac

SEQ ID NO: 23123 - DNA, 20 bp, human
gagtggtgaggagtcttaag

SEQ ID NO: 23124 - DNA, 20 bp, human
ggacccacgaggagactggg

SEQ ID NO: 23125 - DNA, 20 bp, human
gggcggggctcgcgaggcta

SEQ ID NO: 23126 - DNA, 20 bp, human
gccaagcgcgcgacacgcct

SEQ ID NO: 23127 - DNA, 20 bp, human
gcagcaagcttgccccgaag

SEQ ID NO: 23128 - DNA, 20 bp, human
ggaggtggcaggtatctaag

SEQ ID NO: 23129 - DNA, 20 bp, human
gtgcgctgcgggagcggcga

SEQ ID NO: 23130 - DNA, 20 bp, human
gcgtcaggagaggtgaagaa

SEQ ID NO: 23131 - DNA, 20 bp, human
ggggcaacctggacgagctg

SEQ ID NO: 23132 - DNA, 20 bp, human
gtattctgcaatccccttcg

SEQ ID NO: 23133 - DNA, 20 bp, human
gacggatggagcgtcaggag

SEQ ID NO: 23134 - DNA, 20 bp, human
ggagtgggtgtcctcaagaa

SEQ ID NO: 23135 - DNA, 20 bp, human
gagctggggcaacctgatct

SEQ ID NO: 23136 - DNA, 20 bp, human
gaccagcagcgcggggacac

SEQ ID NO: 23137 - DNA, 20 bp, human
gaccgcggttcagggacccc

SEQ ID NO: 23138 - DNA, 20 bp, human
gtcccggggtccctgaaccg

SEQ ID NO: 23139 - DNA, 20 bp, human
gccctgaaccgcggtaaggg

SEQ ID NO: 23140 - DNA, 20 bp, human
ggcgcgctgcatgaactcga

SEQ ID NO: 23141 - DNA, 20 bp, human
gggtccctgaaccgcggtaa

SEQ ID NO: 23142 - DNA, 20 bp, human
gggcgtggcagtccacgcat

SEQ ID NO: 23143 - DNA, 20 bp, human
gggcggcggcggtgacatcg

SEQ ID NO: 23144 - DNA, 20 bp, human
gtgaaccgcggtaagggcgg

SEQ ID NO: 23145 - DNA, 20 bp, human
ggtggtgcgggcgtccgaat

SEQ ID NO: 23146 - DNA, 20 bp, human
ggagcttgcacaggacgtgg

SEQ ID NO: 23147 - DNA, 20 bp, human
gacttcacggagaccaagag

SEQ ID NO: 23148 - DNA, 20 bp, human
gctctctcgagggcacccca

SEQ ID NO: 23149 - DNA, 20 bp, human
ggatgagcttgcacaggacg

SEQ ID NO: 23150 - DNA, 20 bp, human
ggggtgccctcgagagagtg

SEQ ID NO: 23151 - DNA, 20 bp, human
gcccctgctgcccggctgca

SEQ ID NO: 23152 - DNA, 20 bp, human
gttctctcccctacatgcag

SEQ ID NO: 23153 - DNA, 20 bp, human
ggataagccgggaaagacca

SEQ ID NO: 23154 - DNA, 20 bp, human
gcgggaaagaccacggccct

SEQ ID NO: 23155 - DNA, 20 bp, human
gctgctcctcactctctcga

SEQ ID NO: 23156 - DNA, 20 bp, human
gagtgtgacataactacgaa

SEQ ID NO: 23157 - DNA, 20 bp, human
gtaactacgaacggcctctc

SEQ ID NO: 23158 - DNA, 20 bp, human
gggaatactaaatagagaat

SEQ ID NO: 23159 - DNA, 20 bp, human
gacgcaaggctggagcatct

SEQ ID NO: 23160 - DNA, 20 bp, human
gaagtctatgaagtctctca

SEQ ID NO: 23161 - DNA, 20 bp, human
gcttccgtgacaacatacac

SEQ ID NO: 23162 - DNA, 20 bp, human
gttggcaggatgaaacacga

SEQ ID NO: 23163 - DNA, 20 bp, human
gagttaccggaaaaaacaac

SEQ ID NO: 23164 - DNA, 20 bp, human
gctgcctgtgtatgttgtca

SEQ ID NO: 23165 - DNA, 20 bp, human
gaaactcttgagaagtaaga

SEQ ID NO: 23166 - DNA, 20 bp, human
ggctgtggatcaattaccaa

SEQ ID NO: 23167 - DNA, 20 bp, human
ggtcttgtgaatttgcttct

SEQ ID NO: 23168 - DNA, 20 bp, human
gggctccagagtgagtcgga

SEQ ID NO: 23169 - DNA, 20 bp, human
gccctcctgggaccctaaaa

SEQ ID NO: 23170 - DNA, 20 bp, human
gtgaggggcctaataaatga

SEQ ID NO: 23171 - DNA, 20 bp, human
gacactatggacggaaatcc

SEQ ID NO: 23172 - DNA, 20 bp, human
gagcaccttccgactcactc

SEQ ID NO: 23173 - DNA, 20 bp, human
gcttcccaaattcaactgac

SEQ ID NO: 23174 - DNA, 20 bp, human
gtaaacatgtgatcaggcaa

SEQ ID NO: 23175 - DNA, 20 bp, human
gtgtaattcttggaccctcc

SEQ ID NO: 23176 - DNA, 20 bp, human
gtcttcctggggaaaacctg

SEQ ID NO: 23177 - DNA, 20 bp, human
gttcccaaaaggcccatggt

SEQ ID NO: 23178 - DNA, 20 bp, human
gccaaaaggcccatggttgg

SEQ ID NO: 23179 - DNA, 20 bp, human
gagtattcccaaaaggccca

SEQ ID NO: 23180 - DNA, 20 bp, human
gactatacacagttaaacca

SEQ ID NO: 23181 - DNA, 20 bp, human
gctcaaaagtgttatatccg

SEQ ID NO: 23182 - DNA, 20 bp, human
gattgactcctaaataaccc

SEQ ID NO: 23183 - DNA, 20 bp, human
gttcctgctacctccaacca

SEQ ID NO: 23184 - DNA, 20 bp, human
gagttaaaccagggttattt

SEQ ID NO: 23185 - DNA, 20 bp, human
gaacaacatgacagctttta

SEQ ID NO: 23186 - DNA, 20 bp, human
gagcccaggagaccagaaca

SEQ ID NO: 23187 - DNA, 20 bp, human
ggacccactggagcaaagat

SEQ ID NO: 23188 - DNA, 20 bp, human
gaacatggtgagtctcgaag

SEQ ID NO: 23189 - DNA, 20 bp, human
gcccaggctctcacactcca

SEQ ID NO: 23190 - DNA, 20 bp, human
ggaaggtccctcctgcccaa

SEQ ID NO: 23191 - DNA, 20 bp, human
gtgggctccccgaggatcga

SEQ ID NO: 23192 - DNA, 20 bp, human
ggagggaccttcgatcctcg

SEQ ID NO: 23193 - DNA, 20 bp, human
ggtgagtctcgaaggggaat

SEQ ID NO: 23194 - DNA, 20 bp, human
gtggtctcctgggctccccg

SEQ ID NO: 23195 - DNA, 20 bp, human
gcaccatgttctggtctcct

SEQ ID NO: 23196 - DNA, 20 bp, human
gctctaccagctgccagaca

SEQ ID NO: 23197 - DNA, 20 bp, human
gggtctctccctgccgtgtc

SEQ ID NO: 23198 - DNA, 20 bp, human
gagattcactgggactggtg

SEQ ID NO: 23199 - DNA, 20 bp, human
ggctacaagggcgggaagga

SEQ ID NO: 23200 - DNA, 20 bp, human
gtgtttgccagggctcctgt

SEQ ID NO: 23201 - DNA, 20 bp, human
gccagctgccagacacggca

SEQ ID NO: 23202 - DNA, 20 bp, human
ggtaaggatggaggctacaa

SEQ ID NO: 23203 - DNA, 20 bp, human
ggaagagacggtaaggatgg

SEQ ID NO: 23204 - DNA, 20 bp, human
gggaggctacaagggcggga

SEQ ID NO: 23205 - DNA, 20 bp, human
gccacttgggagcccaatcc

SEQ ID NO: 23206 - DNA, 20 bp, human
ggactcccaaaaccagaggt

SEQ ID NO: 23207 - DNA, 20 bp, human
ggcacgtggcacacaggctc

SEQ ID NO: 23208 - DNA, 20 bp, human
gctccggtagacaaagctgt

SEQ ID NO: 23209 - DNA, 20 bp, human
gattgaggtgaacctacctc

SEQ ID NO: 23210 - DNA, 20 bp, human
gtgtccagcacgtggcacac

SEQ ID NO: 23211 - DNA, 20 bp, human
gtggagatggtaatattcta

SEQ ID NO: 23212 - DNA, 20 bp, human
gctggttttgggagtccttg

SEQ ID NO: 23213 - DNA, 20 bp, human
gccccggcctccatgactgt

SEQ ID NO: 23214 - DNA, 20 bp, human
gggggaaacaagagtcattg

SEQ ID NO: 23215 - DNA, 20 bp, human
gacaaagctgtgggtagcac

SEQ ID NO: 23216 - DNA, 20 bp, human
gggccgcgccaaccccacaa

SEQ ID NO: 23217 - DNA, 20 bp, human
gctcccagccgagtccgtta

SEQ ID NO: 23218 - DNA, 20 bp, human
gcccctcatcctcttcggga

SEQ ID NO: 23219 - DNA, 20 bp, human
ggccgtcccgaagaggatga

SEQ ID NO: 23220 - DNA, 20 bp, human
gggccgctgccgtcccgaag

SEQ ID NO: 23221 - DNA, 20 bp, human
ggcagcggccataacggact

SEQ ID NO: 23222 - DNA, 20 bp, human
gatcctcttcgggacggcag

SEQ ID NO: 23223 - DNA, 20 bp, human
gggcagcagggtgtgtagat

SEQ ID NO: 23224 - DNA, 20 bp, human
gctggccccctcatcctctt

SEQ ID NO: 23225 - DNA, 20 bp, human
ggggcttggatggccgaccc

SEQ ID NO: 23226 - DNA, 20 bp, human
gccgccgcggccgagcaatg

SEQ ID NO: 23227 - DNA, 20 bp, human
gcaatgaggagtacaccctc

SEQ ID NO: 23228 - DNA, 20 bp, human
gactcctcattgctcggccg

SEQ ID NO: 23229 - DNA, 20 bp, human
gtccacagtcgctggcccgg

SEQ ID NO: 23230 - DNA, 20 bp, human
ggcagcacaggagccaacgg

SEQ ID NO: 23231 - DNA, 20 bp, human
ggggtgtactcctcattgct

SEQ ID NO: 23232 - DNA, 20 bp, human
ggtacaccctccacagtcgc

SEQ ID NO: 23233 - DNA, 20 bp, human
gcctgagtctggtgaggaca

SEQ ID NO: 23234 - DNA, 20 bp, human
gccctccgggccagcgactg

SEQ ID NO: 23235 - DNA, 20 bp, human
gccttagctgccttccctca

SEQ ID NO: 23236 - DNA, 20 bp, human
gagctggctccagaacccaa

SEQ ID NO: 23237 - DNA, 20 bp, human
gacggacctggtaggcaaca

SEQ ID NO: 23238 - DNA, 20 bp, human
gtgagggtctctaccctcca

SEQ ID NO: 23239 - DNA, 20 bp, human
ggctggggtcctgcgagagg

SEQ ID NO: 23240 - DNA, 20 bp, human
ggggtctctaccctccaggg

SEQ ID NO: 23241 - DNA, 20 bp, human
gcctggtaggcaacagggag

SEQ ID NO: 23242 - DNA, 20 bp, human
gcctctccagggcctcagtg

SEQ ID NO: 23243 - DNA, 20 bp, human
gctctgtgattccccaacta

SEQ ID NO: 23244 - DNA, 20 bp, human
gccctggagaggggcactca

SEQ ID NO: 23245 - DNA, 20 bp, human
gttagttgtagccacggacc

SEQ ID NO: 23246 - DNA, 20 bp, human
gtgggtggtggaggatcatc

SEQ ID NO: 23247 - DNA, 20 bp, human
ggaaagccggcgcctcatcc

SEQ ID NO: 23248 - DNA, 20 bp, human
gtggcagctggagaagaccc

SEQ ID NO: 23249 - DNA, 20 bp, human
gcagttttgcagtaaagcgg

SEQ ID NO: 23250 - DNA, 20 bp, human
gggctctggggcagaatcag

SEQ ID NO: 23251 - DNA, 20 bp, human
gcccagaaccaaacaaaagg

SEQ ID NO: 23252 - DNA, 20 bp, human
gggagaagacccgggaaagc

SEQ ID NO: 23253 - DNA, 20 bp, human
gatgaggcgccggctttccc

SEQ ID NO: 23254 - DNA, 20 bp, human
gcgctcagagggccaagcag

SEQ ID NO: 23255 - DNA, 20 bp, human
ggctttactgcaaaactgac

SEQ ID NO: 23256 - DNA, 20 bp, human
gcgcctctaacactacaggg

SEQ ID NO: 23257 - DNA, 20 bp, human
gccccggacgcagtacgaag

SEQ ID NO: 23258 - DNA, 20 bp, human
gccgtaatggctccacaccg

SEQ ID NO: 23259 - DNA, 20 bp, human
gctagtgtagccggagtgag

SEQ ID NO: 23260 - DNA, 20 bp, human
gtaacactacagggtggtag

SEQ ID NO: 23261 - DNA, 20 bp, human
gtggctcccagcacccgccg

SEQ ID NO: 23262 - DNA, 20 bp, human
gggaagagcaggctacgtcc

SEQ ID NO: 23263 - DNA, 20 bp, human
gcgagcggctgaggtaggta

SEQ ID NO: 23264 - DNA, 20 bp, human
gcgaggggccgggctacgag

SEQ ID NO: 23265 - DNA, 20 bp, human
gacggagtggcaggcagcga

SEQ ID NO: 23266 - DNA, 20 bp, human
ggccgctgcgtgggactgag

SEQ ID NO: 23267 - DNA, 20 bp, human
gtcccctcagtcccacgcag

SEQ ID NO: 23268 - DNA, 20 bp, human
gaactcagagaagccggggt

SEQ ID NO: 23269 - DNA, 20 bp, human
gctcggccgtcgcatctcta

SEQ ID NO: 23270 - DNA, 20 bp, human
ggtcggagccatagagacgt

SEQ ID NO: 23271 - DNA, 20 bp, human
ggtcgcccggtccctcagtc

SEQ ID NO: 23272 - DNA, 20 bp, human
gccggcagccgacgtctcta

SEQ ID NO: 23273 - DNA, 20 bp, human
gtcaagcctcaaaggctccg

SEQ ID NO: 23274 - DNA, 20 bp, human
gtgggtcacacgcacccagg

SEQ ID NO: 23275 - DNA, 20 bp, human
gaagccctcagggtgggcaa

SEQ ID NO: 23276 - DNA, 20 bp, human
ggctgcggagcgggagacag

SEQ ID NO: 23277 - DNA, 20 bp, human
gcgggagaggcgcaggactg

SEQ ID NO: 23278 - DNA, 20 bp, human
ggactgcggcgccgagatcc

SEQ ID NO: 23279 - DNA, 20 bp, human
gaggcacccgaaggggactg

SEQ ID NO: 23280 - DNA, 20 bp, human
ggactggggtctggtaaact

SEQ ID NO: 23281 - DNA, 20 bp, human
gagctggcgccgagcgcggt

SEQ ID NO: 23282 - DNA, 20 bp, human
gggttcccaggcacccgaag

SEQ ID NO: 23283 - DNA, 20 bp, human
gccttggtggaccggttccc

SEQ ID NO: 23284 - DNA, 20 bp, human
gcggagcgggagacaggggc

SEQ ID NO: 23285 - DNA, 20 bp, human
gaccggtccaccaaggccaa

SEQ ID NO: 23286 - DNA, 20 bp, human
gctgttgcggagctctgaag

SEQ ID NO: 23287 - DNA, 20 bp, human
gcccctgaagaagcagtcgt

SEQ ID NO: 23288 - DNA, 20 bp, human
gcaaccctagaggaataagg

SEQ ID NO: 23289 - DNA, 20 bp, human
gccgccacgaaacaggaaag

SEQ ID NO: 23290 - DNA, 20 bp, human
gcacccagcacattacgtca

SEQ ID NO: 23291 - DNA, 20 bp, human
gggctccgaactgctgtgag

SEQ ID NO: 23292 - DNA, 20 bp, human
gggtttgcgctttctcttag

SEQ ID NO: 23293 - DNA, 20 bp, human
ggttcaaaaccagcgccctc

SEQ ID NO: 23294 - DNA, 20 bp, human
gctgccaccttattcctcta

SEQ ID NO: 23295 - DNA, 20 bp, human
ggctctggaagccgcagcgt

SEQ ID NO: 23296 - DNA, 20 bp, human
gcaggaggcagagcaggtcc

SEQ ID NO: 23297 - DNA, 20 bp, human
ggcggctcgggtcttcctcc

SEQ ID NO: 23298 - DNA, 20 bp, human
ggcctctgcctagtccgtga

SEQ ID NO: 23299 - DNA, 20 bp, human
gaccctcacggactaggcag

SEQ ID NO: 23300 - DNA, 20 bp, human
gggagtggaccgcgaggggt

SEQ ID NO: 23301 - DNA, 20 bp, human
gcggaagtcgcagggaagtg

SEQ ID NO: 23302 - DNA, 20 bp, human
gactaggcagaggccgcccg

SEQ ID NO: 23303 - DNA, 20 bp, human
gcagagcaggtccgggaccg

SEQ ID NO: 23304 - DNA, 20 bp, human
gccaggccgggtccaattag

SEQ ID NO: 23305 - DNA, 20 bp, human
gcagcatggacctggatccg

SEQ ID NO: 23306 - DNA, 20 bp, human
gaggctcgcgtcagggctgg

SEQ ID NO: 23307 - DNA, 20 bp, human
gcgcgtcagggctggcggta

SEQ ID NO: 23308 - DNA, 20 bp, human
gagtcaggcgcgagaaggct

SEQ ID NO: 23309 - DNA, 20 bp, human
gcgacagaagagtagatgag

SEQ ID NO: 23310 - DNA, 20 bp, human
gcttctcgagcaggatccgg

SEQ ID NO: 23311 - DNA, 20 bp, human
gaggacgcaggctcgcgtca

SEQ ID NO: 23312 - DNA, 20 bp, human
gcggagcgcgggagccccaa

SEQ ID NO: 23313 - DNA, 20 bp, human
ggggcagttacctccgccag

SEQ ID NO: 23314 - DNA, 20 bp, human
gcagcttctcgagcaggatc

SEQ ID NO: 23315 - DNA, 20 bp, human
gggcgcgagaaggctaggcg

SEQ ID NO: 23316 - DNA, 20 bp, human
ggcgactgcacaagcaggga

SEQ ID NO: 23317 - DNA, 20 bp, human
ggacctggtgcgcctggaag

SEQ ID NO: 23318 - DNA, 20 bp, human
ggccccgcggaaacggacgg

SEQ ID NO: 23319 - DNA, 20 bp, human
gggagtgcagggaccgctga

SEQ ID NO: 23320 - DNA, 20 bp, human
gctggccccgcggaaacgga

SEQ ID NO: 23321 - DNA, 20 bp, human
ggcgacagcgctacttcgtg

SEQ ID NO: 23322 - DNA, 20 bp, human
gcaatgagacccgccctcag

SEQ ID NO: 23323 - DNA, 20 bp, human
gccgggcccgaaggagtgca

SEQ ID NO: 23324 - DNA, 20 bp, human
gaggcgcggggcgacggaga

SEQ ID NO: 23325 - DNA, 20 bp, human
ggtgcagggaccgctgaggg

SEQ ID NO: 23326 - DNA, 20 bp, human
gcagtcccaggacaactgtc

SEQ ID NO: 23327 - DNA, 20 bp, human
gataccccgtgctaccagaa

SEQ ID NO: 23328 - DNA, 20 bp, human
gcagccattctggtagcacg

SEQ ID NO: 23329 - DNA, 20 bp, human
ggaataagacaagcagtccc

SEQ ID NO: 23330 - DNA, 20 bp, human
gtggtgaagaatatgtactc

SEQ ID NO: 23331 - DNA, 20 bp, human
gagtactgagacagccattc

SEQ ID NO: 23332 - DNA, 20 bp, human
gcttacctgcatagcaggtc

SEQ ID NO: 23333 - DNA, 20 bp, human
gttcgcctgacagttgtcct

SEQ ID NO: 23334 - DNA, 20 bp, human
gtaactactgaacaattcat

SEQ ID NO: 23335 - DNA, 20 bp, human
gaaatgccagtcagctccca

SEQ ID NO: 23336 - DNA, 20 bp, human
gccctgagctgggaaccgag

SEQ ID NO: 23337 - DNA, 20 bp, human
gccatcgcagcctcagtcaa

SEQ ID NO: 23338 - DNA, 20 bp, human
ggcccggctgccgttgactg

SEQ ID NO: 23339 - DNA, 20 bp, human
ggggcatcgagagttcagag

SEQ ID NO: 23340 - DNA, 20 bp, human
ggagaagccgagggaagcaa

SEQ ID NO: 23341 - DNA, 20 bp, human
ggtgggcagtctggcgcctg

SEQ ID NO: 23342 - DNA, 20 bp, human
gcagagcggcaccagacagt

SEQ ID NO: 23343 - DNA, 20 bp, human
ggcatccctcgcctgcacag

SEQ ID NO: 23344 - DNA, 20 bp, human
gtgtcgccaggagaagccga

SEQ ID NO: 23345 - DNA, 20 bp, human
gaagccgagggaagcaatgg

SEQ ID NO: 23346 - DNA, 20 bp, human
gcatccattgctgtcaggaa

SEQ ID NO: 23347 - DNA, 20 bp, human
ggtaggcctgaggcaaatct

SEQ ID NO: 23348 - DNA, 20 bp, human
gtagtgagtttaggcaaagt

SEQ ID NO: 23349 - DNA, 20 bp, human
gaagccattcctgacagcaa

SEQ ID NO: 23350 - DNA, 20 bp, human
gcctgggagccacaaagata

SEQ ID NO: 23351 - DNA, 20 bp, human
gtaggcagtcggtaggcctg

SEQ ID NO: 23352 - DNA, 20 bp, human
gagcagttgttagtgagttt

SEQ ID NO: 23353 - DNA, 20 bp, human
gactgcctaaaggaaatgtc

SEQ ID NO: 23354 - DNA, 20 bp, human
gtttcctttaggcagtcggt

SEQ ID NO: 23355 - DNA, 20 bp, human
gagtcaagttaaaatgggca

SEQ ID NO: 23356 - DNA, 20 bp, human
gcctcggagggagggcgtag

SEQ ID NO: 23357 - DNA, 20 bp, human
gaggcctgcagactccgact

SEQ ID NO: 23358 - DNA, 20 bp, human
gggcggggctctccctcgga

SEQ ID NO: 23359 - DNA, 20 bp, human
gccctaggcccccgccccta

SEQ ID NO: 23360 - DNA, 20 bp, human
gacagacgcgggctagacgc

SEQ ID NO: 23361 - DNA, 20 bp, human
gccccagcggaagggtcttg

SEQ ID NO: 23362 - DNA, 20 bp, human
ggggcccagtcggagtctgc

SEQ ID NO: 23363 - DNA, 20 bp, human
gagggatcaccccagcggaa

SEQ ID NO: 23364 - DNA, 20 bp, human
ggggctctccctcggaggga

SEQ ID NO: 23365 - DNA, 20 bp, human
gggcggcatggaggacgacg

SEQ ID NO: 23366 - DNA, 20 bp, human
gccagcaagtggacagcaga

SEQ ID NO: 23367 - DNA, 20 bp, human
ggccatggcaacccagcaag

SEQ ID NO: 23368 - DNA, 20 bp, human
gcaagtggacagcagaaggc

SEQ ID NO: 23369 - DNA, 20 bp, human
gagctgcttgaacggagaag

SEQ ID NO: 23370 - DNA, 20 bp, human
ggcagccagatctgaggcca

SEQ ID NO: 23371 - DNA, 20 bp, human
gtgaattggagcgctcctgg

SEQ ID NO: 23372 - DNA, 20 bp, human
gcctggaggattcattctca

SEQ ID NO: 23373 - DNA, 20 bp, human
ggttgccatggcctcagatc

SEQ ID NO: 23374 - DNA, 20 bp, human
gctgcttctcgtcatcacag

SEQ ID NO: 23375 - DNA, 20 bp, human
gagtgggatccagggacggt

SEQ ID NO: 23376 - DNA, 20 bp, human
gttcgctaagttgctgtatg

SEQ ID NO: 23377 - DNA, 20 bp, human
ggcggccgcagtctctagtg

SEQ ID NO: 23378 - DNA, 20 bp, human
gtctagtgtggtgagacgag

SEQ ID NO: 23379 - DNA, 20 bp, human
gccgccatggccacaatcgg

SEQ ID NO: 23380 - DNA, 20 bp, human
gctcaccacactagagactg

SEQ ID NO: 23381 - DNA, 20 bp, human
gtcggtagcgattggaagaa

SEQ ID NO: 23382 - DNA, 20 bp, human
gcggccgccatggccacaat

SEQ ID NO: 23383 - DNA, 20 bp, human
gctagagactgcggccgcca

SEQ ID NO: 23384 - DNA, 20 bp, human
gctcagaagcgacagacctc

SEQ ID NO: 23385 - DNA, 20 bp, human
gctgggacccaaaggaacac

SEQ ID NO: 23386 - DNA, 20 bp, human
gagcgcgcgcccacctaggt

SEQ ID NO: 23387 - DNA, 20 bp, human
ggccgcggaaagcagatctg

SEQ ID NO: 23388 - DNA, 20 bp, human
gaggtgaccgagggcctagt

SEQ ID NO: 23389 - DNA, 20 bp, human
ggttgccagcccacctaggt

SEQ ID NO: 23390 - DNA, 20 bp, human
gtgacgcggagtgagtccct

SEQ ID NO: 23391 - DNA, 20 bp, human
gcgagaaatcgactatcctg

SEQ ID NO: 23392 - DNA, 20 bp, human
gggccacacctgaacagcac

SEQ ID NO: 23393 - DNA, 20 bp, human
gccggaatcgcgggagaacc

SEQ ID NO: 23394 - DNA, 20 bp, human
gctagtcggctgtgtcattg

SEQ ID NO: 23395 - DNA, 20 bp, human
gaggtgggcgcgcgctgacg

SEQ ID NO: 23396 - DNA, 20 bp, human
gacccccgggcaggaatctg

SEQ ID NO: 23397 - DNA, 20 bp, human
ggagaacccggatggaaccc

SEQ ID NO: 23398 - DNA, 20 bp, human
gatcccctctggaggaactg

SEQ ID NO: 23399 - DNA, 20 bp, human
gccaggcccgggttccatcc

SEQ ID NO: 23400 - DNA, 20 bp, human
ggttccatccgggttctcca

SEQ ID NO: 23401 - DNA, 20 bp, human
gtgcggatgcttctctctcc

SEQ ID NO: 23402 - DNA, 20 bp, human
gggctgggcagacgctccag

SEQ ID NO: 23403 - DNA, 20 bp, human
gccgcccgtctccaagcctg

SEQ ID NO: 23404 - DNA, 20 bp, human
gtgggactggagcctgaaac

SEQ ID NO: 23405 - DNA, 20 bp, human
gaccgcagattcctgcccgg

SEQ ID NO: 23406 - DNA, 20 bp, human
gctgctggggagcggccatg

SEQ ID NO: 23407 - DNA, 20 bp, human
gggccgagcgacttcagctc

SEQ ID NO: 23408 - DNA, 20 bp, human
gcctccaggagcgcagtcat

SEQ ID NO: 23409 - DNA, 20 bp, human
gagctcggggacctgcccca

SEQ ID NO: 23410 - DNA, 20 bp, human
ggacaagaagccccccacct

SEQ ID NO: 23411 - DNA, 20 bp, human
gcgcacgcggtggtcgccag

SEQ ID NO: 23412 - DNA, 20 bp, human
gacagggaaaccgccgaggt

SEQ ID NO: 23413 - DNA, 20 bp, human
gaagaagccccccacctcgg

SEQ ID NO: 23414 - DNA, 20 bp, human
gtctctccgcaggttgggaa

SEQ ID NO: 23415 - DNA, 20 bp, human
gacgggtccgggccctcccg

SEQ ID NO: 23416 - DNA, 20 bp, human
gtcagaacctcggtgacggt

SEQ ID NO: 23417 - DNA, 20 bp, human
gtaggccggggtcactctga

SEQ ID NO: 23418 - DNA, 20 bp, human
gacctggccaaccgtcaccg

SEQ ID NO: 23419 - DNA, 20 bp, human
gcagctaaagatggagcctg

SEQ ID NO: 23420 - DNA, 20 bp, human
gcctgtcagaacctcggtga

SEQ ID NO: 23421 - DNA, 20 bp, human
gagatctggggggtcttcat

SEQ ID NO: 23422 - DNA, 20 bp, human
gccaaccgacacccagggag

SEQ ID NO: 23423 - DNA, 20 bp, human
gcttccaccacccaacgggt

SEQ ID NO: 23424 - DNA, 20 bp, human
ggacggctgctcggtcttga

SEQ ID NO: 23425 - DNA, 20 bp, human
ggcggctggtggctgtccgt

SEQ ID NO: 23426 - DNA, 20 bp, human
gttcctctggacagtgttat

SEQ ID NO: 23427 - DNA, 20 bp, human
gatggatattctctttcctc

SEQ ID NO: 23428 - DNA, 20 bp, human
ggtagaggcgtaagataatc

SEQ ID NO: 23429 - DNA, 20 bp, human
ggaggacccggtcatgagag

SEQ ID NO: 23430 - DNA, 20 bp, human
gtaccaataacactgtccag

SEQ ID NO: 23431 - DNA, 20 bp, human
gcccggtcatgagaggggtg

SEQ ID NO: 23432 - DNA, 20 bp, human
gcaggctgaacacaacaaag

SEQ ID NO: 23433 - DNA, 20 bp, human
gggagcgcctctggctgatg

SEQ ID NO: 23434 - DNA, 20 bp, human
gacagatggtctgggagctt

SEQ ID NO: 23435 - DNA, 20 bp, human
gacttttccacatcagccag

SEQ ID NO: 23436 - DNA, 20 bp, human
ggggcggaagtgcccggcgc

SEQ ID NO: 23437 - DNA, 20 bp, human
gctgcgcgtcagctcagagg

SEQ ID NO: 23438 - DNA, 20 bp, human
gaccctcggcgcgggactaa

SEQ ID NO: 23439 - DNA, 20 bp, human
gagggcggaagcagaggcgt

SEQ ID NO: 23440 - DNA, 20 bp, human
gggaagtgcccggcgcaggg

SEQ ID NO: 23441 - DNA, 20 bp, human
gagcctgcgcgtcagctcag

SEQ ID NO: 23442 - DNA, 20 bp, human
gcagaggcgttggcggcgtg

SEQ ID NO: 23443 - DNA, 20 bp, human
gcgttggcggcgtgaggctc

SEQ ID NO: 23444 - DNA, 20 bp, human
ggagcgctcaccctcggcgc

SEQ ID NO: 23445 - DNA, 20 bp, human
gggcatcggcgaatcactgg

SEQ ID NO: 23446 - DNA, 20 bp, human
gagcctgcagaataattggg

SEQ ID NO: 23447 - DNA, 20 bp, human
gagaagcctgcagaataatt

SEQ ID NO: 23448 - DNA, 20 bp, human
gagaataattgggaggagtc

SEQ ID NO: 23449 - DNA, 20 bp, human
gcctctatcaaagcatagtg

SEQ ID NO: 23450 - DNA, 20 bp, human
ggagacccctaatacagcca

SEQ ID NO: 23451 - DNA, 20 bp, human
gagaccccaaaactgtgagg

SEQ ID NO: 23452 - DNA, 20 bp, human
gtcatccctggctgtattag

SEQ ID NO: 23453 - DNA, 20 bp, human
gcgacttagcagcggcagac

SEQ ID NO: 23454 - DNA, 20 bp, human
gcatctcctcgacttagcag

SEQ ID NO: 23455 - DNA, 20 bp, human
gccgtaagagaactgggtca

SEQ ID NO: 23456 - DNA, 20 bp, human
gaaggtaagctgggtagtcc

SEQ ID NO: 23457 - DNA, 20 bp, human
gccaggtgcatgactgacct

SEQ ID NO: 23458 - DNA, 20 bp, human
gcttaccttggcgatagtaa

SEQ ID NO: 23459 - DNA, 20 bp, human
ggaagcctagcaacacctag

SEQ ID NO: 23460 - DNA, 20 bp, human
gtttttctgtgcatgcccag

SEQ ID NO: 23461 - DNA, 20 bp, human
ggacctaagctgcaaattat

SEQ ID NO: 23462 - DNA, 20 bp, human
gcaaccctctaggtgttgct

SEQ ID NO: 23463 - DNA, 20 bp, human
gtctacctttactatcgcca

SEQ ID NO: 23464 - DNA, 20 bp, human
gcaccacaaactctgcttaa

SEQ ID NO: 23465 - DNA, 20 bp, human
gaatttgcagcttaggtccg

SEQ ID NO: 23466 - DNA, 20 bp, human
ggctgcagcggcgggaggta

SEQ ID NO: 23467 - DNA, 20 bp, human
ggggcccgggagccaaccga

SEQ ID NO: 23468 - DNA, 20 bp, human
gcgacaggaacgccctcggt

SEQ ID NO: 23469 - DNA, 20 bp, human
gaagcaaagagatcgtcctg

SEQ ID NO: 23470 - DNA, 20 bp, human
gccgtcaggcgcgtgatcaa

SEQ ID NO: 23471 - DNA, 20 bp, human
ggttcctgtcggggctgcag

SEQ ID NO: 23472 - DNA, 20 bp, human
gtagagactcaagcgaacct

SEQ ID NO: 23473 - DNA, 20 bp, human
gccgccgctgcagccccgac

SEQ ID NO: 23474 - DNA, 20 bp, human
gggatgcgggccagcaacag

SEQ ID NO: 23475 - DNA, 20 bp, human
ggccccgacaggaacgccct

SEQ ID NO: 23476 - DNA, 20 bp, human
gaatatgaacttgggtgtca

SEQ ID NO: 23477 - DNA, 20 bp, human
gtctgcatctctgcctacaa

SEQ ID NO: 23478 - DNA, 20 bp, human
gatgggagtgtggcctgtga

SEQ ID NO: 23479 - DNA, 20 bp, human
gtcagacctaagcaaatgat

SEQ ID NO: 23480 - DNA, 20 bp, human
gagctctaggctgatagtgc

SEQ ID NO: 23481 - DNA, 20 bp, human
gctagagcttagttaactgt

SEQ ID NO: 23482 - DNA, 20 bp, human
gtttaaactctagaaaccaa

SEQ ID NO: 23483 - DNA, 20 bp, human
gagttgaggaagcctcaaag

SEQ ID NO: 23484 - DNA, 20 bp, human
gtaagcaaatgatgggagtg

SEQ ID NO: 23485 - DNA, 20 bp, human
gcagattctagaaccttcac

SEQ ID NO: 23486 - DNA, 20 bp, human
gtcgcgaagctagctagcag

SEQ ID NO: 23487 - DNA, 20 bp, human
ggcgggcgacgcttgcgcag

SEQ ID NO: 23488 - DNA, 20 bp, human
gcgagccaggcgggtactga

SEQ ID NO: 23489 - DNA, 20 bp, human
gggagagttagggaccacgg

SEQ ID NO: 23490 - DNA, 20 bp, human
gtgagactgtgagaggcccg

SEQ ID NO: 23491 - DNA, 20 bp, human
gtcctccccgtcccgggaag

SEQ ID NO: 23492 - DNA, 20 bp, human
gtgcctgggcaccaccgaca

SEQ ID NO: 23493 - DNA, 20 bp, human
ggcagggctaaaggagagtt

SEQ ID NO: 23494 - DNA, 20 bp, human
gggacggggaggacgagtcg

SEQ ID NO: 23495 - DNA, 20 bp, human
ggtggccctcagtacccgcc

SEQ ID NO: 23496 - DNA, 20 bp, human
ggcgggagcctgaatgtaag

SEQ ID NO: 23497 - DNA, 20 bp, human
gctccaggccacttacattc

SEQ ID NO: 23498 - DNA, 20 bp, human
gagtctccggaagcctgaag

SEQ ID NO: 23499 - DNA, 20 bp, human
gggtcactagggctgaggac

SEQ ID NO: 23500 - DNA, 20 bp, human
ggcgcgcaaagcacagaggt

SEQ ID NO: 23501 - DNA, 20 bp, human
gcgcaaagcacagaggtggg

SEQ ID NO: 23502 - DNA, 20 bp, human
gaggttgcaggctgttcaga

SEQ ID NO: 23503 - DNA, 20 bp, human
gcatttataggagcgcggaa

SEQ ID NO: 23504 - DNA, 20 bp, human
gagcctgaatgtaagtggcc

SEQ ID NO: 23505 - DNA, 20 bp, human
ggctggtttcagattctctg

SEQ ID NO: 23506 - DNA, 20 bp, human
gttaacccacccctcctccc

SEQ ID NO: 23507 - DNA, 20 bp, human
ggtccccgccgtccgcacgc

SEQ ID NO: 23508 - DNA, 20 bp, human
gggagtggtggtgagtccga

SEQ ID NO: 23509 - DNA, 20 bp, human
ggtagcgcggcgcccactca

SEQ ID NO: 23510 - DNA, 20 bp, human
gtataaagcgcggccccctg

SEQ ID NO: 23511 - DNA, 20 bp, human
ggacgaggaggaggtccccg

SEQ ID NO: 23512 - DNA, 20 bp, human
gacgtcgtccagggccagat

SEQ ID NO: 23513 - DNA, 20 bp, human
gggaggaggtccccgaggag

SEQ ID NO: 23514 - DNA, 20 bp, human
gacctgcggctgaaccacga

SEQ ID NO: 23515 - DNA, 20 bp, human
ggcagcagggccgtcgtcca

SEQ ID NO: 23516 - DNA, 20 bp, human
gcctcctgggtgaagatcca

SEQ ID NO: 23517 - DNA, 20 bp, human
ggtctcctggaggcgcggag

SEQ ID NO: 23518 - DNA, 20 bp, human
gcggcggtgctgtctcctgg

SEQ ID NO: 23519 - DNA, 20 bp, human
gcctagtccgggaaaggagg

SEQ ID NO: 23520 - DNA, 20 bp, human
gggccaaagcgagcacgcca

SEQ ID NO: 23521 - DNA, 20 bp, human
ggcggaggggagggacacgt

SEQ ID NO: 23522 - DNA, 20 bp, human
gggcctggtagagtcccctg

SEQ ID NO: 23523 - DNA, 20 bp, human
gctggccgagagcagccgcc

SEQ ID NO: 23524 - DNA, 20 bp, human
gggtcagtatgggtacatcg

SEQ ID NO: 23525 - DNA, 20 bp, human
gaagggctgtgcggtgagag

SEQ ID NO: 23526 - DNA, 20 bp, human
gctggtaggcgcgcaggcaa

SEQ ID NO: 23527 - DNA, 20 bp, human
gacctccggcctcctcacag

SEQ ID NO: 23528 - DNA, 20 bp, human
gctctaggcacaggtaaccg

SEQ ID NO: 23529 - DNA, 20 bp, human
ggccggaggtcggactcagg

SEQ ID NO: 23530 - DNA, 20 bp, human
ggggcgcgctcacccctgtg

SEQ ID NO: 23531 - DNA, 20 bp, human
gcgcgctgcagggcacaggt

SEQ ID NO: 23532 - DNA, 20 bp, human
gcaggtaaccgcggagagtc

SEQ ID NO: 23533 - DNA, 20 bp, human
ggaggccggaggtcggactc

SEQ ID NO: 23534 - DNA, 20 bp, human
gggtgagcgcgccccagagc

SEQ ID NO: 23535 - DNA, 20 bp, human
gcccagagccggcttcgtga

SEQ ID NO: 23536 - DNA, 20 bp, human
ggcagcagaggccacaccca

SEQ ID NO: 23537 - DNA, 20 bp, human
gactcgaggggaccctgcac

SEQ ID NO: 23538 - DNA, 20 bp, human
ggaggtggttagggactcga

SEQ ID NO: 23539 - DNA, 20 bp, human
gggcggccacgaggacagaa

SEQ ID NO: 23540 - DNA, 20 bp, human
gggcgcccggaatcccgcga

SEQ ID NO: 23541 - DNA, 20 bp, human
gagtccctaaccacctctct

SEQ ID NO: 23542 - DNA, 20 bp, human
ggcgcgggaccaccaagccc

SEQ ID NO: 23543 - DNA, 20 bp, human
gctctccacccgcatgagga

SEQ ID NO: 23544 - DNA, 20 bp, human
ggcagctccggactcccagc

SEQ ID NO: 23545 - DNA, 20 bp, human
gaggctgcgggaggagtcca

SEQ ID NO: 23546 - DNA, 20 bp, human
gtgggagatgaagacagacc

SEQ ID NO: 23547 - DNA, 20 bp, human
ggaccctaggtctaatgact

SEQ ID NO: 23548 - DNA, 20 bp, human
gttagacctagggtccagag

SEQ ID NO: 23549 - DNA, 20 bp, human
ggcagcccgctctggaccct

SEQ ID NO: 23550 - DNA, 20 bp, human
gcatcacggcctccatacct

SEQ ID NO: 23551 - DNA, 20 bp, human
ggatgcagggccgcgtggca

SEQ ID NO: 23552 - DNA, 20 bp, human
gctcggggactggagaccac

SEQ ID NO: 23553 - DNA, 20 bp, human
gtgccaagtcattagaccta

SEQ ID NO: 23554 - DNA, 20 bp, human
gagcgcagctccctgccacg

SEQ ID NO: 23555 - DNA, 20 bp, human
gctcctgcccaagggcatca

SEQ ID NO: 23556 - DNA, 20 bp, human
gttaggataatgctagaggc

SEQ ID NO: 23557 - DNA, 20 bp, human
gcccctgccatagaaggtat

SEQ ID NO: 23558 - DNA, 20 bp, human
gctggtgcccataccttcta

SEQ ID NO: 23559 - DNA, 20 bp, human
gaggtatgggcaccagattt

SEQ ID NO: 23560 - DNA, 20 bp, human
gacactcacaaagacatact

SEQ ID NO: 23561 - DNA, 20 bp, human
gttaatgctagagtctggga

SEQ ID NO: 23562 - DNA, 20 bp, human
ggaaagctggaagaggttca

SEQ ID NO: 23563 - DNA, 20 bp, human
gggatatttgaggagaatat

SEQ ID NO: 23564 - DNA, 20 bp, human
gacagaaagaatgacacata

SEQ ID NO: 23565 - DNA, 20 bp, human
gtgtgtctaacgttaaagaa

SEQ ID NO: 23566 - DNA, 20 bp, human
gcgcgacggtcggagcagtt

SEQ ID NO: 23567 - DNA, 20 bp, human
ggggccctcaccgcgacggt

SEQ ID NO: 23568 - DNA, 20 bp, human
gcctggggccctcaccgcga

SEQ ID NO: 23569 - DNA, 20 bp, human
gcgagtaggctgacctggat

SEQ ID NO: 23570 - DNA, 20 bp, human
ggcgcatgcgcacacagatc

SEQ ID NO: 23571 - DNA, 20 bp, human
gtgccggaggcgccacccca

SEQ ID NO: 23572 - DNA, 20 bp, human
gcgggagacttagtaattgg

SEQ ID NO: 23573 - DNA, 20 bp, human
gcgccgctgccgggtcgcta

SEQ ID NO: 23574 - DNA, 20 bp, human
gcatctccatggttacgcgg

SEQ ID NO: 23575 - DNA, 20 bp, human
gtgccgggtcgctagggacg

SEQ ID NO: 23576 - DNA, 20 bp, human
ggctctgtctagcagaaact

SEQ ID NO: 23577 - DNA, 20 bp, human
gctgtacttgggtggatcat

SEQ ID NO: 23578 - DNA, 20 bp, human
gtagtacatagtaagttaac

SEQ ID NO: 23579 - DNA, 20 bp, human
gtacctgctgcttcaaacac

SEQ ID NO: 23580 - DNA, 20 bp, human
gacatagtaagttaactggc

SEQ ID NO: 23581 - DNA, 20 bp, human
gatattctgatactggaaat

SEQ ID NO: 23582 - DNA, 20 bp, human
gaacaatgtaagattaaagt

SEQ ID NO: 23583 - DNA, 20 bp, human
gtcctgaattaactgtactt

SEQ ID NO: 23584 - DNA, 20 bp, human
gggttgtagataaagacagg

SEQ ID NO: 23585 - DNA, 20 bp, human
gacccaagtacagttaattc

SEQ ID NO: 23586 - DNA, 20 bp, human
gagcttacggtgagcaccgg

SEQ ID NO: 23587 - DNA, 20 bp, human
gcagagcttacggtgagcac

SEQ ID NO: 23588 - DNA, 20 bp, human
gccggaggctggaaacgggg

SEQ ID NO: 23589 - DNA, 20 bp, human
gcctgcggccaggactgtga

SEQ ID NO: 23590 - DNA, 20 bp, human
ggcaccggaggctggaaacg

SEQ ID NO: 23591 - DNA, 20 bp, human
gcaggggcgcccggactctg

SEQ ID NO: 23592 - DNA, 20 bp, human
gtcccctccgccccgctcag

SEQ ID NO: 23593 - DNA, 20 bp, human
gcacagggaagaccaaccct

SEQ ID NO: 23594 - DNA, 20 bp, human
ggggggcggggaatctgctg

SEQ ID NO: 23595 - DNA, 20 bp, human
gtacggtgagcaccggaggc

SEQ ID NO: 23596 - DNA, 20 bp, human
ggagaacatgaggagtggat

SEQ ID NO: 23597 - DNA, 20 bp, human
gatgtatgtgggccgagggt

SEQ ID NO: 23598 - DNA, 20 bp, human
gcacttcatcttggagatgg

SEQ ID NO: 23599 - DNA, 20 bp, human
gtccttgcgtcttaaagtag

SEQ ID NO: 23600 - DNA, 20 bp, human
gattcggaagcagctcgtgg

SEQ ID NO: 23601 - DNA, 20 bp, human
gtgcaggagtgcaataatcg

SEQ ID NO: 23602 - DNA, 20 bp, human
ggtgattcggaagcagctcg

SEQ ID NO: 23603 - DNA, 20 bp, human
ggttagacagcatctcaaag

SEQ ID NO: 23604 - DNA, 20 bp, human
gagctggttccacttcatct

SEQ ID NO: 23605 - DNA, 20 bp, human
gctgcttccgaatcacctga

SEQ ID NO: 23606 - DNA, 20 bp, human
gccaggcgcggagcctctcg

SEQ ID NO: 23607 - DNA, 20 bp, human
gtggaggactacgtaccggg

SEQ ID NO: 23608 - DNA, 20 bp, human
gagtctggaggactacgtac

SEQ ID NO: 23609 - DNA, 20 bp, human
gggacgcacggggccgccag

SEQ ID NO: 23610 - DNA, 20 bp, human
gtgtgagcaggcggtgggaa

SEQ ID NO: 23611 - DNA, 20 bp, human
gaggcccactggccatgtcg

SEQ ID NO: 23612 - DNA, 20 bp, human
ggagcctctcgggggtcacc

SEQ ID NO: 23613 - DNA, 20 bp, human
gagtgggcctctgggacccg

SEQ ID NO: 23614 - DNA, 20 bp, human
gggaaggccgaagaaggtcc

SEQ ID NO: 23615 - DNA, 20 bp, human
gggagggtcaaggaagcccg

SEQ ID NO: 23616 - DNA, 20 bp, human
gggagacccggcgggagcgt

SEQ ID NO: 23617 - DNA, 20 bp, human
gggagaggcgaagtgacagg

SEQ ID NO: 23618 - DNA, 20 bp, human
ggccgcggggagggacgaga

SEQ ID NO: 23619 - DNA, 20 bp, human
gagccagcaggagcgacagg

SEQ ID NO: 23620 - DNA, 20 bp, human
gacgagagggcctgacgtac

SEQ ID NO: 23621 - DNA, 20 bp, human
gctttacttggagacctcgg

SEQ ID NO: 23622 - DNA, 20 bp, human
ggacaggaggcaggaacgga

SEQ ID NO: 23623 - DNA, 20 bp, human
gcccgaggctggcaggacac

SEQ ID NO: 23624 - DNA, 20 bp, human
gggacactcacggggagacc

SEQ ID NO: 23625 - DNA, 20 bp, human
ggaaggtgcactgcccgcgg

SEQ ID NO: 23626 - DNA, 20 bp, human
gcgatcccggccgcaaagct

SEQ ID NO: 23627 - DNA, 20 bp, human
gatcgccgcagaaacagagg

SEQ ID NO: 23628 - DNA, 20 bp, human
gccgggatcgcggaaagtga

SEQ ID NO: 23629 - DNA, 20 bp, human
gtctctcaggacaggacgtg

SEQ ID NO: 23630 - DNA, 20 bp, human
gtcaatcgccgcagaaacag

SEQ ID NO: 23631 - DNA, 20 bp, human
gctcgtaaggatcaggacag

SEQ ID NO: 23632 - DNA, 20 bp, human
ggccagcggagggcgactag

SEQ ID NO: 23633 - DNA, 20 bp, human
gaaagtgatggctgtcgtcc

SEQ ID NO: 23634 - DNA, 20 bp, human
gagggcgcccgctccccggt

SEQ ID NO: 23635 - DNA, 20 bp, human
gctgtcctgagagagacgcc

SEQ ID NO: 23636 - DNA, 20 bp, human
gggagaagatgccactactt

SEQ ID NO: 23637 - DNA, 20 bp, human
ggtagtggcatcttctccct

SEQ ID NO: 23638 - DNA, 20 bp, human
ggcggctaataagcaggatt

SEQ ID NO: 23639 - DNA, 20 bp, human
gcaacggggtgtttctcaaa

SEQ ID NO: 23640 - DNA, 20 bp, human
gccaggactaaactcttctc

SEQ ID NO: 23641 - DNA, 20 bp, human
gagggtggcggctaataagc

SEQ ID NO: 23642 - DNA, 20 bp, human
gctcccgcccccaaaggaga

SEQ ID NO: 23643 - DNA, 20 bp, human
gacacaacttccagctgaca

SEQ ID NO: 23644 - DNA, 20 bp, human
gagttccttgctcagggtgg

SEQ ID NO: 23645 - DNA, 20 bp, human
ggacaagaggtctctgtgtt

SEQ ID NO: 23646 - DNA, 20 bp, human
ggatgctctgaccatcagta

SEQ ID NO: 23647 - DNA, 20 bp, human
gttgccaacctgatgactgg

SEQ ID NO: 23648 - DNA, 20 bp, human
ggaggccctgaggggatgaa

SEQ ID NO: 23649 - DNA, 20 bp, human
gggcccttcagcaacggagt

SEQ ID NO: 23650 - DNA, 20 bp, human
gtgactggcggctgaggagt

SEQ ID NO: 23651 - DNA, 20 bp, human
gggcccactccgttgctgaa

SEQ ID NO: 23652 - DNA, 20 bp, human
gctggcagaagcaggcgccc

SEQ ID NO: 23653 - DNA, 20 bp, human
gtgatgccactggcagaagc

SEQ ID NO: 23654 - DNA, 20 bp, human
gcaaagttgttgaggaagga

SEQ ID NO: 23655 - DNA, 20 bp, human
ggggggagcataggcagaag

SEQ ID NO: 23656 - DNA, 20 bp, human
gctgcggggacgctccatgt

SEQ ID NO: 23657 - DNA, 20 bp, human
gcaggattcgcgacccgaca

SEQ ID NO: 23658 - DNA, 20 bp, human
gtcgggtcgcgaatcctgac

SEQ ID NO: 23659 - DNA, 20 bp, human
ggccagggtaaccgaagctg

SEQ ID NO: 23660 - DNA, 20 bp, human
gagggcgtggctacaggacc

SEQ ID NO: 23661 - DNA, 20 bp, human
ggtaaccgaagctgaggcag

SEQ ID NO: 23662 - DNA, 20 bp, human
gagtctagttgagacaggtc

SEQ ID NO: 23663 - DNA, 20 bp, human
ggctcctgcaaccaccatgg

SEQ ID NO: 23664 - DNA, 20 bp, human
gagaggccggggccgagcat

SEQ ID NO: 23665 - DNA, 20 bp, human
gccgagcattggggactgcg

SEQ ID NO: 23666 - DNA, 20 bp, human
gaccagagtccagggagcgt

SEQ ID NO: 23667 - DNA, 20 bp, human
ggctgctctcgagggcccaa

SEQ ID NO: 23668 - DNA, 20 bp, human
gggccgacgaaaggctggag

SEQ ID NO: 23669 - DNA, 20 bp, human
gcgccggataccagagtcca

SEQ ID NO: 23670 - DNA, 20 bp, human
gcgtccagagaagctaggag

SEQ ID NO: 23671 - DNA, 20 bp, human
ggagggcccaagggaaccct

SEQ ID NO: 23672 - DNA, 20 bp, human
ggaagctgcgagcgaatcag

SEQ ID NO: 23673 - DNA, 20 bp, human
gcagggatcgcttaccccca

SEQ ID NO: 23674 - DNA, 20 bp, human
gagaggcccacaggatcggt

SEQ ID NO: 23675 - DNA, 20 bp, human
gagcgtaggcggccgacgaa

SEQ ID NO: 23676 - DNA, 20 bp, human
ggctcccgggcccagcgtcg

SEQ ID NO: 23677 - DNA, 20 bp, human
gtcaccaaggccacacccca

SEQ ID NO: 23678 - DNA, 20 bp, human
gcagctgcttccgggcttcg

SEQ ID NO: 23679 - DNA, 20 bp, human
gaggccgcggccccgacgct

SEQ ID NO: 23680 - DNA, 20 bp, human
gcggcggctccccaaggccg

SEQ ID NO: 23681 - DNA, 20 bp, human
gcaggagcacctaggacctg

SEQ ID NO: 23682 - DNA, 20 bp, human
gccgcgggtccttccagtcc

SEQ ID NO: 23683 - DNA, 20 bp, human
gtgtgcgcggggaccgctcc

SEQ ID NO: 23684 - DNA, 20 bp, human
gaaacgcagagaggactctc

SEQ ID NO: 23685 - DNA, 20 bp, human
ggacgcgtaggtcccgaagt

SEQ ID NO: 23686 - DNA, 20 bp, human
ggcccgactgttgagtgagg

SEQ ID NO: 23687 - DNA, 20 bp, human
ggagaaatgctggaccgagg

SEQ ID NO: 23688 - DNA, 20 bp, human
ggcgaagtgggctcgtgggt

SEQ ID NO: 23689 - DNA, 20 bp, human
gggtcgcccggggataggaa

SEQ ID NO: 23690 - DNA, 20 bp, human
gcccgccggctgctgcgcaa

SEQ ID NO: 23691 - DNA, 20 bp, human
ggcgcgcgggaagagtccca

SEQ ID NO: 23692 - DNA, 20 bp, human
gggggagcaggggatcccaa

SEQ ID NO: 23693 - DNA, 20 bp, human
gggcagtatgagagttgtaa

SEQ ID NO: 23694 - DNA, 20 bp, human
gagggagtgatgatgacccc

SEQ ID NO: 23695 - DNA, 20 bp, human
gttttgcgaagtgggctcgt

SEQ ID NO: 23696 - DNA, 20 bp, human
gcggcagcgtgcattgttgt

SEQ ID NO: 23697 - DNA, 20 bp, human
gggctgtgtactagtagggt

SEQ ID NO: 23698 - DNA, 20 bp, human
gttgtgggctgtgtactagt

SEQ ID NO: 23699 - DNA, 20 bp, human
gcttccggccggttgcttag

SEQ ID NO: 23700 - DNA, 20 bp, human
gcgtgacatcaggaggaggt

SEQ ID NO: 23701 - DNA, 20 bp, human
gtagcactccgagtccgtca

SEQ ID NO: 23702 - DNA, 20 bp, human
gcagcccctaagcaaccggc

SEQ ID NO: 23703 - DNA, 20 bp, human
ggtttttgttcagggaccag

SEQ ID NO: 23704 - DNA, 20 bp, human
gctgatgtcacggaaatgaa

SEQ ID NO: 23705 - DNA, 20 bp, human
gggtggggccgacttccggc

SEQ ID NO: 23706 - DNA, 20 bp, human
gagcccctggcaacaccgaa

SEQ ID NO: 23707 - DNA, 20 bp, human
gacacacgcggcttcctccg

SEQ ID NO: 23708 - DNA, 20 bp, human
gaaccagggaagcctcgatg

SEQ ID NO: 23709 - DNA, 20 bp, human
ggtgccctgcgagctcccac

SEQ ID NO: 23710 - DNA, 20 bp, human
ggcaggcgcaaagcagtagt

SEQ ID NO: 23711 - DNA, 20 bp, human
gcggctgggcgggagaagct

SEQ ID NO: 23712 - DNA, 20 bp, human
gcctgcccaggccaccgggt

SEQ ID NO: 23713 - DNA, 20 bp, human
ggaccccatcgaggcttccc

SEQ ID NO: 23714 - DNA, 20 bp, human
gcgcccagccgcccacccgg

SEQ ID NO: 23715 - DNA, 20 bp, human
gtctctggggcatcgaagtg

SEQ ID NO: 23716 - DNA, 20 bp, human
gagattggaagtccctgcta

SEQ ID NO: 23717 - DNA, 20 bp, human
gatccccagctctggcacaa

SEQ ID NO: 23718 - DNA, 20 bp, human
gctagtacacaaacccagga

SEQ ID NO: 23719 - DNA, 20 bp, human
gagagacagagccccctctg

SEQ ID NO: 23720 - DNA, 20 bp, human
gggactctccttccacagag

SEQ ID NO: 23721 - DNA, 20 bp, human
gccaactagtacacaaaccc

SEQ ID NO: 23722 - DNA, 20 bp, human
gggctctgtctctgagagat

SEQ ID NO: 23723 - DNA, 20 bp, human
gggtcagctcagtgactaca

SEQ ID NO: 23724 - DNA, 20 bp, human
gttctctcaaggtataccca

SEQ ID NO: 23725 - DNA, 20 bp, human
gattgccagccatactgcag

SEQ ID NO: 23726 - DNA, 20 bp, human
ggactatgggtcccaggtgg

SEQ ID NO: 23727 - DNA, 20 bp, human
ggggcgccgagccagactat

SEQ ID NO: 23728 - DNA, 20 bp, human
gagcgcgggcggtccagtca

SEQ ID NO: 23729 - DNA, 20 bp, human
gtcgttcccccccccgccgg

SEQ ID NO: 23730 - DNA, 20 bp, human
gccgcttctgcagccaccgg

SEQ ID NO: 23731 - DNA, 20 bp, human
gcactgcagcggggatggag

SEQ ID NO: 23732 - DNA, 20 bp, human
gcagaagcggcgaaggcctc

SEQ ID NO: 23733 - DNA, 20 bp, human
gtcgccgcttctgcagccac

SEQ ID NO: 23734 - DNA, 20 bp, human
ggggaaggacgcggagacag

SEQ ID NO: 23735 - DNA, 20 bp, human
gtctggctcggcgccctggg

SEQ ID NO: 23736 - DNA, 20 bp, human
gggtcagacgggaaaaaggg

SEQ ID NO: 23737 - DNA, 20 bp, human
ggaaattgtcactaaactat

SEQ ID NO: 23738 - DNA, 20 bp, human
gtggggtcagacgggaaaaa

SEQ ID NO: 23739 - DNA, 20 bp, human
gaatgggggacccaaactcc

SEQ ID NO: 23740 - DNA, 20 bp, human
gggcttaactgccaaaataa

SEQ ID NO: 23741 - DNA, 20 bp, human
gcaggtggtactaaagcctt

SEQ ID NO: 23742 - DNA, 20 bp, human
gtggattttagggattggtc

SEQ ID NO: 23743 - DNA, 20 bp, human
gaaaggggggaaaatccgga

SEQ ID NO: 23744 - DNA, 20 bp, human
gatcccttttctaaaaaggg

SEQ ID NO: 23745 - DNA, 20 bp, human
gccaatccctaaaatccatc

SEQ ID NO: 23746 - DNA, 20 bp, human
gtagtggtgagtacagccca

SEQ ID NO: 23747 - DNA, 20 bp, human
gggtctgcgccagccgatga

SEQ ID NO: 23748 - DNA, 20 bp, human
gaggtgtatcaatccctcat

SEQ ID NO: 23749 - DNA, 20 bp, human
gcatttcctaagtttaacag

SEQ ID NO: 23750 - DNA, 20 bp, human
gagacatcaactgtcagctt

SEQ ID NO: 23751 - DNA, 20 bp, human
gacagttgatgtctaaccct

SEQ ID NO: 23752 - DNA, 20 bp, human
gtagttcctctgttaaactt

SEQ ID NO: 23753 - DNA, 20 bp, human
gcatcaacgactgtggaatt

SEQ ID NO: 23754 - DNA, 20 bp, human
gaacttaggaaatggatggc

SEQ ID NO: 23755 - DNA, 20 bp, human
gcgactgtggaattgggtct

SEQ ID NO: 23756 - DNA, 20 bp, human
ggcgcggcgaggctgtcaca

SEQ ID NO: 23757 - DNA, 20 bp, human
gtccgcgctgggatagaggg

SEQ ID NO: 23758 - DNA, 20 bp, human
gggccccagtcactcacatg

SEQ ID NO: 23759 - DNA, 20 bp, human
gggatccgcgctgggataga

SEQ ID NO: 23760 - DNA, 20 bp, human
gggatagagggtggtagcag

SEQ ID NO: 23761 - DNA, 20 bp, human
gtgcggggctcgcgcccctc

SEQ ID NO: 23762 - DNA, 20 bp, human
gcgtcaaaagggcagaaatc

SEQ ID NO: 23763 - DNA, 20 bp, human
gaccccgggggagctgccag

SEQ ID NO: 23764 - DNA, 20 bp, human
gccccgcatgtgagtgactg

SEQ ID NO: 23765 - DNA, 20 bp, human
ggcgcgaggatgtcagagac

SEQ ID NO: 23766 - DNA, 20 bp, human
gacgccctcggacgacgctg

SEQ ID NO: 23767 - DNA, 20 bp, human
gacgcaggcgatcacgccct

SEQ ID NO: 23768 - DNA, 20 bp, human
gccatggcgtgtgcttgtaa

SEQ ID NO: 23769 - DNA, 20 bp, human
gcaacggttccctcttcgga

SEQ ID NO: 23770 - DNA, 20 bp, human
ggtcgcacccgcgtctccag

SEQ ID NO: 23771 - DNA, 20 bp, human
gtgacctgagctgtaggagg

SEQ ID NO: 23772 - DNA, 20 bp, human
ggctaaaacccaggtgtgta

SEQ ID NO: 23773 - DNA, 20 bp, human
gagtccgcagcgtcgtccga

SEQ ID NO: 23774 - DNA, 20 bp, human
gatcgcttcactcttctcaa

SEQ ID NO: 23775 - DNA, 20 bp, human
ggtgttcagcgtcacagact

SEQ ID NO: 23776 - DNA, 20 bp, human
gacttacccggcccttacag

SEQ ID NO: 23777 - DNA, 20 bp, human
gaggaagatttcctctgtaa

SEQ ID NO: 23778 - DNA, 20 bp, human
gctgctgttgaaaacttacc

SEQ ID NO: 23779 - DNA, 20 bp, human
gagatttcctctgtaagggc

SEQ ID NO: 23780 - DNA, 20 bp, human
gagtactattgttatttctt

SEQ ID NO: 23781 - DNA, 20 bp, human
gtccctgctctagattatct

SEQ ID NO: 23782 - DNA, 20 bp, human
gtatcttgtggtgaaattat

SEQ ID NO: 23783 - DNA, 20 bp, human
gtgccaagataatctagagc

SEQ ID NO: 23784 - DNA, 20 bp, human
gtcaccacaagataagaaaa

SEQ ID NO: 23785 - DNA, 20 bp, human
gtatcttttcaaatgaacgg

SEQ ID NO: 23786 - DNA, 20 bp, human
gatgctggcgacgctggcga

SEQ ID NO: 23787 - DNA, 20 bp, human
ggcatcgcgtgcgtctcaga

SEQ ID NO: 23788 - DNA, 20 bp, human
gcgcccgaggaggcaagctg

SEQ ID NO: 23789 - DNA, 20 bp, human
gtctcagatggcatcggtcc

SEQ ID NO: 23790 - DNA, 20 bp, human
gcgtgcgtctcagatggcat

SEQ ID NO: 23791 - DNA, 20 bp, human
gacttggcggacgaaaggac

SEQ ID NO: 23792 - DNA, 20 bp, human
gcacgcgatgctggcgacgc

SEQ ID NO: 23793 - DNA, 20 bp, human
ggccctgaggagagcaatta

SEQ ID NO: 23794 - DNA, 20 bp, human
gacgggacagaggcgaccct

SEQ ID NO: 23795 - DNA, 20 bp, human
gcggccgcaggcccacggaa

SEQ ID NO: 23796 - DNA, 20 bp, human
gccgccgggaaatctcaacc

SEQ ID NO: 23797 - DNA, 20 bp, human
gtcgctccccggctcctcac

SEQ ID NO: 23798 - DNA, 20 bp, human
gccagcgcaggtcgccgggt

SEQ ID NO: 23799 - DNA, 20 bp, human
gatgcaggaggtgcccgagg

SEQ ID NO: 23800 - DNA, 20 bp, human
gccccgctcgaacgccgagg

SEQ ID NO: 23801 - DNA, 20 bp, human
gccaccccgctcgaacgccg

SEQ ID NO: 23802 - DNA, 20 bp, human
gccaaggctgcaacccgcgg

SEQ ID NO: 23803 - DNA, 20 bp, human
ggcgcgtgcacgcagaggcc

SEQ ID NO: 23804 - DNA, 20 bp, human
ggtgcaagcggccccagcgc

SEQ ID NO: 23805 - DNA, 20 bp, human
ggagcggggcgcctcttctg

SEQ ID NO: 23806 - DNA, 20 bp, human
ggcgcccgaaggtccgactg

SEQ ID NO: 23807 - DNA, 20 bp, human
gccgaacagcggccgaatgc

SEQ ID NO: 23808 - DNA, 20 bp, human
gccgccgcgcagccgaacag

SEQ ID NO: 23809 - DNA, 20 bp, human
gcgaatgccgggcacggaga

SEQ ID NO: 23810 - DNA, 20 bp, human
gcacgccccgcagactggac

SEQ ID NO: 23811 - DNA, 20 bp, human
gggcgccgcagtcggacctt

SEQ ID NO: 23812 - DNA, 20 bp, human
gacagcccaacagacctcta

SEQ ID NO: 23813 - DNA, 20 bp, human
gggtgcggcctgagacggtc

SEQ ID NO: 23814 - DNA, 20 bp, human
gccgggaacccgaccgtctc

SEQ ID NO: 23815 - DNA, 20 bp, human
gcccaaggtgcggcctgaga

SEQ ID NO: 23816 - DNA, 20 bp, human
gctccaccgggccgtaggtg

SEQ ID NO: 23817 - DNA, 20 bp, human
gaggtatgtccagacccccg

SEQ ID NO: 23818 - DNA, 20 bp, human
gccaagtccgagagagaggt

SEQ ID NO: 23819 - DNA, 20 bp, human
gggtcgaggccgagcctcac

SEQ ID NO: 23820 - DNA, 20 bp, human
gcctgcaagcggtgcctcgg

SEQ ID NO: 23821 - DNA, 20 bp, human
ggcccctctcgcctccgacc

SEQ ID NO: 23822 - DNA, 20 bp, human
gcagcccagcgctacgggac

SEQ ID NO: 23823 - DNA, 20 bp, human
gctgggaccaagggtgccag

SEQ ID NO: 23824 - DNA, 20 bp, human
gggagtgcgaggcgccgggt

SEQ ID NO: 23825 - DNA, 20 bp, human
gggaaaccagcccagcgcta

SEQ ID NO: 23826 - DNA, 20 bp, human
ggatccccagggtcagtagg

SEQ ID NO: 23827 - DNA, 20 bp, human
gtcgctcctgaccactggat

SEQ ID NO: 23828 - DNA, 20 bp, human
ggcgcctcgctcctgaccac

SEQ ID NO: 23829 - DNA, 20 bp, human
gtatggtgatgccaatccag

SEQ ID NO: 23830 - DNA, 20 bp, human
gtatgccacgggaagacata

SEQ ID NO: 23831 - DNA, 20 bp, human
gactcaggcgaaggtcaatc

SEQ ID NO: 23832 - DNA, 20 bp, human
ggaatcctcctactgaccct

SEQ ID NO: 23833 - DNA, 20 bp, human
gtccggcgccttgccccact

SEQ ID NO: 23834 - DNA, 20 bp, human
ggaccttcgcctgagtggga

SEQ ID NO: 23835 - DNA, 20 bp, human
gacctggaccgcccctaacg

SEQ ID NO: 23836 - DNA, 20 bp, human
ggcggccaaaggcagtgggt

SEQ ID NO: 23837 - DNA, 20 bp, human
gctagggtgagacctgacat

SEQ ID NO: 23838 - DNA, 20 bp, human
gtaagggccaggacaggaat

SEQ ID NO: 23839 - DNA, 20 bp, human
gaatagtgtcggctcaccat

SEQ ID NO: 23840 - DNA, 20 bp, human
ggagcccaggccccaaagat

SEQ ID NO: 23841 - DNA, 20 bp, human
gaggccccaggtcactgatg

SEQ ID NO: 23842 - DNA, 20 bp, human
ggaggtgcacggatcctgct

SEQ ID NO: 23843 - DNA, 20 bp, human
gtgtgaagtcagaggtccta

SEQ ID NO: 23844 - DNA, 20 bp, human
ggaaaacaccctcttcaggt

SEQ ID NO: 23845 - DNA, 20 bp, human
gaagtcagaggtcctatgga

SEQ ID NO: 23846 - DNA, 20 bp, human
gcgcccaccgggccccaccc

SEQ ID NO: 23847 - DNA, 20 bp, human
ggcccaccgcgcgggagctc

SEQ ID NO: 23848 - DNA, 20 bp, human
gggcggtgggcgcagagtgg

SEQ ID NO: 23849 - DNA, 20 bp, human
gctgcgttcggtctcctcgg

SEQ ID NO: 23850 - DNA, 20 bp, human
gtagaaggagacgccggggt

SEQ ID NO: 23851 - DNA, 20 bp, human
gagggcgcctaggagcggga

SEQ ID NO: 23852 - DNA, 20 bp, human
gccggccgcgccaaccccca

SEQ ID NO: 23853 - DNA, 20 bp, human
gatgagctcgaagggcgtgt

SEQ ID NO: 23854 - DNA, 20 bp, human
gcggtggcgatgagctcgaa

SEQ ID NO: 23855 - DNA, 20 bp, human
gaaggcgcccggaggatccg

SEQ ID NO: 23856 - DNA, 20 bp, human
gacgaacccgaaccgagacc

SEQ ID NO: 23857 - DNA, 20 bp, human
ggggtactgagccgaatgac

SEQ ID NO: 23858 - DNA, 20 bp, human
gggagagaccggcccggtcc

SEQ ID NO: 23859 - DNA, 20 bp, human
gcgaatgactggagagaaac

SEQ ID NO: 23860 - DNA, 20 bp, human
gcggcccggtcccggcaccg

SEQ ID NO: 23861 - DNA, 20 bp, human
ggcgctgaccgaggccaggg

SEQ ID NO: 23862 - DNA, 20 bp, human
gctgccagctccgcgcgcgg

SEQ ID NO: 23863 - DNA, 20 bp, human
gtagtcgcactgggactcca

SEQ ID NO: 23864 - DNA, 20 bp, human
ggcgctgccgggtctcggtt

SEQ ID NO: 23865 - DNA, 20 bp, human
gccggcgctgaccgaggcca

SEQ ID NO: 23866 - DNA, 20 bp, human
ggcctggcgcccaaactctg

SEQ ID NO: 23867 - DNA, 20 bp, human
ggtttgggcgccaggcgaga

SEQ ID NO: 23868 - DNA, 20 bp, human
ggtaccggcccgcagaggga

SEQ ID NO: 23869 - DNA, 20 bp, human
gggcgccaggcgagacggca

SEQ ID NO: 23870 - DNA, 20 bp, human
ggcgcggtgccccagagacc

SEQ ID NO: 23871 - DNA, 20 bp, human
gccctgcctgggcagaatgg

SEQ ID NO: 23872 - DNA, 20 bp, human
gtcccagccgctccctgcct

SEQ ID NO: 23873 - DNA, 20 bp, human
gacgccgggcagggctgcaa

SEQ ID NO: 23874 - DNA, 20 bp, human
gcgctctggaagctaagaag

SEQ ID NO: 23875 - DNA, 20 bp, human
ggggagggcgggctgtgaac

SEQ ID NO: 23876 - DNA, 20 bp, human
gcgggactaacgcttacctg

SEQ ID NO: 23877 - DNA, 20 bp, human
gacgcttaggtgggcgacgt

SEQ ID NO: 23878 - DNA, 20 bp, human
ggggagctgaaagcctcgga

SEQ ID NO: 23879 - DNA, 20 bp, human
gggcgcgggtccctgccgga

SEQ ID NO: 23880 - DNA, 20 bp, human
gccgcgctgagttaacccag

SEQ ID NO: 23881 - DNA, 20 bp, human
gcagctgttcacgcttaggt

SEQ ID NO: 23882 - DNA, 20 bp, human
gagcgtgaacagctgcgtcg

SEQ ID NO: 23883 - DNA, 20 bp, human
gcctaggtttcaggccgtca

SEQ ID NO: 23884 - DNA, 20 bp, human
gggctccgcactcctgaagg

SEQ ID NO: 23885 - DNA, 20 bp, human
gggaggctccgcactcctga

SEQ ID NO: 23886 - DNA, 20 bp, human
gggacctgcggctcagacaa

SEQ ID NO: 23887 - DNA, 20 bp, human
gcggctcagacaaaggacat

SEQ ID NO: 23888 - DNA, 20 bp, human
gcgttcaacgtccggagcat

SEQ ID NO: 23889 - DNA, 20 bp, human
gagcatcggtgcagtttcga

SEQ ID NO: 23890 - DNA, 20 bp, human
ggacctctaacccagaacaa

SEQ ID NO: 23891 - DNA, 20 bp, human
ggtcagaaccagggctccgt

SEQ ID NO: 23892 - DNA, 20 bp, human
ggtccacatcaccgcgccaa

SEQ ID NO: 23893 - DNA, 20 bp, human
gcacctagcgcccacgtgag

SEQ ID NO: 23894 - DNA, 20 bp, human
gttattaatcgaaggcccag

SEQ ID NO: 23895 - DNA, 20 bp, human
ggtcacaggccaccccagat

SEQ ID NO: 23896 - DNA, 20 bp, human
gggcgtcagagcttgagggg

SEQ ID NO: 23897 - DNA, 20 bp, human
gcgatgctggaccagttgat

SEQ ID NO: 23898 - DNA, 20 bp, human
ggagcggcgtcagagcttga

SEQ ID NO: 23899 - DNA, 20 bp, human
gggacggtaagtctctgcca

SEQ ID NO: 23900 - DNA, 20 bp, human
gcttgggacagaagcgacac

SEQ ID NO: 23901 - DNA, 20 bp, human
gagagacttaccgtcccggg

SEQ ID NO: 23902 - DNA, 20 bp, human
gacggggacggcgaagggaa

SEQ ID NO: 23903 - DNA, 20 bp, human
gtggcgggtggcggtgttga

SEQ ID NO: 23904 - DNA, 20 bp, human
gcgaagggaaggggttccga

SEQ ID NO: 23905 - DNA, 20 bp, human
gctttccgcacgcctcgagg

SEQ ID NO: 23906 - DNA, 20 bp, human
ggctccccgcgggtctccgt

SEQ ID NO: 23907 - DNA, 20 bp, human
ggcacgccgggtagacagca

SEQ ID NO: 23908 - DNA, 20 bp, human
gagcagggcacgtccacaca

SEQ ID NO: 23909 - DNA, 20 bp, human
gggacacagcaagtacagag

SEQ ID NO: 23910 - DNA, 20 bp, human
gcaaggcccgggaccacagt

SEQ ID NO: 23911 - DNA, 20 bp, human
gcggcgttggagtttttaca

SEQ ID NO: 23912 - DNA, 20 bp, human
ggtgcgtgcggggcacacag

SEQ ID NO: 23913 - DNA, 20 bp, human
ggcacccacggagacccgcg

SEQ ID NO: 23914 - DNA, 20 bp, human
gctgggagtttgggtttggt

SEQ ID NO: 23915 - DNA, 20 bp, human
gaggctcaccagctccccgc

SEQ ID NO: 23916 - DNA, 20 bp, human
gtaggaggagggagctgcgg

SEQ ID NO: 23917 - DNA, 20 bp, human
gctggtctgagccccctagt

SEQ ID NO: 23918 - DNA, 20 bp, human
ggcgcgtctgatgccgacta

SEQ ID NO: 23919 - DNA, 20 bp, human
gggcctagaactctcccgaa

SEQ ID NO: 23920 - DNA, 20 bp, human
gtaccccacctcctccatct

SEQ ID NO: 23921 - DNA, 20 bp, human
gtccatctggggagcgtctg

SEQ ID NO: 23922 - DNA, 20 bp, human
gtgtggtgaagagcgtccac

SEQ ID NO: 23923 - DNA, 20 bp, human
gtggagcaggagaagctctc

SEQ ID NO: 23924 - DNA, 20 bp, human
gatctggggagcgtctgcgg

SEQ ID NO: 23925 - DNA, 20 bp, human
ggagagttctaggcctgtaa

SEQ ID NO: 23926 - DNA, 20 bp, human
gcagggagaggagtcgaagt

SEQ ID NO: 23927 - DNA, 20 bp, human
gagggaacccacgcagtaag

SEQ ID NO: 23928 - DNA, 20 bp, human
gggcctgtggccaaacaaga

SEQ ID NO: 23929 - DNA, 20 bp, human
gccaagcccgtctaacccat

SEQ ID NO: 23930 - DNA, 20 bp, human
ggtggccaaacaagatggag

SEQ ID NO: 23931 - DNA, 20 bp, human
gccggtgaccacctcttgag

SEQ ID NO: 23932 - DNA, 20 bp, human
gttcttccgatgggttagac

SEQ ID NO: 23933 - DNA, 20 bp, human
gtaggtgagaacctacagtg

SEQ ID NO: 23934 - DNA, 20 bp, human
ggcagagctagcatttggta

SEQ ID NO: 23935 - DNA, 20 bp, human
gaggtctgggattcattgcc

SEQ ID NO: 23936 - DNA, 20 bp, human
gggacagctgagaacaccag

SEQ ID NO: 23937 - DNA, 20 bp, human
ggcctgatggaggacaagta

SEQ ID NO: 23938 - DNA, 20 bp, human
gcaagtagggcctcgaggac

SEQ ID NO: 23939 - DNA, 20 bp, human
ggaggacaagtagggcctcg

SEQ ID NO: 23940 - DNA, 20 bp, human
ggctgagaacaccagaggac

SEQ ID NO: 23941 - DNA, 20 bp, human
gctggcagttgggagcctga

SEQ ID NO: 23942 - DNA, 20 bp, human
ggccctacttgtcctccatc

SEQ ID NO: 23943 - DNA, 20 bp, human
gtgtcacgcacctgtcctcg

SEQ ID NO: 23944 - DNA, 20 bp, human
gaaggttacataagctaatt

SEQ ID NO: 23945 - DNA, 20 bp, human
ggaaaaatggtaagttgacc

SEQ ID NO: 23946 - DNA, 20 bp, human
ggaggtctgggtcaactggg

SEQ ID NO: 23947 - DNA, 20 bp, human
gacaaccggcccgggatcag

SEQ ID NO: 23948 - DNA, 20 bp, human
ggtctgggtcaactgggggg

SEQ ID NO: 23949 - DNA, 20 bp, human
gtcagaggtctgggtcaact

SEQ ID NO: 23950 - DNA, 20 bp, human
gagacggggtccagacctgg

SEQ ID NO: 23951 - DNA, 20 bp, human
ggtggtgacggaggacgatg

SEQ ID NO: 23952 - DNA, 20 bp, human
gcagacctctgatcccgggc

SEQ ID NO: 23953 - DNA, 20 bp, human
gggagtgaagtctcgagacg

SEQ ID NO: 23954 - DNA, 20 bp, human
ggggcggcagcggcgctaag

SEQ ID NO: 23955 - DNA, 20 bp, human
gcccttgccacccccaggtc

SEQ ID NO: 23956 - DNA, 20 bp, human
gtttggcagacgagtcaccc

SEQ ID NO: 23957 - DNA, 20 bp, human
ggagagtccacagaatgtca

SEQ ID NO: 23958 - DNA, 20 bp, human
gctggccatgtcttacacaa

SEQ ID NO: 23959 - DNA, 20 bp, human
ggacgagtcacccgggcagt

SEQ ID NO: 23960 - DNA, 20 bp, human
gcttcgagaccccagatgtt

SEQ ID NO: 23961 - DNA, 20 bp, human
gaacagaaggaagacggctc

SEQ ID NO: 23962 - DNA, 20 bp, human
gttccttctgttgactctgt

SEQ ID NO: 23963 - DNA, 20 bp, human
gcaaatgcaagaatcgaatg

SEQ ID NO: 23964 - DNA, 20 bp, human
ggaaggaagacggctctggc

SEQ ID NO: 23965 - DNA, 20 bp, human
gactcgagaagtgattactt

SEQ ID NO: 23966 - DNA, 20 bp, human
gggtgccacgtctcacagta

SEQ ID NO: 23967 - DNA, 20 bp, human
gggtgccctactgtgagacg

SEQ ID NO: 23968 - DNA, 20 bp, human
ggagactgaatgctgatcaa

SEQ ID NO: 23969 - DNA, 20 bp, human
ggttgagaaagaccatcact

SEQ ID NO: 23970 - DNA, 20 bp, human
gggcataaaaacacttgaga

SEQ ID NO: 23971 - DNA, 20 bp, human
ggctcaatatcgtcacatga

SEQ ID NO: 23972 - DNA, 20 bp, human
gtataaaccttgcaaaatga

SEQ ID NO: 23973 - DNA, 20 bp, human
gctgacatcactggatgcaa

SEQ ID NO: 23974 - DNA, 20 bp, human
gcactggatgcaatgggtcc

SEQ ID NO: 23975 - DNA, 20 bp, human
gtcaggctcattcctcaaca

SEQ ID NO: 23976 - DNA, 20 bp, human
gaagcaaatgactaactcag

SEQ ID NO: 23977 - DNA, 20 bp, human
gacagcatgtctgtgtcctg

SEQ ID NO: 23978 - DNA, 20 bp, human
gttgggaggcctcaggttca

SEQ ID NO: 23979 - DNA, 20 bp, human
gggatatagtgagttaaggc

SEQ ID NO: 23980 - DNA, 20 bp, human
gagatctgatcatttataat

SEQ ID NO: 23981 - DNA, 20 bp, human
ggttggaaagacagagttta

SEQ ID NO: 23982 - DNA, 20 bp, human
ggaagtttgggtttgatagc

SEQ ID NO: 23983 - DNA, 20 bp, human
gaactcaagtaatgcaccta

SEQ ID NO: 23984 - DNA, 20 bp, human
gttatagtgacctgtacagt

SEQ ID NO: 23985 - DNA, 20 bp, human
gtattcagtgtgcaaacgcc

SEQ ID NO: 23986 - DNA, 20 bp, human
gcgctgctgccacgtcgcaa

SEQ ID NO: 23987 - DNA, 20 bp, human
gccccacctatgctccaagg

SEQ ID NO: 23988 - DNA, 20 bp, human
ggaggggaccatcacgatgt

SEQ ID NO: 23989 - DNA, 20 bp, human
ggaatctccaccatcaccag

SEQ ID NO: 23990 - DNA, 20 bp, human
gatcgtgatggtcccctcat

SEQ ID NO: 23991 - DNA, 20 bp, human
gggtagccctgggcctatga

SEQ ID NO: 23992 - DNA, 20 bp, human
ggatccccacctatgctcca

SEQ ID NO: 23993 - DNA, 20 bp, human
gcccctgctgggtatggatg

SEQ ID NO: 23994 - DNA, 20 bp, human
gaggcccagggctaccacct

SEQ ID NO: 23995 - DNA, 20 bp, human
gaccaccttggagcataggt

SEQ ID NO: 23996 - DNA, 20 bp, human
gctccaccaaaggaagaata

SEQ ID NO: 23997 - DNA, 20 bp, human
gtagtctggcaaaactgaag

SEQ ID NO: 23998 - DNA, 20 bp, human
ggacacagctttctaaatgt

SEQ ID NO: 23999 - DNA, 20 bp, human
gaatgaaggaacatgacata

SEQ ID NO: 24000 - DNA, 20 bp, human
gcattgccctattcttcctt

SEQ ID NO: 24001 - DNA, 20 bp, human
gttgagaacagacataacta

SEQ ID NO: 24002 - DNA, 20 bp, human
ggcaaaactgaagggggata

SEQ ID NO: 24003 - DNA, 20 bp, human
ggaacagacataactatggc

SEQ ID NO: 24004 - DNA, 20 bp, human
ggatcatgtaaatgatagtc

SEQ ID NO: 24005 - DNA, 20 bp, human
ggcccatatggtgggggata

SEQ ID NO: 24006 - DNA, 20 bp, human
gtggggaggtaggctcggac

SEQ ID NO: 24007 - DNA, 20 bp, human
gcccccgcgcatggggaggt

SEQ ID NO: 24008 - DNA, 20 bp, human
gccggccggcgaccatgtaa

SEQ ID NO: 24009 - DNA, 20 bp, human
gggactacgaaaagtcatca

SEQ ID NO: 24010 - DNA, 20 bp, human
gagctccactcaccaggaac

SEQ ID NO: 24011 - DNA, 20 bp, human
gtgacccggaagtcgacgag

SEQ ID NO: 24012 - DNA, 20 bp, human
ggccccccccgcgcatgggg

SEQ ID NO: 24013 - DNA, 20 bp, human
ggccctgcgaggcgacgacc

SEQ ID NO: 24014 - DNA, 20 bp, human
gctccacagcagggaccggc

SEQ ID NO: 24015 - DNA, 20 bp, human
ggatggctgcagaaaaatat

SEQ ID NO: 24016 - DNA, 20 bp, human
gggtcagcaacagaatacac

SEQ ID NO: 24017 - DNA, 20 bp, human
gctcctacaaaaggtaatca

SEQ ID NO: 24018 - DNA, 20 bp, human
gttctgttgctgaccatcca

SEQ ID NO: 24019 - DNA, 20 bp, human
gacatgcaggctctccaaaa

SEQ ID NO: 24020 - DNA, 20 bp, human
ggtccttggaggttataatg

SEQ ID NO: 24021 - DNA, 20 bp, human
gagccctgattaccttttgt

SEQ ID NO: 24022 - DNA, 20 bp, human
ggtttaacaactcactaaat

SEQ ID NO: 24023 - DNA, 20 bp, human
gatttggcatctgagagctc

SEQ ID NO: 24024 - DNA, 20 bp, human
gcagcatttgatcaatgctt

SEQ ID NO: 24025 - DNA, 20 bp, human
ggctgagaaaaaagttgtag

SEQ ID NO: 24026 - DNA, 20 bp, human
gtggagtaaaagatgtctac

SEQ ID NO: 24027 - DNA, 20 bp, human
gtcagggtaaatcatctcat

SEQ ID NO: 24028 - DNA, 20 bp, human
ggtaaaagatgtctacaggc

SEQ ID NO: 24029 - DNA, 20 bp, human
gccttcaaggtaatatagtg

SEQ ID NO: 24030 - DNA, 20 bp, human
gcagcctggggtaactgcac

SEQ ID NO: 24031 - DNA, 20 bp, human
ggagaaggtgaaccagtaag

SEQ ID NO: 24032 - DNA, 20 bp, human
gagacatatggcccacttac

SEQ ID NO: 24033 - DNA, 20 bp, human
gcgtgcacttggagtcaaat

SEQ ID NO: 24034 - DNA, 20 bp, human
gggggtaactgcacaggaga

SEQ ID NO: 24035 - DNA, 20 bp, human
gctactcctgtggaggagga

SEQ ID NO: 24036 - DNA, 20 bp, human
gatgggtctagcagcctctg

SEQ ID NO: 24037 - DNA, 20 bp, human
gacagtggcactcacagcac

SEQ ID NO: 24038 - DNA, 20 bp, human
ggtgacaggagatgccacag

SEQ ID NO: 24039 - DNA, 20 bp, human
gcacagcacaggcttgttat

SEQ ID NO: 24040 - DNA, 20 bp, human
gttcataaagaatcacacgg

SEQ ID NO: 24041 - DNA, 20 bp, human
gggcaaactgagacagccca

SEQ ID NO: 24042 - DNA, 20 bp, human
gagagatggtcagcatcatg

SEQ ID NO: 24043 - DNA, 20 bp, human
gagagaagaaatagctccac

SEQ ID NO: 24044 - DNA, 20 bp, human
gtaggcatgcaacaaagaga

SEQ ID NO: 24045 - DNA, 20 bp, human
ggttcctgtaagaaactgac

SEQ ID NO: 24046 - DNA, 20 bp, human
gagagggtcgcagtcccagg

SEQ ID NO: 24047 - DNA, 20 bp, human
gactctgtcctgggacttgg

SEQ ID NO: 24048 - DNA, 20 bp, human
gagaccatgggagaactcga

SEQ ID NO: 24049 - DNA, 20 bp, human
ggacttggtggtgctaccct

SEQ ID NO: 24050 - DNA, 20 bp, human
ggagaactcgagggcactgt

SEQ ID NO: 24051 - DNA, 20 bp, human
ggccaggagcagagtcaaga

SEQ ID NO: 24052 - DNA, 20 bp, human
gcaaactgggggcagaccat

SEQ ID NO: 24053 - DNA, 20 bp, human
gtcaagagggtcgcagtccc

SEQ ID NO: 24054 - DNA, 20 bp, human
ggtgccctcgagttctccca

SEQ ID NO: 24055 - DNA, 20 bp, human
gactcgagggcactgtggga

SEQ ID NO: 24056 - DNA, 20 bp, human
gcccatcacggacctaccac

SEQ ID NO: 24057 - DNA, 20 bp, human
gaggctgcaccacatacgca

SEQ ID NO: 24058 - DNA, 20 bp, human
ggccagtggtaggtccgtga

SEQ ID NO: 24059 - DNA, 20 bp, human
gaaatataaggtgtgctcag

SEQ ID NO: 24060 - DNA, 20 bp, human
gtggcatccgtaccttccat

SEQ ID NO: 24061 - DNA, 20 bp, human
gttgaaagaaccagttctta

SEQ ID NO: 24062 - DNA, 20 bp, human
gttcttgggtgctttctcac

SEQ ID NO: 24063 - DNA, 20 bp, human
gtttctcacgggtaaagcca

SEQ ID NO: 24064 - DNA, 20 bp, human
gctcttcaatccctaagaac

SEQ ID NO: 24065 - DNA, 20 bp, human
gccatctaaaacagacctaa

SEQ ID NO: 24066 - DNA, 20 bp, human
gtgaggagtcccgtgccggg

SEQ ID NO: 24067 - DNA, 20 bp, human
gccccagatgccaaaggaca

SEQ ID NO: 24068 - DNA, 20 bp, human
gatgccaaaggacaaggtga

SEQ ID NO: 24069 - DNA, 20 bp, human
gaagcatgcgtggtatcaag

SEQ ID NO: 24070 - DNA, 20 bp, human
ggttgtgaggagtcccgtgc

SEQ ID NO: 24071 - DNA, 20 bp, human
ggtgagcccctgccctgtca

SEQ ID NO: 24072 - DNA, 20 bp, human
ggcctggggactgtcctctc

SEQ ID NO: 24073 - DNA, 20 bp, human
gggtatcaagaggtgcattg

SEQ ID NO: 24074 - DNA, 20 bp, human
gcacgctcgggggacccaca

SEQ ID NO: 24075 - DNA, 20 bp, human
gtcactggtcccccacgctc

SEQ ID NO: 24076 - DNA, 20 bp, human
gtggcgactgcggcgcatgg

SEQ ID NO: 24077 - DNA, 20 bp, human
gcgcatggcggtgagcggtg

SEQ ID NO: 24078 - DNA, 20 bp, human
gtgcggcgcatggcggtgag

SEQ ID NO: 24079 - DNA, 20 bp, human
ggcgccccgcgtagttccgg

SEQ ID NO: 24080 - DNA, 20 bp, human
gcgggaagggtggaatccac

SEQ ID NO: 24081 - DNA, 20 bp, human
ggtagttccggtggcgactg

SEQ ID NO: 24082 - DNA, 20 bp, human
gtccacgggtgcgaatccac

SEQ ID NO: 24083 - DNA, 20 bp, human
gcttaggggaacttcttctg

SEQ ID NO: 24084 - DNA, 20 bp, human
gggcgggcttcggtcgggaa

SEQ ID NO: 24085 - DNA, 20 bp, human
gtcgccaccggaactacgcg

SEQ ID NO: 24086 - DNA, 20 bp, human
gtgcggagagcggcgagggt

SEQ ID NO: 24087 - DNA, 20 bp, human
ggccaactcagacaactccg

SEQ ID NO: 24088 - DNA, 20 bp, human
gcccagtccgggtaaaagga

SEQ ID NO: 24089 - DNA, 20 bp, human
gggcgcagtggggaaattcg

SEQ ID NO: 24090 - DNA, 20 bp, human
gttgaggtaaggcgctgtgg

SEQ ID NO: 24091 - DNA, 20 bp, human
gagcgccttacctcaaacag

SEQ ID NO: 24092 - DNA, 20 bp, human
gcagacaactccgaggcgag

SEQ ID NO: 24093 - DNA, 20 bp, human
gggagggttgtccccagcgg

SEQ ID NO: 24094 - DNA, 20 bp, human
ggcggcagcagcaggaatca

SEQ ID NO: 24095 - DNA, 20 bp, human
ggacgccatggggaacagat

SEQ ID NO: 24096 - DNA, 20 bp, human
ggccaggcgattcaagatgg

SEQ ID NO: 24097 - DNA, 20 bp, human
ggagtctgcgctgagtgaag

SEQ ID NO: 24098 - DNA, 20 bp, human
gcggcggaggggcagctcta

SEQ ID NO: 24099 - DNA, 20 bp, human
gcgcgctggcagccagaaac

SEQ ID NO: 24100 - DNA, 20 bp, human
ggtatggtcgagcagcccaa

SEQ ID NO: 24101 - DNA, 20 bp, human
gggagccttggcgattggag

SEQ ID NO: 24102 - DNA, 20 bp, human
ggccccccggcatgccccag

SEQ ID NO: 24103 - DNA, 20 bp, human
gtgcgctgccgcggagggta

SEQ ID NO: 24104 - DNA, 20 bp, human
gaaggccaggcgattcaaga

SEQ ID NO: 24105 - DNA, 20 bp, human
gaggtcaggtgtgcaaaact

SEQ ID NO: 24106 - DNA, 20 bp, human
gtcttctgtcaggactccag

SEQ ID NO: 24107 - DNA, 20 bp, human
gagcgacgtggacatgatga

SEQ ID NO: 24108 - DNA, 20 bp, human
gtaaggacgttatccaagaa

SEQ ID NO: 24109 - DNA, 20 bp, human
ggaagagaagaggatggata

SEQ ID NO: 24110 - DNA, 20 bp, human
gcttccggaattcagctccc

SEQ ID NO: 24111 - DNA, 20 bp, human
gacgagaggctgtgtcgaag

SEQ ID NO: 24112 - DNA, 20 bp, human
gcatcgatgtggggatcttc

SEQ ID NO: 24113 - DNA, 20 bp, human
ggctttgctttcatcgatgt

SEQ ID NO: 24114 - DNA, 20 bp, human
gtcgaagtggtagccatgga

SEQ ID NO: 24115 - DNA, 20 bp, human
gagaatctcacaaactcact

SEQ ID NO: 24116 - DNA, 20 bp, human
gtcaactgttttccccctta

SEQ ID NO: 24117 - DNA, 20 bp, human
gtcctcccctccgcctaagg

SEQ ID NO: 24118 - DNA, 20 bp, human
ggcagtgggagtcgaagcga

SEQ ID NO: 24119 - DNA, 20 bp, human
ggtgattcgcactagagagg

SEQ ID NO: 24120 - DNA, 20 bp, human
ggcttggttaaaaacagtta

SEQ ID NO: 24121 - DNA, 20 bp, human
gacttcctccttaggcggag

SEQ ID NO: 24122 - DNA, 20 bp, human
gtaggctggaggccataagg

SEQ ID NO: 24123 - DNA, 20 bp, human
gtcctccttaggcggagggg

SEQ ID NO: 24124 - DNA, 20 bp, human
gtcagtgattcgcactagag

SEQ ID NO: 24125 - DNA, 20 bp, human
ggaatcctcccctccgccta

SEQ ID NO: 24126 - DNA, 20 bp, human
ggcagtgggagtcgaagcga

SEQ ID NO: 24127 - DNA, 20 bp, human
ggtgattcgcactagagagg

SEQ ID NO: 24128 - DNA, 20 bp, human
ggcttggttaaaaacagtta

SEQ ID NO: 24129 - DNA, 20 bp, human
gacttcctccttaggcggag

SEQ ID NO: 24130 - DNA, 20 bp, human
gtaggctggaggccataagg

SEQ ID NO: 24131 - DNA, 20 bp, human
gtcctccttaggcggagggg

SEQ ID NO: 24132 - DNA, 20 bp, human
ggaatcctcccctccgccta

SEQ ID NO: 24133 - DNA, 20 bp, human
gtcacgactactagaagggg

SEQ ID NO: 24134 - DNA, 20 bp, human
gagttcacgactactagaag

SEQ ID NO: 24135 - DNA, 20 bp, human
gtcctcccctccgcctaagg

SEQ ID NO: 24136 - DNA, 20 bp, human
gtaggatgcctcgcgactag

SEQ ID NO: 24137 - DNA, 20 bp, human
gctctggacccctagtcgcg

SEQ ID NO: 24138 - DNA, 20 bp, human
gtcccaggcacttcgggaag

SEQ ID NO: 24139 - DNA, 20 bp, human
gtccagttcccaggcacttc

SEQ ID NO: 24140 - DNA, 20 bp, human
gacgttaaggaaacagtcaa

SEQ ID NO: 24141 - DNA, 20 bp, human
gtcacctgtgtgcatagcaa

SEQ ID NO: 24142 - DNA, 20 bp, human
ggtctctatctagctaccct

SEQ ID NO: 24143 - DNA, 20 bp, human
gtggctcagggatcattgtg

SEQ ID NO: 24144 - DNA, 20 bp, human
ggtgcgggtccacaaaagac

SEQ ID NO: 24145 - DNA, 20 bp, human
gttccttaacgtggcatctt

SEQ ID NO: 24146 - DNA, 20 bp, human
ggcccggaaccgggaaccga

SEQ ID NO: 24147 - DNA, 20 bp, human
ggagatcccatcagcggaca

SEQ ID NO: 24148 - DNA, 20 bp, human
gcgggtgtcggcccggaacc

SEQ ID NO: 24149 - DNA, 20 bp, human
gccctgcgcgggtgtcggcc

SEQ ID NO: 24150 - DNA, 20 bp, human
gagttggtgttgaggcccta

SEQ ID NO: 24151 - DNA, 20 bp, human
gtctgcagcccggctccctt

SEQ ID NO: 24152 - DNA, 20 bp, human
gggagaaacttccgcggcta

SEQ ID NO: 24153 - DNA, 20 bp, human
gctacgggtgcagttgcctt

SEQ ID NO: 24154 - DNA, 20 bp, human
gacagcagcaggttccccag

SEQ ID NO: 24155 - DNA, 20 bp, human
gagcgccgcggagcgcacca

SEQ ID NO: 24156 - DNA, 20 bp, human
gactggctcaggaacccgtc

SEQ ID NO: 24157 - DNA, 20 bp, human
ggtcaggagctgacccctcc

SEQ ID NO: 24158 - DNA, 20 bp, human
gttgagatccattcccggag

SEQ ID NO: 24159 - DNA, 20 bp, human
ggagctgacccctccgggaa

SEQ ID NO: 24160 - DNA, 20 bp, human
gacgacctccgcagagctga

SEQ ID NO: 24161 - DNA, 20 bp, human
gcctttgcccaggttaagac

SEQ ID NO: 24162 - DNA, 20 bp, human
gcctgagccagtcttaacct

SEQ ID NO: 24163 - DNA, 20 bp, human
gatggtgcaataagactgca

SEQ ID NO: 24164 - DNA, 20 bp, human
gtggcattgagatccattcc

SEQ ID NO: 24165 - DNA, 20 bp, human
gccgcgttgccaagacagct

SEQ ID NO: 24166 - DNA, 20 bp, human
ggactcgggccgggatcctc

SEQ ID NO: 24167 - DNA, 20 bp, human
gtcgggccgggatcctcggg

SEQ ID NO: 24168 - DNA, 20 bp, human
gatcctcagaaggagcggga

SEQ ID NO: 24169 - DNA, 20 bp, human
gagtgggccaggaggtcact

SEQ ID NO: 24170 - DNA, 20 bp, human
gatcccggcccgagtccccg

SEQ ID NO: 24171 - DNA, 20 bp, human
gtgcagccgcccgaggatcc

SEQ ID NO: 24172 - DNA, 20 bp, human
gggggtccgcagccacggag

SEQ ID NO: 24173 - DNA, 20 bp, human
gccccgctgggagtgtctgg

SEQ ID NO: 24174 - DNA, 20 bp, human
gctggaggggcggtcatcag

SEQ ID NO: 24175 - DNA, 20 bp, human
gccgctccttctgaggatgt

SEQ ID NO: 24176 - DNA, 20 bp, human
gtattttcttttctagacaa

SEQ ID NO: 24177 - DNA, 20 bp, human
gccgaaaccccggtgcttgt

SEQ ID NO: 24178 - DNA, 20 bp, human
gtaacaccatctggcacgta

SEQ ID NO: 24179 - DNA, 20 bp, human
gcgtgccagatggtgttacc

SEQ ID NO: 24180 - DNA, 20 bp, human
gagctccaggtaacaccatc

SEQ ID NO: 24181 - DNA, 20 bp, human
gtcgggcctgctacccagta

SEQ ID NO: 24182 - DNA, 20 bp, human
gagacagtctacaagtggag

SEQ ID NO: 24183 - DNA, 20 bp, human
gcggcgtctaggaagttccg

SEQ ID NO: 24184 - DNA, 20 bp, human
gtgcctcaggcagccctact

SEQ ID NO: 24185 - DNA, 20 bp, human
ggaacatacacagacatgat

SEQ ID NO: 24186 - DNA, 20 bp, human
gtcctggcaaccagatgcag

SEQ ID NO: 24187 - DNA, 20 bp, human
ggcagtggaagaggagtctc

SEQ ID NO: 24188 - DNA, 20 bp, human
gagacttctttcactccctg

SEQ ID NO: 24189 - DNA, 20 bp, human
gtggggtgttaagagtgcca

SEQ ID NO: 24190 - DNA, 20 bp, human
gtggccttagtgacagaggg

SEQ ID NO: 24191 - DNA, 20 bp, human
gagggggtgctgtctagatt

SEQ ID NO: 24192 - DNA, 20 bp, human
gaggcctagagtcctgtcct

SEQ ID NO: 24193 - DNA, 20 bp, human
gtggtggccttagtgacaga

SEQ ID NO: 24194 - DNA, 20 bp, human
gaccctcagggtcccagagg

SEQ ID NO: 24195 - DNA, 20 bp, human
gctcttccttcacctgaagt

SEQ ID NO: 24196 - DNA, 20 bp, human
gccgggtgctggttgttcgg

SEQ ID NO: 24197 - DNA, 20 bp, human
gcgggcgcgagatggattcc

SEQ ID NO: 24198 - DNA, 20 bp, human
gggaggtaccggagattgca

SEQ ID NO: 24199 - DNA, 20 bp, human
gaccggagattgcagggcag

SEQ ID NO: 24200 - DNA, 20 bp, human
ggttcgaggagaggccggag

SEQ ID NO: 24201 - DNA, 20 bp, human
ggaagacaaacgggaggtac

SEQ ID NO: 24202 - DNA, 20 bp, human
gggactcggtgttcgaggag

SEQ ID NO: 24203 - DNA, 20 bp, human
gattccgggtgctggttgtt

SEQ ID NO: 24204 - DNA, 20 bp, human
gggcggcgagttcgaggact

SEQ ID NO: 24205 - DNA, 20 bp, human
gcaggggcgttgagaccagc

SEQ ID NO: 24206 - DNA, 20 bp, human
gccccgaggcccgagggaga

SEQ ID NO: 24207 - DNA, 20 bp, human
gccggcgcgggaggagaatg

SEQ ID NO: 24208 - DNA, 20 bp, human
gggaccggaaggggcgtcac

SEQ ID NO: 24209 - DNA, 20 bp, human
ggccggagggacgttccagg

SEQ ID NO: 24210 - DNA, 20 bp, human
gcccgcgcttcgcgttccgg

SEQ ID NO: 24211 - DNA, 20 bp, human
gggcgggaccattgctcgag

SEQ ID NO: 24212 - DNA, 20 bp, human
gagagcgcgctggaaagacg

SEQ ID NO: 24213 - DNA, 20 bp, human
gcctctcggaaggccagggc

SEQ ID NO: 24214 - DNA, 20 bp, human
ggcagggacgcggcccatgt

SEQ ID NO: 24215 - DNA, 20 bp, human
gctccagctctgaggagtcg

SEQ ID NO: 24216 - DNA, 20 bp, human
gcagagcgggaaccagggtg

SEQ ID NO: 24217 - DNA, 20 bp, human
gggagggaatgagacccctg

SEQ ID NO: 24218 - DNA, 20 bp, human
gctggctcaggcagtctcta

SEQ ID NO: 24219 - DNA, 20 bp, human
ggagatgctcaggtcaggga

SEQ ID NO: 24220 - DNA, 20 bp, human
gggagggacctaccccagag

SEQ ID NO: 24221 - DNA, 20 bp, human
gaaagagaggcctgtgtcca

SEQ ID NO: 24222 - DNA, 20 bp, human
gaatcaactcctcagctggg

SEQ ID NO: 24223 - DNA, 20 bp, human
gctaccccagagcgggaacc

SEQ ID NO: 24224 - DNA, 20 bp, human
ggtcccagccataatggtct

SEQ ID NO: 24225 - DNA, 20 bp, human
gcagccataatggtctggga

SEQ ID NO: 24226 - DNA, 20 bp, human
gttagagggcaagcaagcat

SEQ ID NO: 24227 - DNA, 20 bp, human
gctagggcagaggatttaga

SEQ ID NO: 24228 - DNA, 20 bp, human
gttggagatcgggttctctt

SEQ ID NO: 24229 - DNA, 20 bp, human
gtcaaagcaacaagaagcta

SEQ ID NO: 24230 - DNA, 20 bp, human
gatcttggaggggaaaatgt

SEQ ID NO: 24231 - DNA, 20 bp, human
ggggcaagcaagcatgggcc

SEQ ID NO: 24232 - DNA, 20 bp, human
gatgaatgctgtcaaagtcc

SEQ ID NO: 24233 - DNA, 20 bp, human
gcaattactctgataaaaga

SEQ ID NO: 24234 - DNA, 20 bp, human
gccataaagaatgggaagag

SEQ ID NO: 24235 - DNA, 20 bp, human
gtgattcagccataaagaat

SEQ ID NO: 24236 - DNA, 20 bp, human
gtggcagggcaggtctggta

SEQ ID NO: 24237 - DNA, 20 bp, human
gtgggtggctgcgagtgggg

SEQ ID NO: 24238 - DNA, 20 bp, human
gtgctgggtggctgcgagtg

SEQ ID NO: 24239 - DNA, 20 bp, human
gttgcaaagggccagaggac

SEQ ID NO: 24240 - DNA, 20 bp, human
gacccaggttcatcatacac

SEQ ID NO: 24241 - DNA, 20 bp, human
gaccagtgtatgatgaacct

SEQ ID NO: 24242 - DNA, 20 bp, human
gatcaggcactaataaaccc

SEQ ID NO: 24243 - DNA, 20 bp, human
ggattgcaactgcaaagctc

SEQ ID NO: 24244 - DNA, 20 bp, human
gcacagcacagtacacgacc

SEQ ID NO: 24245 - DNA, 20 bp, human
gggctctgtatattgccatg

SEQ ID NO: 24246 - DNA, 20 bp, human
ggggagaaactgctgagacg

SEQ ID NO: 24247 - DNA, 20 bp, human
ggcgctgggtaggcaaagcc

SEQ ID NO: 24248 - DNA, 20 bp, human
gccagcaactggcgctgggt

SEQ ID NO: 24249 - DNA, 20 bp, human
gcggcctccgccatcagact

SEQ ID NO: 24250 - DNA, 20 bp, human
gaaactgctgagacgaggtt

SEQ ID NO: 24251 - DNA, 20 bp, human
ggggaaaggcgaaggaatgt

SEQ ID NO: 24252 - DNA, 20 bp, human
gagctgggaacgggtgactt

SEQ ID NO: 24253 - DNA, 20 bp, human
gaaggaatgtgggtgagacg

SEQ ID NO: 24254 - DNA, 20 bp, human
gggagccatcggaaaccgag

SEQ ID NO: 24255 - DNA, 20 bp, human
gcggtgggcctccgagtccg

SEQ ID NO: 24256 - DNA, 20 bp, human
gcggtgtgtgcggaacatgg

SEQ ID NO: 24257 - DNA, 20 bp, human
gtgacttccagggcgactgt

SEQ ID NO: 24258 - DNA, 20 bp, human
gcggaagaggcgagtctcat

SEQ ID NO: 24259 - DNA, 20 bp, human
gcgacggtgtgtgcggaaca

SEQ ID NO: 24260 - DNA, 20 bp, human
ggcgggaccgacggtgtgtg

SEQ ID NO: 24261 - DNA, 20 bp, human
gccgtgcggcccggtaagtg

SEQ ID NO: 24262 - DNA, 20 bp, human
ggtgcagggcagcatggtgg

SEQ ID NO: 24263 - DNA, 20 bp, human
gggcggcgggaccccgtgca

SEQ ID NO: 24264 - DNA, 20 bp, human
gttggcagaggcgggaccga

SEQ ID NO: 24265 - DNA, 20 bp, human
ggtggaggcgtgagaaccag

SEQ ID NO: 24266 - DNA, 20 bp, human
gagaccccgcaagaccccca

SEQ ID NO: 24267 - DNA, 20 bp, human
ggactactaccgcgtgagcg

SEQ ID NO: 24268 - DNA, 20 bp, human
gtggagctgagaccacaact

SEQ ID NO: 24269 - DNA, 20 bp, human
gaggctccgcgcacgctctg

SEQ ID NO: 24270 - DNA, 20 bp, human
ggtttcagggtagagaggag

SEQ ID NO: 24271 - DNA, 20 bp, human
gagtagtcgctggtcctctc

SEQ ID NO: 24272 - DNA, 20 bp, human
gtcctgggcttgagagtctc

SEQ ID NO: 24273 - DNA, 20 bp, human
ggtctacagcaagacagtgg

SEQ ID NO: 24274 - DNA, 20 bp, human
ggcggagtttcagggtagag

SEQ ID NO: 24275 - DNA, 20 bp, human
gctcacccgacacaaatcag

SEQ ID NO: 24276 - DNA, 20 bp, human
gccatggctgatggcaacca

SEQ ID NO: 24277 - DNA, 20 bp, human
gggccacgagctagcatcgt

SEQ ID NO: 24278 - DNA, 20 bp, human
gtagctcgtggccccacccc

SEQ ID NO: 24279 - DNA, 20 bp, human
gtctaggagctgggaaggtg

SEQ ID NO: 24280 - DNA, 20 bp, human
gtggggtctggacatcccag

SEQ ID NO: 24281 - DNA, 20 bp, human
gagtgaggcagggggacgtg

SEQ ID NO: 24282 - DNA, 20 bp, human
ggcggctccacggccaccac

SEQ ID NO: 24283 - DNA, 20 bp, human
gtcctgccccatgggatcac

SEQ ID NO: 24284 - DNA, 20 bp, human
gagaggccaggtggttgcta

SEQ ID NO: 24285 - DNA, 20 bp, human
ggggacgtggggattgcctg

SEQ ID NO: 24286 - DNA, 20 bp, human
gaaaggacgcaggtcctcta

SEQ ID NO: 24287 - DNA, 20 bp, human
gtggcggcgtgagggtccgg

SEQ ID NO: 24288 - DNA, 20 bp, human
ggcctggcctcgggcagtgt

SEQ ID NO: 24289 - DNA, 20 bp, human
gtccggcggcgctggagacc

SEQ ID NO: 24290 - DNA, 20 bp, human
ggcagactgaagccgagagg

SEQ ID NO: 24291 - DNA, 20 bp, human
gaggtggcggcgtgagggtc

SEQ ID NO: 24292 - DNA, 20 bp, human
gaccatgcggtaatccaaag

SEQ ID NO: 24293 - DNA, 20 bp, human
ggtggtggctgcagtgaccg

SEQ ID NO: 24294 - DNA, 20 bp, human
gacttacccacgtagtgtgg

SEQ ID NO: 24295 - DNA, 20 bp, human
gctgcgcgagcgagataccc

SEQ ID NO: 24296 - DNA, 20 bp, human
gcttggggctaagggggata

SEQ ID NO: 24297 - DNA, 20 bp, human
gccgcagtgtctgcaggcta

SEQ ID NO: 24298 - DNA, 20 bp, human
ggaaatggaatggctgctgg

SEQ ID NO: 24299 - DNA, 20 bp, human
ggacctgcttggggctaagg

SEQ ID NO: 24300 - DNA, 20 bp, human
gggtgactggccacacacgt

SEQ ID NO: 24301 - DNA, 20 bp, human
gtaaactgccagaaggctaa

SEQ ID NO: 24302 - DNA, 20 bp, human
gctcagggtaaactgccaga

SEQ ID NO: 24303 - DNA, 20 bp, human
gatatggtgcaaggcaaggt

SEQ ID NO: 24304 - DNA, 20 bp, human
gtgtctgcaggctagggcat

SEQ ID NO: 24305 - DNA, 20 bp, human
gactagatgaggagctgtgt

SEQ ID NO: 24306 - DNA, 20 bp, human
gcgggcaggacaggtgcata

SEQ ID NO: 24307 - DNA, 20 bp, human
gatctgtcaaggctatccat

SEQ ID NO: 24308 - DNA, 20 bp, human
gtcagaggtctgtacctcga

SEQ ID NO: 24309 - DNA, 20 bp, human
gctatccatgggagccctcg

SEQ ID NO: 24310 - DNA, 20 bp, human
ggtcctggcaggatctgtca

SEQ ID NO: 24311 - DNA, 20 bp, human
ggatgagacgagagaggaat

SEQ ID NO: 24312 - DNA, 20 bp, human
gacaggagtggagacgacag

SEQ ID NO: 24313 - DNA, 20 bp, human
ggaacgtaagtaccaagatt

SEQ ID NO: 24314 - DNA, 20 bp, human
ggaaaaagatgagacgagag

SEQ ID NO: 24315 - DNA, 20 bp, human
ggataagagacgccgaatct

SEQ ID NO: 24316 - DNA, 20 bp, human
gtgagatctccaggacgtct

SEQ ID NO: 24317 - DNA, 20 bp, human
gtggccagacccagacgtcc

SEQ ID NO: 24318 - DNA, 20 bp, human
ggtcctggagatctcaatgc

SEQ ID NO: 24319 - DNA, 20 bp, human
gggagatctcaatgcaggtc

SEQ ID NO: 24320 - DNA, 20 bp, human
gtctcaatgcaggtcaggct

SEQ ID NO: 24321 - DNA, 20 bp, human
gccacgcctgggaccacaca

SEQ ID NO: 24322 - DNA, 20 bp, human
gtctccaggacgtctgggtc

SEQ ID NO: 24323 - DNA, 20 bp, human
gtctgggtctggccacgcct

SEQ ID NO: 24324 - DNA, 20 bp, human
gtgctgcacgggaccttgtg

SEQ ID NO: 24325 - DNA, 20 bp, human
gaaggtcccgtgcagcagag

SEQ ID NO: 24326 - DNA, 20 bp, human
gccggcggcagcgtgcagag

SEQ ID NO: 24327 - DNA, 20 bp, human
ggaggactacagctacaggg

SEQ ID NO: 24328 - DNA, 20 bp, human
gagtagcacacgaagcgggg

SEQ ID NO: 24329 - DNA, 20 bp, human
ggtagctgtagtcctcccat

SEQ ID NO: 24330 - DNA, 20 bp, human
gggcggcgacagcggatcca

SEQ ID NO: 24331 - DNA, 20 bp, human
gacgcgtgtggagcctggag

SEQ ID NO: 24332 - DNA, 20 bp, human
gaccccagagccctagccaa

SEQ ID NO: 24333 - DNA, 20 bp, human
ggcggacccccactcactag

SEQ ID NO: 24334 - DNA, 20 bp, human
ggcagggaggaaggacgggt

SEQ ID NO: 24335 - DNA, 20 bp, human
gtatggggcgacagacatct

SEQ ID NO: 24336 - DNA, 20 bp, human
gacctaagctgccagaagtg

SEQ ID NO: 24337 - DNA, 20 bp, human
gtcctggctgggtctaacta

SEQ ID NO: 24338 - DNA, 20 bp, human
ggaaaggggagacttcaccg

SEQ ID NO: 24339 - DNA, 20 bp, human
gcagcttaggtctcacttaa

SEQ ID NO: 24340 - DNA, 20 bp, human
gggaactggatgctgagtgg

SEQ ID NO: 24341 - DNA, 20 bp, human
ggccccacttctggcagctt

SEQ ID NO: 24342 - DNA, 20 bp, human
ggtgggagaccgagaagtaa

SEQ ID NO: 24343 - DNA, 20 bp, human
ggccatacctgggctagcag

SEQ ID NO: 24344 - DNA, 20 bp, human
gtgacaagcggggattaatg

SEQ ID NO: 24345 - DNA, 20 bp, human
gatcaagcaatggaaggacc

SEQ ID NO: 24346 - DNA, 20 bp, human
gttgagtctctgcactccca

SEQ ID NO: 24347 - DNA, 20 bp, human
gatccatgggaacacagggg

SEQ ID NO: 24348 - DNA, 20 bp, human
gcaaaggacactgggtgtga

SEQ ID NO: 24349 - DNA, 20 bp, human
ggacactgggtgtgagggag

SEQ ID NO: 24350 - DNA, 20 bp, human
gaatgacacatgctaggagt

SEQ ID NO: 24351 - DNA, 20 bp, human
gcagagctgggaggtgagat

SEQ ID NO: 24352 - DNA, 20 bp, human
gtcagtgttgaaggccggaa

SEQ ID NO: 24353 - DNA, 20 bp, human
gaggtgggaagaccagagct

SEQ ID NO: 24354 - DNA, 20 bp, human
ggtgaggtgggcagtggcta

SEQ ID NO: 24355 - DNA, 20 bp, human
gtgaaggccggaaaggatga

SEQ ID NO: 24356 - DNA, 20 bp, human
gagcgcaggatgcctctcta

SEQ ID NO: 24357 - DNA, 20 bp, human
ggcgcggcttggaggagtcg

SEQ ID NO: 24358 - DNA, 20 bp, human
gggcctacagcgaccccgtg

SEQ ID NO: 24359 - DNA, 20 bp, human
ggcagctacgtgcagcgtag

SEQ ID NO: 24360 - DNA, 20 bp, human
gaaggttgaatgcgtcgggt

SEQ ID NO: 24361 - DNA, 20 bp, human
gagccgcacggggtcgctgt

SEQ ID NO: 24362 - DNA, 20 bp, human
gcaccatctcccatacgcta

SEQ ID NO: 24363 - DNA, 20 bp, human
gaattgggcctagaaagaca

SEQ ID NO: 24364 - DNA, 20 bp, human
ggcatggctactggttgctg

SEQ ID NO: 24365 - DNA, 20 bp, human
gggcttaacgcagccgcacg

SEQ ID NO: 24366 - DNA, 20 bp, human
gggtggagcaaggcccacaa

SEQ ID NO: 24367 - DNA, 20 bp, human
ggaggcggcggatagaacac

SEQ ID NO: 24368 - DNA, 20 bp, human
ggatagaacacgggccggaa

SEQ ID NO: 24369 - DNA, 20 bp, human
gaaagccggcgccggatgga

SEQ ID NO: 24370 - DNA, 20 bp, human
ggccggcgccggatggaagg

SEQ ID NO: 24371 - DNA, 20 bp, human
ggggccggaagggtagaacg

SEQ ID NO: 24372 - DNA, 20 bp, human
ggccgcctccaccttccatc

SEQ ID NO: 24373 - DNA, 20 bp, human
ggccgcgcgacgatggaacg

SEQ ID NO: 24374 - DNA, 20 bp, human
ggggagaccgaggcacctga

SEQ ID NO: 24375 - DNA, 20 bp, human
gtcagtcctgggggagaccg

SEQ ID NO: 24376 - DNA, 20 bp, human
gcagagcgaagggacagtag

SEQ ID NO: 24377 - DNA, 20 bp, human
ggaaagagccagcgtaaaca

SEQ ID NO: 24378 - DNA, 20 bp, human
gggcctctgtgcagagcgaa

SEQ ID NO: 24379 - DNA, 20 bp, human
ggacagtagaggatgcgtcg

SEQ ID NO: 24380 - DNA, 20 bp, human
ggatgcgtcggggaaacccc

SEQ ID NO: 24381 - DNA, 20 bp, human
gacagggcgacgtactggga

SEQ ID NO: 24382 - DNA, 20 bp, human
gggcggccagagcgacccag

SEQ ID NO: 24383 - DNA, 20 bp, human
gctgcacagaggcccgggca

SEQ ID NO: 24384 - DNA, 20 bp, human
gccagagcgacccagcggag

SEQ ID NO: 24385 - DNA, 20 bp, human
gcgacgtactgggacggccc

SEQ ID NO: 24386 - DNA, 20 bp, human
ggctgccagtcgctcaactc

SEQ ID NO: 24387 - DNA, 20 bp, human
ggcggccaagggcttacctg

SEQ ID NO: 24388 - DNA, 20 bp, human
gtagagctcagaagaccgag

SEQ ID NO: 24389 - DNA, 20 bp, human
ggcccgggggatgctgatgt

SEQ ID NO: 24390 - DNA, 20 bp, human
gtcctgggccgcaggctcgt

SEQ ID NO: 24391 - DNA, 20 bp, human
ggggcagtcccggcggccaa

SEQ ID NO: 24392 - DNA, 20 bp, human
gcctgagttcagggcagtcc

SEQ ID NO: 24393 - DNA, 20 bp, human
gccaggaccaatgccaccag

SEQ ID NO: 24394 - DNA, 20 bp, human
gactgccgtgttgccaccac

SEQ ID NO: 24395 - DNA, 20 bp, human
gtgtgcaaggctagtgtcat

SEQ ID NO: 24396 - DNA, 20 bp, human
gcccccaggaggagatgcag

SEQ ID NO: 24397 - DNA, 20 bp, human
gctctcgccgttccccgggc

SEQ ID NO: 24398 - DNA, 20 bp, human
gttcagcgcgcggacatttc

SEQ ID NO: 24399 - DNA, 20 bp, human
gggcgcggcagccagcgaga

SEQ ID NO: 24400 - DNA, 20 bp, human
ggaactggcggacagaggaa

SEQ ID NO: 24401 - DNA, 20 bp, human
gtgagcgcccgagagcatgg

SEQ ID NO: 24402 - DNA, 20 bp, human
ggctctctctcgccgttccc

SEQ ID NO: 24403 - DNA, 20 bp, human
ggcgaggcctccatgctctc

SEQ ID NO: 24404 - DNA, 20 bp, human
gtgggagaactggcggacag

SEQ ID NO: 24405 - DNA, 20 bp, human
ggcgcgcggacatttccggc

SEQ ID NO: 24406 - DNA, 20 bp, human
gcctcacagtgggatgataa

SEQ ID NO: 24407 - DNA, 20 bp, human
gccaggctgtgcccgacgtg

SEQ ID NO: 24408 - DNA, 20 bp, human
gggcgacgcgacctgcatgg

SEQ ID NO: 24409 - DNA, 20 bp, human
gcggctccccggcgacctca

SEQ ID NO: 24410 - DNA, 20 bp, human
ggcgacctcaaggatgccag

SEQ ID NO: 24411 - DNA, 20 bp, human
ggagccccgcgggatcctca

SEQ ID NO: 24412 - DNA, 20 bp, human
ggcgcgcccaaaccagcccg

SEQ ID NO: 24413 - DNA, 20 bp, human
gggcatccttgaggtcgccg

SEQ ID NO: 24414 - DNA, 20 bp, human
ggggcgcgcttccccacgtc

SEQ ID NO: 24415 - DNA, 20 bp, human
gcggggtccgagcgcagcgt

SEQ ID NO: 24416 - DNA, 20 bp, human
gcgactagtgacggcggggt

SEQ ID NO: 24417 - DNA, 20 bp, human
gctcccccgactagtgacgg

SEQ ID NO: 24418 - DNA, 20 bp, human
gcggcccgtccttccaactg

SEQ ID NO: 24419 - DNA, 20 bp, human
gcatcttaaaagaggtcccc

SEQ ID NO: 24420 - DNA, 20 bp, human
ggccgcgggaaccacaacca

SEQ ID NO: 24421 - DNA, 20 bp, human
gacggcggggtcggctcggg

SEQ ID NO: 24422 - DNA, 20 bp, human
ggccctctggtgtccgcagt

SEQ ID NO: 24423 - DNA, 20 bp, human
gtctggtgtccgcagttgga

SEQ ID NO: 24424 - DNA, 20 bp, human
ggggcctgggccgagaacgc

SEQ ID NO: 24425 - DNA, 20 bp, human
gatgacccgtacggaccctc

SEQ ID NO: 24426 - DNA, 20 bp, human
gagatgccttgggcctgcaa

SEQ ID NO: 24427 - DNA, 20 bp, human
gtctccgccagttactgggt

SEQ ID NO: 24428 - DNA, 20 bp, human
gcatcaatggaggcaaacac

SEQ ID NO: 24429 - DNA, 20 bp, human
gtgtctgcctcaggtgacca

SEQ ID NO: 24430 - DNA, 20 bp, human
ggagcccacccagtaactgg

SEQ ID NO: 24431 - DNA, 20 bp, human
ggaggcaaacactggaccca

SEQ ID NO: 24432 - DNA, 20 bp, human
gcagaaggcagtgaaattcc

SEQ ID NO: 24433 - DNA, 20 bp, human
gccagctgggagtggccagg

SEQ ID NO: 24434 - DNA, 20 bp, human
gatgatgaattctgaccaga

SEQ ID NO: 24435 - DNA, 20 bp, human
gaggggctgagggacagtag

SEQ ID NO: 24436 - DNA, 20 bp, human
gccgagtcacggacagagtg

SEQ ID NO: 24437 - DNA, 20 bp, human
ggcctaggagggcattccaa

SEQ ID NO: 24438 - DNA, 20 bp, human
ggccaggagtccaggaaagg

SEQ ID NO: 24439 - DNA, 20 bp, human
ggcagctccccacctctcca

SEQ ID NO: 24440 - DNA, 20 bp, human
gcatcccgcgcagacagtag

SEQ ID NO: 24441 - DNA, 20 bp, human
gtgaagggcgggagaagttg

SEQ ID NO: 24442 - DNA, 20 bp, human
gcgcatcggggcgtgatccg

SEQ ID NO: 24443 - DNA, 20 bp, human
ggagccgctccggcctagga

SEQ ID NO: 24444 - DNA, 20 bp, human
ggccaggacggatagattca

SEQ ID NO: 24445 - DNA, 20 bp, human
gtctgggaggacccctaaaa

SEQ ID NO: 24446 - DNA, 20 bp, human
gatgagaggcaggtcatctc

SEQ ID NO: 24447 - DNA, 20 bp, human
gctgtgacacagggaatcat

SEQ ID NO: 24448 - DNA, 20 bp, human
gaggcaggtcatctctggca

SEQ ID NO: 24449 - DNA, 20 bp, human
gatagtgcttcacaagtatg

SEQ ID NO: 24450 - DNA, 20 bp, human
gtctgtgttaaaagtcgagg

SEQ ID NO: 24451 - DNA, 20 bp, human
gtcctcgaggaaaagcacta

SEQ ID NO: 24452 - DNA, 20 bp, human
gcagctgtatgtccatgatg

SEQ ID NO: 24453 - DNA, 20 bp, human
gttgtcacgggaatatggca

SEQ ID NO: 24454 - DNA, 20 bp, human
gcttgtgaagcactatgtac

SEQ ID NO: 24455 - DNA, 20 bp, human
gacaagtatgtggctggtgt

SEQ ID NO: 24456 - DNA, 20 bp, human
gtccagccggagcataccct

SEQ ID NO: 24457 - DNA, 20 bp, human
gtgggcagcgggcctatgag

SEQ ID NO: 24458 - DNA, 20 bp, human
gcgcgccggggacaccccac

SEQ ID NO: 24459 - DNA, 20 bp, human
gacggcgggaatacctggac

SEQ ID NO: 24460 - DNA, 20 bp, human
gcggagcataccctcggcag

SEQ ID NO: 24461 - DNA, 20 bp, human
ggcccgcggggtaggagacc

SEQ ID NO: 24462 - DNA, 20 bp, human
gctccaggtctcctaccccg

SEQ ID NO: 24463 - DNA, 20 bp, human
gcgcggaaggctgactccct

SEQ ID NO: 24464 - DNA, 20 bp, human
gggtatgctccggctggagg

SEQ ID NO: 24465 - DNA, 20 bp, human
gccctaacggcgggaatacc

SEQ ID NO: 24466 - DNA, 20 bp, human
gcgtccgggccgcatctcgg

SEQ ID NO: 24467 - DNA, 20 bp, human
gcaacgtccgggccgcatct

SEQ ID NO: 24468 - DNA, 20 bp, human
ggcggccggatccagagagg

SEQ ID NO: 24469 - DNA, 20 bp, human
gccgggccgcatctcggcgg

SEQ ID NO: 24470 - DNA, 20 bp, human
gcctcgccgccgccgagatg

SEQ ID NO: 24471 - DNA, 20 bp, human
gggatccagagaggcggtgg

SEQ ID NO: 24472 - DNA, 20 bp, human
ggcttgctgggcgaagccga

SEQ ID NO: 24473 - DNA, 20 bp, human
ggcagctcgcgcagggccta

SEQ ID NO: 24474 - DNA, 20 bp, human
ggagcgtgaggaccacggtc

SEQ ID NO: 24475 - DNA, 20 bp, human
gttgagaagcaaccgcgaag

SEQ ID NO: 24476 - DNA, 20 bp, human
gcggacatgcccccagctcg

SEQ ID NO: 24477 - DNA, 20 bp, human
gtgggctccgccaggtcttc

SEQ ID NO: 24478 - DNA, 20 bp, human
gggtggtgcgaggtgactcg

SEQ ID NO: 24479 - DNA, 20 bp, human
gtccgcgaccgacagcgtgg

SEQ ID NO: 24480 - DNA, 20 bp, human
gcgcggcggcgatgcagcga

SEQ ID NO: 24481 - DNA, 20 bp, human
gacgcaagcgagccaggccg

SEQ ID NO: 24482 - DNA, 20 bp, human
ggccaccacgctgtcggtcg

SEQ ID NO: 24483 - DNA, 20 bp, human
gccgggtcccgacgcctcgg

SEQ ID NO: 24484 - DNA, 20 bp, human
ggcgggcgccgtctagagga

SEQ ID NO: 24485 - DNA, 20 bp, human
gccgtcggggcgcccactgg

SEQ ID NO: 24486 - DNA, 20 bp, human
ggactgggcaggtaacgaaa

SEQ ID NO: 24487 - DNA, 20 bp, human
gtgcggcgcggtgagattaa

SEQ ID NO: 24488 - DNA, 20 bp, human
ggcggtgagattaacggacc

SEQ ID NO: 24489 - DNA, 20 bp, human
gtaggacccgaggcaggctc

SEQ ID NO: 24490 - DNA, 20 bp, human
ggtgagattaacggacccgg

SEQ ID NO: 24491 - DNA, 20 bp, human
gcggatccctttaggacccg

SEQ ID NO: 24492 - DNA, 20 bp, human
gttagggttgctaaatcaag

SEQ ID NO: 24493 - DNA, 20 bp, human
ggcctgcctcgggtcctaaa

SEQ ID NO: 24494 - DNA, 20 bp, human
ggcagattccaaaccgctta

SEQ ID NO: 24495 - DNA, 20 bp, human
gtcaggagtcaattcggact

SEQ ID NO: 24496 - DNA, 20 bp, human
gctgacagcgagggtttgtt

SEQ ID NO: 24497 - DNA, 20 bp, human
ggccggacagcgtttttgtt

SEQ ID NO: 24498 - DNA, 20 bp, human
ggaccaggcaggcgccggag

SEQ ID NO: 24499 - DNA, 20 bp, human
gtttccgcgcgggtcccctc

SEQ ID NO: 24500 - DNA, 20 bp, human
gcccaggcacgcagagactt

SEQ ID NO: 24501 - DNA, 20 bp, human
gctctccgcgctctaccccc

SEQ ID NO: 24502 - DNA, 20 bp, human
gagggcgagccggaccctag

SEQ ID NO: 24503 - DNA, 20 bp, human
gggagaaggggtccaggcta

SEQ ID NO: 24504 - DNA, 20 bp, human
gccggcttgggcttgcaggt

SEQ ID NO: 24505 - DNA, 20 bp, human
gaccaggcggcttgagcggg

SEQ ID NO: 24506 - DNA, 20 bp, human
gacgcgccggccgacagcag

SEQ ID NO: 24507 - DNA, 20 bp, human
gcaggccatagtgccccggg

SEQ ID NO: 24508 - DNA, 20 bp, human
gcgggtcgcggtgagcaagg

SEQ ID NO: 24509 - DNA, 20 bp, human
gccccaggccatagtgcccc

SEQ ID NO: 24510 - DNA, 20 bp, human
ggcgcgggcggggtcagctt

SEQ ID NO: 24511 - DNA, 20 bp, human
ggtgaacgccaccggcccgg

SEQ ID NO: 24512 - DNA, 20 bp, human
ggggacgccaagcccggggt

SEQ ID NO: 24513 - DNA, 20 bp, human
gcaccgcgctgccccgcccg

SEQ ID NO: 24514 - DNA, 20 bp, human
gtcgctgtccgccgggccgg

SEQ ID NO: 24515 - DNA, 20 bp, human
gtgagcaaggcgggcaggcg

SEQ ID NO: 24516 - DNA, 20 bp, human
ggtactatggaaattttcct

SEQ ID NO: 24517 - DNA, 20 bp, human
gcttaatgaaaaagataggt

SEQ ID NO: 24518 - DNA, 20 bp, human
ggggtctgaactttcttaaa

SEQ ID NO: 24519 - DNA, 20 bp, human
ggtgtcgctttcagttgtaa

SEQ ID NO: 24520 - DNA, 20 bp, human
gctttttcattaaggtacta

SEQ ID NO: 24521 - DNA, 20 bp, human
gtaaactgtttggaatctag

SEQ ID NO: 24522 - DNA, 20 bp, human
gagggaagaaattgtaagat

SEQ ID NO: 24523 - DNA, 20 bp, human
gcaaaagaccttatttatga

SEQ ID NO: 24524 - DNA, 20 bp, human
ggtaccttaatgaaaaagat

SEQ ID NO: 24525 - DNA, 20 bp, human
gaggcgcatgctgcaacacc

SEQ ID NO: 24526 - DNA, 20 bp, human
gcagggctgagtggcagtgt

SEQ ID NO: 24527 - DNA, 20 bp, human
gtctggggacagggaggtat

SEQ ID NO: 24528 - DNA, 20 bp, human
gggaggagacgcaagctgag

SEQ ID NO: 24529 - DNA, 20 bp, human
ggagcccaggctgtcgtccc

SEQ ID NO: 24530 - DNA, 20 bp, human
gaggtgcgtgaccacaacac

SEQ ID NO: 24531 - DNA, 20 bp, human
gggagtccagcacatacaca

SEQ ID NO: 24532 - DNA, 20 bp, human
gcacagggctagcctccaat

SEQ ID NO: 24533 - DNA, 20 bp, human
gtagcctccaatgggctaaa

SEQ ID NO: 24534 - DNA, 20 bp, human
gtccagcagcggccacagga

SEQ ID NO: 24535 - DNA, 20 bp, human
ggctccctttagcccattgg

SEQ ID NO: 24536 - DNA, 20 bp, human
gctggggttcagctcatgaa

SEQ ID NO: 24537 - DNA, 20 bp, human
gtaggaaaccagagagaccc

SEQ ID NO: 24538 - DNA, 20 bp, human
gccgcggcgttgccctgatt

SEQ ID NO: 24539 - DNA, 20 bp, human
gaggtaaaggttctctcccg

SEQ ID NO: 24540 - DNA, 20 bp, human
gcccaaagggcagaatggac

SEQ ID NO: 24541 - DNA, 20 bp, human
ggaccccggggcagctcgct

SEQ ID NO: 24542 - DNA, 20 bp, human
gctctctggtttcctaatca

SEQ ID NO: 24543 - DNA, 20 bp, human
gtggcccgccgggtcccaaa

SEQ ID NO: 24544 - DNA, 20 bp, human
ggacgaggccgcggtcaact

SEQ ID NO: 24545 - DNA, 20 bp, human
gagaggccgcaagcacttcc

SEQ ID NO: 24546 - DNA, 20 bp, human
gaggtggccgggtcccagaa

SEQ ID NO: 24547 - DNA, 20 bp, human
gcgggtcccagaagggtgat

SEQ ID NO: 24548 - DNA, 20 bp, human
gcctgtaagaacctggaggg

SEQ ID NO: 24549 - DNA, 20 bp, human
ggaaagagcttggctcctgg

SEQ ID NO: 24550 - DNA, 20 bp, human
ggccacctgtaagaacctgg

SEQ ID NO: 24551 - DNA, 20 bp, human
gccacggagtgtctcataaa

SEQ ID NO: 24552 - DNA, 20 bp, human
gggggcgcgcctgagacctg

SEQ ID NO: 24553 - DNA, 20 bp, human
ggaactccagcaaaaagcta

SEQ ID NO: 24554 - DNA, 20 bp, human
gtcggggaagggatccccgg

SEQ ID NO: 24555 - DNA, 20 bp, human
gccggccacctgtaagaacc

SEQ ID NO: 24556 - DNA, 20 bp, human
gacggagccccgagggacag

SEQ ID NO: 24557 - DNA, 20 bp, human
gctcgggaagcgacgagtcc

SEQ ID NO: 24558 - DNA, 20 bp, human
gtcacccggtgccctctccg

SEQ ID NO: 24559 - DNA, 20 bp, human
ggagggcaccgggtgagctg

SEQ ID NO: 24560 - DNA, 20 bp, human
gtaggcgggggccgtctcca

SEQ ID NO: 24561 - DNA, 20 bp, human
gtccctcgacggccaccgta

SEQ ID NO: 24562 - DNA, 20 bp, human
gcaccgggtgagctgcggtc

SEQ ID NO: 24563 - DNA, 20 bp, human
gcgcacgcacgcacgccctc

SEQ ID NO: 24564 - DNA, 20 bp, human
gaagggaagtgcggctcggt

SEQ ID NO: 24565 - DNA, 20 bp, human
gccgcgcgttgccctggaga

SEQ ID NO: 24566 - DNA, 20 bp, human
ggaggaggcggcatcctggc

SEQ ID NO: 24567 - DNA, 20 bp, human
ggagtgaggaggcggcatcc

SEQ ID NO: 24568 - DNA, 20 bp, human
gcgccggcagggaccgtctc

SEQ ID NO: 24569 - DNA, 20 bp, human
ggaagaggcgcgggtagaag

SEQ ID NO: 24570 - DNA, 20 bp, human
gatcatgcgggatgagatgg

SEQ ID NO: 24571 - DNA, 20 bp, human
ggcttctgcggaccaagtcg

SEQ ID NO: 24572 - DNA, 20 bp, human
ggaggcggcatcctggcggg

SEQ ID NO: 24573 - DNA, 20 bp, human
ggagacagctcgggtactga

SEQ ID NO: 24574 - DNA, 20 bp, human
gcggcgcagggacaagggat

SEQ ID NO: 24575 - DNA, 20 bp, human
gttcctagcgaaccccgact

SEQ ID NO: 24576 - DNA, 20 bp, human
gacgaccggcatggtgacaa

SEQ ID NO: 24577 - DNA, 20 bp, human
ggcgcggcggctgtacaact

SEQ ID NO: 24578 - DNA, 20 bp, human
gggaaaatcttccggacgac

SEQ ID NO: 24579 - DNA, 20 bp, human
gccgccgcgcctctgcgcag

SEQ ID NO: 24580 - DNA, 20 bp, human
gtgggctgggatgccctcga

SEQ ID NO: 24581 - DNA, 20 bp, human
ggccaataaggcaccttcga

SEQ ID NO: 24582 - DNA, 20 bp, human
gatcttccggacgaccggca

SEQ ID NO: 24583 - DNA, 20 bp, human
gcgcgcgccggaagcagcct

SEQ ID NO: 24584 - DNA, 20 bp, human
gaaagctaacagagccaata

SEQ ID NO: 24585 - DNA, 20 bp, human
ggagccactgcgcatcccgg

SEQ ID NO: 24586 - DNA, 20 bp, human
gctcaggtaagagccctgag

SEQ ID NO: 24587 - DNA, 20 bp, human
gtcagtggtcacgtgtccag

SEQ ID NO: 24588 - DNA, 20 bp, human
gggtaagagccctgagaggc

SEQ ID NO: 24589 - DNA, 20 bp, human
ggtatgggaccaaagaagta

SEQ ID NO: 24590 - DNA, 20 bp, human
gtggtcacgtgtccagcggg

SEQ ID NO: 24591 - DNA, 20 bp, human
gggggaggaaaaggtcgtat

SEQ ID NO: 24592 - DNA, 20 bp, human
gctcaggttaagtggacagt

SEQ ID NO: 24593 - DNA, 20 bp, human
gctgtgaggcccggccgatg

SEQ ID NO: 24594 - DNA, 20 bp, human
gtaacatggcagagaaggcg

SEQ ID NO: 24595 - DNA, 20 bp, human
gcatcaactagaagttgtat

SEQ ID NO: 24596 - DNA, 20 bp, human
ggagcaggcaaaaggatgag

SEQ ID NO: 24597 - DNA, 20 bp, human
ggacagaagcgtcaattcct

SEQ ID NO: 24598 - DNA, 20 bp, human
gctcgccgggagcaggcaaa

SEQ ID NO: 24599 - DNA, 20 bp, human
gaggaccctaatgaaatcta

SEQ ID NO: 24600 - DNA, 20 bp, human
ggacgcttctgtcaatgacc

SEQ ID NO: 24601 - DNA, 20 bp, human
ggataaaagtgtgcagacca

SEQ ID NO: 24602 - DNA, 20 bp, human
gtgcagccaagactaactct

SEQ ID NO: 24603 - DNA, 20 bp, human
gaccaggagacaacatgtcc

SEQ ID NO: 24604 - DNA, 20 bp, human
ggaaatctaaggtgcagatg

SEQ ID NO: 24605 - DNA, 20 bp, human
gatcaaagccacccctcgcc

SEQ ID NO: 24606 - DNA, 20 bp, human
gctggagctggtggaccggg

SEQ ID NO: 24607 - DNA, 20 bp, human
ggaccgggcggctgaccgag

SEQ ID NO: 24608 - DNA, 20 bp, human
gcaggtgcggggcccgaaga

SEQ ID NO: 24609 - DNA, 20 bp, human
ggacacacacacattggcag

SEQ ID NO: 24610 - DNA, 20 bp, human
ggggctggcctagccaaaag

SEQ ID NO: 24611 - DNA, 20 bp, human
gctacacagccaaagccggg

SEQ ID NO: 24612 - DNA, 20 bp, human
gcgggcggctgaccgagggg

SEQ ID NO: 24613 - DNA, 20 bp, human
gctggcctagccaaaagggg

SEQ ID NO: 24614 - DNA, 20 bp, human
ggtgcggggcccgaagaggg

SEQ ID NO: 24615 - DNA, 20 bp, human
gggcgagcacggcccgcggg

SEQ ID NO: 24616 - DNA, 20 bp, human
gacccgcgcgaccgaggatc

SEQ ID NO: 24617 - DNA, 20 bp, human
gggcccagatacccgatcct

SEQ ID NO: 24618 - DNA, 20 bp, human
ggaccgaggatcgggtatct

SEQ ID NO: 24619 - DNA, 20 bp, human
gagctgggaggggtctaccg

SEQ ID NO: 24620 - DNA, 20 bp, human
gcagagcgcgtcagccgggg

SEQ ID NO: 24621 - DNA, 20 bp, human
gggaggggcgtccatgagat

SEQ ID NO: 24622 - DNA, 20 bp, human
gtagcaatcgggtcacttgg

SEQ ID NO: 24623 - DNA, 20 bp, human
ggacgcgggaataaatgtgg

SEQ ID NO: 24624 - DNA, 20 bp, human
gtctaccggggctcgactct

SEQ ID NO: 24625 - DNA, 20 bp, human
gggcaagtcggccctccgag

SEQ ID NO: 24626 - DNA, 20 bp, human
gtcccacggccggcacgcgg

SEQ ID NO: 24627 - DNA, 20 bp, human
ggctcggtcgcccaaccccg

SEQ ID NO: 24628 - DNA, 20 bp, human
gccgggacgcggaaggtcgg

SEQ ID NO: 24629 - DNA, 20 bp, human
gtccggcgggcggctcctcg

SEQ ID NO: 24630 - DNA, 20 bp, human
ggcccgaacgcaggccaagg

SEQ ID NO: 24631 - DNA, 20 bp, human
gtcagagccgctcccacggc

SEQ ID NO: 24632 - DNA, 20 bp, human
ggcgctcggctgatgaaacg

SEQ ID NO: 24633 - DNA, 20 bp, human
gcttggccccaaagcgagtc

SEQ ID NO: 24634 - DNA, 20 bp, human
gcgcacgaaggaccccccgc

SEQ ID NO: 24635 - DNA, 20 bp, human
gagacggcctgggttcggcg

SEQ ID NO: 24636 - DNA, 20 bp, human
gggctcctttggtataaagg

SEQ ID NO: 24637 - DNA, 20 bp, human
ggtttgcttccaacttacat

SEQ ID NO: 24638 - DNA, 20 bp, human
gaagctgtcgttagctgaag

SEQ ID NO: 24639 - DNA, 20 bp, human
gtccctcaccaggtccaggg

SEQ ID NO: 24640 - DNA, 20 bp, human
ggaagttatgcagggataag

SEQ ID NO: 24641 - DNA, 20 bp, human
gtgtcgttagctgaagaggc

SEQ ID NO: 24642 - DNA, 20 bp, human
gcgttagctgaagaggcagg

SEQ ID NO: 24643 - DNA, 20 bp, human
ggtgtcaggaatgcaggatt

SEQ ID NO: 24644 - DNA, 20 bp, human
gatccctgcataacttccag

SEQ ID NO: 24645 - DNA, 20 bp, human
gagcttgctggcaaatttaa

SEQ ID NO: 24646 - DNA, 20 bp, human
ggcaaacaacctgcttgtag

SEQ ID NO: 24647 - DNA, 20 bp, human
gtgggagagaggtctgtgtc

SEQ ID NO: 24648 - DNA, 20 bp, human
gacagtgcgttagagagtat

SEQ ID NO: 24649 - DNA, 20 bp, human
gcaaccatgggccagacact

SEQ ID NO: 24650 - DNA, 20 bp, human
gtctccaaagtgggctttgt

SEQ ID NO: 24651 - DNA, 20 bp, human
ggagtataggagacttgcca

SEQ ID NO: 24652 - DNA, 20 bp, human
gtgaatcctcgcagtgggaa

SEQ ID NO: 24653 - DNA, 20 bp, human
gcgggcgccaatctccaaag

SEQ ID NO: 24654 - DNA, 20 bp, human
gaacgtcacattcacaggtg

SEQ ID NO: 24655 - DNA, 20 bp, human
gtcttccagcctctacaagc

SEQ ID NO: 24656 - DNA, 20 bp, human
ggccctcaaatactcagcca

SEQ ID NO: 24657 - DNA, 20 bp, human
gccaccccgcgtgggtcagt

SEQ ID NO: 24658 - DNA, 20 bp, human
gggacgcctgagtgcctcga

SEQ ID NO: 24659 - DNA, 20 bp, human
gccccaggcacgaaggatag

SEQ ID NO: 24660 - DNA, 20 bp, human
gtcgggcggggaggatcccg

SEQ ID NO: 24661 - DNA, 20 bp, human
gccacgcggggtggggccag

SEQ ID NO: 24662 - DNA, 20 bp, human
gcgtgggtcagtgggacccg

SEQ ID NO: 24663 - DNA, 20 bp, human
gcctccccgcagggaacact

SEQ ID NO: 24664 - DNA, 20 bp, human
gggtcccactgacccacgcg

SEQ ID NO: 24665 - DNA, 20 bp, human
ggccctggctgagtatttga

SEQ ID NO: 24666 - DNA, 20 bp, human
gcctgtggtacccagtcctc

SEQ ID NO: 24667 - DNA, 20 bp, human
gccacagaggaccacgcagg

SEQ ID NO: 24668 - DNA, 20 bp, human
gggggttgcacctgaggact

SEQ ID NO: 24669 - DNA, 20 bp, human
gacgcagggggttgcacctg

SEQ ID NO: 24670 - DNA, 20 bp, human
gtctgcttgataaatataaa

SEQ ID NO: 24671 - DNA, 20 bp, human
gtaaagattcttttggcagt

SEQ ID NO: 24672 - DNA, 20 bp, human
gtacagctctgaatgagaga

SEQ ID NO: 24673 - DNA, 20 bp, human
gcacaggctggagggggaat

SEQ ID NO: 24674 - DNA, 20 bp, human
gactgggtaccacaggctgg

SEQ ID NO: 24675 - DNA, 20 bp, human
gaggtttagaaaaactataa

SEQ ID NO: 24676 - DNA, 20 bp, human
gttgcggaaaatctcgacag

SEQ ID NO: 24677 - DNA, 20 bp, human
gtgaggggggcggacttcga

SEQ ID NO: 24678 - DNA, 20 bp, human
gctccgaccatgccccggtg

SEQ ID NO: 24679 - DNA, 20 bp, human
ggcgagcggggagacctcca

SEQ ID NO: 24680 - DNA, 20 bp, human
gaagtccgcccccctcaccg

SEQ ID NO: 24681 - DNA, 20 bp, human
gggctgcgccgtgcaattcc

SEQ ID NO: 24682 - DNA, 20 bp, human
gcagcgagctacgcgctccc

SEQ ID NO: 24683 - DNA, 20 bp, human
gccgggagcccggaattgca

SEQ ID NO: 24684 - DNA, 20 bp, human
gcgaccatgccccggtgagg

SEQ ID NO: 24685 - DNA, 20 bp, human
gaacttgccgcggactgcct

SEQ ID NO: 24686 - DNA, 20 bp, human
ggtccctcggaggcctcctg

SEQ ID NO: 24687 - DNA, 20 bp, human
gatccccaggaggcctccga

SEQ ID NO: 24688 - DNA, 20 bp, human
gcctcgagcgctggtactct

SEQ ID NO: 24689 - DNA, 20 bp, human
gggaggccgacactgaggga

SEQ ID NO: 24690 - DNA, 20 bp, human
ggagatgcgggatggagacc

SEQ ID NO: 24691 - DNA, 20 bp, human
gagactgaaacagggagaag

SEQ ID NO: 24692 - DNA, 20 bp, human
ggggcagcaggtaagacctg

SEQ ID NO: 24693 - DNA, 20 bp, human
gtcccgggaggagcccccga

SEQ ID NO: 24694 - DNA, 20 bp, human
gtaatgaaaagagaacggag

SEQ ID NO: 24695 - DNA, 20 bp, human
gagctggaggccgacactga

SEQ ID NO: 24696 - DNA, 20 bp, human
gaagccaggagagcgaaggg

SEQ ID NO: 24697 - DNA, 20 bp, human
ggggaagccaggagagcgaa

SEQ ID NO: 24698 - DNA, 20 bp, human
gccagcccggccccagtgaa

SEQ ID NO: 24699 - DNA, 20 bp, human
gtgtgcagctggagagcgag

SEQ ID NO: 24700 - DNA, 20 bp, human
gagggcggacgtactcgcca

SEQ ID NO: 24701 - DNA, 20 bp, human
gcgtctagggattccttcag

SEQ ID NO: 24702 - DNA, 20 bp, human
ggaagcacgttgctttctag

SEQ ID NO: 24703 - DNA, 20 bp, human
gtggagagcgagcggccacc

SEQ ID NO: 24704 - DNA, 20 bp, human
gccgcgtgcaggctgcgccg

SEQ ID NO: 24705 - DNA, 20 bp, human
ggtggcgcttggcgcagatt

SEQ ID NO: 24706 - DNA, 20 bp, human
gcgagtgacgactcctcaga

SEQ ID NO: 24707 - DNA, 20 bp, human
ggaaggcaggagatcccccc

SEQ ID NO: 24708 - DNA, 20 bp, human
gaggagtcgtcactcgggag

SEQ ID NO: 24709 - DNA, 20 bp, human
gtgagcagcgagaaagagga

SEQ ID NO: 24710 - DNA, 20 bp, human
gaccccgagggaccatgtcg

SEQ ID NO: 24711 - DNA, 20 bp, human
ggcgctcgctgaccacacac

SEQ ID NO: 24712 - DNA, 20 bp, human
gcgccgctggctgactcctg

SEQ ID NO: 24713 - DNA, 20 bp, human
gccccgcacaaaccccccct

SEQ ID NO: 24714 - DNA, 20 bp, human
gggggataccgcgagcacaa

SEQ ID NO: 24715 - DNA, 20 bp, human
gagagagaaaggtttccggg

SEQ ID NO: 24716 - DNA, 20 bp, human
ggtcccaggaaggggtgcag

SEQ ID NO: 24717 - DNA, 20 bp, human
gggtgtgaaaggaagcctag

SEQ ID NO: 24718 - DNA, 20 bp, human
gggaggtcggggagaactag

SEQ ID NO: 24719 - DNA, 20 bp, human
ggcctagaggctggaataat

SEQ ID NO: 24720 - DNA, 20 bp, human
ggagaacaacatagtgtccc

SEQ ID NO: 24721 - DNA, 20 bp, human
gatttgaggactagaggact

SEQ ID NO: 24722 - DNA, 20 bp, human
gtccaaatagggagtcaaag

SEQ ID NO: 24723 - DNA, 20 bp, human
gcgccaggtgtgcttaatgg

SEQ ID NO: 24724 - DNA, 20 bp, human
ggaagtccaggagtcctgcc

SEQ ID NO: 24725 - DNA, 20 bp, human
ggtcggggagaactagcggc

SEQ ID NO: 24726 - DNA, 20 bp, human
gggaatcggcaccgatctgg

SEQ ID NO: 24727 - DNA, 20 bp, human
ggcaggaatcggcaccgatc

SEQ ID NO: 24728 - DNA, 20 bp, human
gcccaggtcgggacccggga

SEQ ID NO: 24729 - DNA, 20 bp, human
ggaccatgtcccatcactgg

SEQ ID NO: 24730 - DNA, 20 bp, human
gatcggcaccgatctggcgg

SEQ ID NO: 24731 - DNA, 20 bp, human
gtttaaccggacctaggagg

SEQ ID NO: 24732 - DNA, 20 bp, human
gggaggcgcgtagggcccga

SEQ ID NO: 24733 - DNA, 20 bp, human
gcgcgtagggcccgagggag

SEQ ID NO: 24734 - DNA, 20 bp, human
gatggtcgcgctggcggtcg

SEQ ID NO: 24735 - DNA, 20 bp, human
gacccgaggacagtccctcc

SEQ ID NO: 24736 - DNA, 20 bp, human
ggcgactctgcaccacgcag

SEQ ID NO: 24737 - DNA, 20 bp, human
gcaggagccgtccagcacgg

SEQ ID NO: 24738 - DNA, 20 bp, human
ggcacggaggaaggcgacca

SEQ ID NO: 24739 - DNA, 20 bp, human
gcgaccatggccaaggagtg

SEQ ID NO: 24740 - DNA, 20 bp, human
gagccgtccagcacggagga

SEQ ID NO: 24741 - DNA, 20 bp, human
gggggctacgccagtcacaa

SEQ ID NO: 24742 - DNA, 20 bp, human
gccggcaccaagctcaggtt

SEQ ID NO: 24743 - DNA, 20 bp, human
gaggaaggcgaccatggcca

SEQ ID NO: 24744 - DNA, 20 bp, human
gcgccttcctccgtgctgga

SEQ ID NO: 24745 - DNA, 20 bp, human
gctggcgtagccccactcct

SEQ ID NO: 24746 - DNA, 20 bp, human
ggagttgggagtccctgata

SEQ ID NO: 24747 - DNA, 20 bp, human
gtggcccggcgagacgagtt

SEQ ID NO: 24748 - DNA, 20 bp, human
gtgcgcgacccccggctcag

SEQ ID NO: 24749 - DNA, 20 bp, human
gctgagacgcatccttatca

SEQ ID NO: 24750 - DNA, 20 bp, human
ggcgctcctggccctctccg

SEQ ID NO: 24751 - DNA, 20 bp, human
gtaaggatgcgtctcaggcc

SEQ ID NO: 24752 - DNA, 20 bp, human
ggcgagggtgcgggaggact

SEQ ID NO: 24753 - DNA, 20 bp, human
gaggatcgctgcacccgcgg

SEQ ID NO: 24754 - DNA, 20 bp, human
gggcaggatcgctgcacccg

SEQ ID NO: 24755 - DNA, 20 bp, human
gggcgaccggtgagcgtcgg

SEQ ID NO: 24756 - DNA, 20 bp, human
gagaccgtcccgagccagat

SEQ ID NO: 24757 - DNA, 20 bp, human
ggaacccatctggctcggga

SEQ ID NO: 24758 - DNA, 20 bp, human
ggggtctttcgagaggagag

SEQ ID NO: 24759 - DNA, 20 bp, human
ggctgatggggtctttcgag

SEQ ID NO: 24760 - DNA, 20 bp, human
ggtggaaatctgaacccatc

SEQ ID NO: 24761 - DNA, 20 bp, human
gatctgaacccatctggctc

SEQ ID NO: 24762 - DNA, 20 bp, human
gtcgcatcttaggaaatttg

SEQ ID NO: 24763 - DNA, 20 bp, human
gaaggatccagtcgcatctt

SEQ ID NO: 24764 - DNA, 20 bp, human
gttgctggtttgccatgcac

SEQ ID NO: 24765 - DNA, 20 bp, human
ggctgagaacaccatcgccc

SEQ ID NO: 24766 - DNA, 20 bp, human
ggcaggctgcggatccccgt

SEQ ID NO: 24767 - DNA, 20 bp, human
ggagacgctcaggtaaggac

SEQ ID NO: 24768 - DNA, 20 bp, human
gggcgtaacagggcacgagg

SEQ ID NO: 24769 - DNA, 20 bp, human
gatccccgtaggcgagcgag

SEQ ID NO: 24770 - DNA, 20 bp, human
gggtaagggcgacaaatctg

SEQ ID NO: 24771 - DNA, 20 bp, human
ggtgatctggagagacgctc

SEQ ID NO: 24772 - DNA, 20 bp, human
ggggagagcagttccttggt

SEQ ID NO: 24773 - DNA, 20 bp, human
gacgctcaggtaaggacggg

SEQ ID NO: 24774 - DNA, 20 bp, human
gagcggctaggttcgtgatc

SEQ ID NO: 24775 - DNA, 20 bp, human
ggcgcgggagagcagttcct

SEQ ID NO: 24776 - DNA, 20 bp, human
gtggccacccagcaggaaca

SEQ ID NO: 24777 - DNA, 20 bp, human
gagggacagcagaagcacca

SEQ ID NO: 24778 - DNA, 20 bp, human
gcagatgtgcagcaccatga

SEQ ID NO: 24779 - DNA, 20 bp, human
ggggagcatgcagaagctag

SEQ ID NO: 24780 - DNA, 20 bp, human
ggtccagtcagacacatgct

SEQ ID NO: 24781 - DNA, 20 bp, human
gagggtgtgagggtaactgg

SEQ ID NO: 24782 - DNA, 20 bp, human
gtgtctgactggacctactc

SEQ ID NO: 24783 - DNA, 20 bp, human
gtgccctaaaggaggactct

SEQ ID NO: 24784 - DNA, 20 bp, human
gctgtgaaatgccctaaagg

SEQ ID NO: 24785 - DNA, 20 bp, human
gggccaagagtcctccttta

SEQ ID NO: 24786 - DNA, 20 bp, human
ggagcgggctgggcaatcag

SEQ ID NO: 24787 - DNA, 20 bp, human
gggcgagtgagtgagagtct

SEQ ID NO: 24788 - DNA, 20 bp, human
ggagccgcagcccgaacgag

SEQ ID NO: 24789 - DNA, 20 bp, human
gcgagcggaccgagccgacc

SEQ ID NO: 24790 - DNA, 20 bp, human
gagccgaccgggcaggtgca

SEQ ID NO: 24791 - DNA, 20 bp, human
gccgccagcaagcgacctgg

SEQ ID NO: 24792 - DNA, 20 bp, human
gaggcttgggccaagttcgg

SEQ ID NO: 24793 - DNA, 20 bp, human
gcggctcggtccgctcgttc

SEQ ID NO: 24794 - DNA, 20 bp, human
ggcggcatgaccggccacca

SEQ ID NO: 24795 - DNA, 20 bp, human
ggagcagcctcttaaagcag

SEQ ID NO: 24796 - DNA, 20 bp, human
ggtgttccagagacccgcgt

SEQ ID NO: 24797 - DNA, 20 bp, human
gaagtggcagagacccccgt

SEQ ID NO: 24798 - DNA, 20 bp, human
gtgaagctcaggtccgccat

SEQ ID NO: 24799 - DNA, 20 bp, human
gcccgcccgaaacgcaccag

SEQ ID NO: 24800 - DNA, 20 bp, human
ggctcaggtccgccatggga

SEQ ID NO: 24801 - DNA, 20 bp, human
gcggaggccccagcagagcg

SEQ ID NO: 24802 - DNA, 20 bp, human
gcgaaacgcaccaggggagt

SEQ ID NO: 24803 - DNA, 20 bp, human
gtcgggcgggaggcgctcca

SEQ ID NO: 24804 - DNA, 20 bp, human
ggggccccgcggccttccca

SEQ ID NO: 24805 - DNA, 20 bp, human
gagccctgcggaaggctccc

SEQ ID NO: 24806 - DNA, 20 bp, human
gggatcaacagagggagcca

SEQ ID NO: 24807 - DNA, 20 bp, human
gcaggggccgggatcaacag

SEQ ID NO: 24808 - DNA, 20 bp, human
gagccatgcggctgactgtg

SEQ ID NO: 24809 - DNA, 20 bp, human
gcccagcacacggtgtgtac

SEQ ID NO: 24810 - DNA, 20 bp, human
ggtgaacagagcctaggctg

SEQ ID NO: 24811 - DNA, 20 bp, human
gccctgagtgaacagagcct

SEQ ID NO: 24812 - DNA, 20 bp, human
gctccaggagcctcaacagt

SEQ ID NO: 24813 - DNA, 20 bp, human
ggaggaggatccacccggag

SEQ ID NO: 24814 - DNA, 20 bp, human
gaggggagtcatgaacctcc

SEQ ID NO: 24815 - DNA, 20 bp, human
gccctgtgggcattattctg

SEQ ID NO: 24816 - DNA, 20 bp, human
gtcggtcgcaccagagacag

SEQ ID NO: 24817 - DNA, 20 bp, human
gcctctgctgcaaccatcgg

SEQ ID NO: 24818 - DNA, 20 bp, human
gcgactcctgcggccgtggg

SEQ ID NO: 24819 - DNA, 20 bp, human
ggaggaaagtccgctgtctc

SEQ ID NO: 24820 - DNA, 20 bp, human
gatccctctgctgcaaccat

SEQ ID NO: 24821 - DNA, 20 bp, human
gcagcagagggatcatgacg

SEQ ID NO: 24822 - DNA, 20 bp, human
ggcagcagtggaagcactag

SEQ ID NO: 24823 - DNA, 20 bp, human
gagctccaggaagcggccag

SEQ ID NO: 24824 - DNA, 20 bp, human
gagcctgcgccccatccctc

SEQ ID NO: 24825 - DNA, 20 bp, human
ggtcgggcttccagagggat

SEQ ID NO: 24826 - DNA, 20 bp, human
ggcacaggcgaagactaagg

SEQ ID NO: 24827 - DNA, 20 bp, human
gaggagcgggcggaagacaa

SEQ ID NO: 24828 - DNA, 20 bp, human
gggggcacaggcgaagacta

SEQ ID NO: 24829 - DNA, 20 bp, human
gcgggcggaagacaacggag

SEQ ID NO: 24830 - DNA, 20 bp, human
gcggccgggggtcactcacg

SEQ ID NO: 24831 - DNA, 20 bp, human
gtgaaggctctgtgtctccc

SEQ ID NO: 24832 - DNA, 20 bp, human
gcccgacgtcgcgtcctcgg

SEQ ID NO: 24833 - DNA, 20 bp, human
ggcacgtcaaagccgggctc

SEQ ID NO: 24834 - DNA, 20 bp, human
gggcagccgcgggagcccct

SEQ ID NO: 24835 - DNA, 20 bp, human
ggagcgtccgagccactccg

SEQ ID NO: 24836 - DNA, 20 bp, human
ggcagcctcacacctaccgg

SEQ ID NO: 24837 - DNA, 20 bp, human
gatggcagcctcacacctac

SEQ ID NO: 24838 - DNA, 20 bp, human
ggtcgagaggccggcatcac

SEQ ID NO: 24839 - DNA, 20 bp, human
ggaggccggcatcactggag

SEQ ID NO: 24840 - DNA, 20 bp, human
ggtcccagccacacacaaga

SEQ ID NO: 24841 - DNA, 20 bp, human
gcgactacgagtaactccat

SEQ ID NO: 24842 - DNA, 20 bp, human
gggagttactcgtagtcgag

SEQ ID NO: 24843 - DNA, 20 bp, human
gcgcagctgtttcctccggt

SEQ ID NO: 24844 - DNA, 20 bp, human
gaaaggagcaaagctagtag

SEQ ID NO: 24845 - DNA, 20 bp, human
gttactcgtagtcgagaggc

SEQ ID NO: 24846 - DNA, 20 bp, human
ggcaagtgttagagagggag

SEQ ID NO: 24847 - DNA, 20 bp, human
gttgtctcttaatctgtcac

SEQ ID NO: 24848 - DNA, 20 bp, human
gtgccacgcttggtaatagg

SEQ ID NO: 24849 - DNA, 20 bp, human
gactggtttatagaaatgga

SEQ ID NO: 24850 - DNA, 20 bp, human
gctgaaagcaagtgttagag

SEQ ID NO: 24851 - DNA, 20 bp, human
gtaaaagggagctgtgactg

SEQ ID NO: 24852 - DNA, 20 bp, human
gttgttgcttagaaaagcct

SEQ ID NO: 24853 - DNA, 20 bp, human
gtgcctcctattaccaagcg

SEQ ID NO: 24854 - DNA, 20 bp, human
gtctattaaatggacgataa

SEQ ID NO: 24855 - DNA, 20 bp, human
ggaagagtaacagttaccac

SEQ ID NO: 24856 - DNA, 20 bp, human
gcgcgaggctgggttacgtg

SEQ ID NO: 24857 - DNA, 20 bp, human
ggaatgggttccggcctccg

SEQ ID NO: 24858 - DNA, 20 bp, human
gcattctaggcacctcaggg

SEQ ID NO: 24859 - DNA, 20 bp, human
gggagtcgcgctcacccact

SEQ ID NO: 24860 - DNA, 20 bp, human
ggccccagtcagggaaaccg

SEQ ID NO: 24861 - DNA, 20 bp, human
gtggccagatggaactcacc

SEQ ID NO: 24862 - DNA, 20 bp, human
ggggcccgcctcttgcgggg

SEQ ID NO: 24863 - DNA, 20 bp, human
gggcggcgagagccatgaag

SEQ ID NO: 24864 - DNA, 20 bp, human
gggaggttcccagtaaccgc

SEQ ID NO: 24865 - DNA, 20 bp, human
gccagcagacgccaaatcaa

SEQ ID NO: 24866 - DNA, 20 bp, human
gcgccgcaggacgcggagtg

SEQ ID NO: 24867 - DNA, 20 bp, human
gcggccgtccagcgagatgt

SEQ ID NO: 24868 - DNA, 20 bp, human
ggaagccgcgcatggacccg

SEQ ID NO: 24869 - DNA, 20 bp, human
gccgccgcagacggacacaa

SEQ ID NO: 24870 - DNA, 20 bp, human
ggccgccgcccgaacccccc

SEQ ID NO: 24871 - DNA, 20 bp, human
gtccatgcgcggcttccggg

SEQ ID NO: 24872 - DNA, 20 bp, human
gcggcgacccgggctgggta

SEQ ID NO: 24873 - DNA, 20 bp, human
gccgcagacggacacaatgg

SEQ ID NO: 24874 - DNA, 20 bp, human
ggcttccgggggggttcggg

SEQ ID NO: 24875 - DNA, 20 bp, human
gcagcggccaggcgaccggc

SEQ ID NO: 24876 - DNA, 20 bp, human
gcaccggcctcggcctggat

SEQ ID NO: 24877 - DNA, 20 bp, human
gggggtggggcgcttcgcgg

SEQ ID NO: 24878 - DNA, 20 bp, human
ggacgcggggtacagggacg

SEQ ID NO: 24879 - DNA, 20 bp, human
gcccgcgtcctgggctgacc

SEQ ID NO: 24880 - DNA, 20 bp, human
ggcccaggacgcggggtaca

SEQ ID NO: 24881 - DNA, 20 bp, human
gcctctggcgctgcccatcc

SEQ ID NO: 24882 - DNA, 20 bp, human
gaatcctgacccctagtcct

SEQ ID NO: 24883 - DNA, 20 bp, human
ggggcccgagcggccgaggt

SEQ ID NO: 24884 - DNA, 20 bp, human
gtccctgtaccccgcgtcct

SEQ ID NO: 24885 - DNA, 20 bp, human
gggccggtgggcacctgcgt

SEQ ID NO: 24886 - DNA, 20 bp, human
gcggcgacgacggcgaaggt

SEQ ID NO: 24887 - DNA, 20 bp, human
gcccccggcgggcagagaac

SEQ ID NO: 24888 - DNA, 20 bp, human
gccggcgggagccaagcccg

SEQ ID NO: 24889 - DNA, 20 bp, human
ggcgatgtgcgagctcatcg

SEQ ID NO: 24890 - DNA, 20 bp, human
ggcaggagccgggtagccgg

SEQ ID NO: 24891 - DNA, 20 bp, human
gggctgcgctgtcacatggg

SEQ ID NO: 24892 - DNA, 20 bp, human
gggccggcgccgcgagagga

SEQ ID NO: 24893 - DNA, 20 bp, human
ggggcagagaacggggctcc

SEQ ID NO: 24894 - DNA, 20 bp, human
gggcgaaggtcgggacgccg

SEQ ID NO: 24895 - DNA, 20 bp, human
gtggggtccccggacgactg

SEQ ID NO: 24896 - DNA, 20 bp, human
gggggctggcaggagtcctc

SEQ ID NO: 24897 - DNA, 20 bp, human
ggtactcccaggctctcatc

SEQ ID NO: 24898 - DNA, 20 bp, human
gcctgagggtcagatgggat

SEQ ID NO: 24899 - DNA, 20 bp, human
gagctctgtctcctagatgg

SEQ ID NO: 24900 - DNA, 20 bp, human
ggccaggcctggaaccccgg

SEQ ID NO: 24901 - DNA, 20 bp, human
ggaggctggctagcagagag

SEQ ID NO: 24902 - DNA, 20 bp, human
gcatccgccgaggcccaccc

SEQ ID NO: 24903 - DNA, 20 bp, human
gcaggcagcagcatccgccg

SEQ ID NO: 24904 - DNA, 20 bp, human
gctgctcccgatgagagcct

SEQ ID NO: 24905 - DNA, 20 bp, human
gaatccccggcagtactccc

SEQ ID NO: 24906 - DNA, 20 bp, human
gcttccagatcctagagatc

SEQ ID NO: 24907 - DNA, 20 bp, human
gatgccggatctctaggatc

SEQ ID NO: 24908 - DNA, 20 bp, human
gtcctagagatccggcatgg

SEQ ID NO: 24909 - DNA, 20 bp, human
gtcccccatgccggatctct

SEQ ID NO: 24910 - DNA, 20 bp, human
gggtgtgaatgaccgagtat

SEQ ID NO: 24911 - DNA, 20 bp, human
ggacggtgctgtgcatctcc

SEQ ID NO: 24912 - DNA, 20 bp, human
gttcttgttcctggcagcag

SEQ ID NO: 24913 - DNA, 20 bp, human
gaggaagtagtagaagcggc

SEQ ID NO: 24914 - DNA, 20 bp, human
gatgaggactcctaccccca

SEQ ID NO: 24915 - DNA, 20 bp, human
gggagtaggacacgccccat

SEQ ID NO: 24916 - DNA, 20 bp, human
ggaggcagagggcctctcag

SEQ ID NO: 24917 - DNA, 20 bp, human
ggaccacagagcaggcaagg

SEQ ID NO: 24918 - DNA, 20 bp, human
gggagtcacaacccccgcag

SEQ ID NO: 24919 - DNA, 20 bp, human
gcagggagtcaggacgatgt

SEQ ID NO: 24920 - DNA, 20 bp, human
ggtcttcgggaaggttaggt

SEQ ID NO: 24921 - DNA, 20 bp, human
ggctcctctgcatcactctt

SEQ ID NO: 24922 - DNA, 20 bp, human
gcgtcagaagccccctgcgg

SEQ ID NO: 24923 - DNA, 20 bp, human
gaggacccccagcccaatcc

SEQ ID NO: 24924 - DNA, 20 bp, human
ggttaggtgggacctggatt

SEQ ID NO: 24925 - DNA, 20 bp, human
gtcgagtcttcgggaaggtt

SEQ ID NO: 24926 - DNA, 20 bp, human
gtctaagacaccgggaccga

SEQ ID NO: 24927 - DNA, 20 bp, human
gagtgctggagaagataagg

SEQ ID NO: 24928 - DNA, 20 bp, human
ggccagtgagataaatgggt

SEQ ID NO: 24929 - DNA, 20 bp, human
gtgtcacagctctaagacac

SEQ ID NO: 24930 - DNA, 20 bp, human
gtgctgagaaacagcgggtg

SEQ ID NO: 24931 - DNA, 20 bp, human
ggtaagccagtgagataaat

SEQ ID NO: 24932 - DNA, 20 bp, human
gagatgcaggcggggcccat

SEQ ID NO: 24933 - DNA, 20 bp, human
ggggtggggtggagctcgca

SEQ ID NO: 24934 - DNA, 20 bp, human
gaaattccaaggaccctggt

SEQ ID NO: 24935 - DNA, 20 bp, human
gtgatggtgccacagaacca

SEQ ID NO: 24936 - DNA, 20 bp, human
ggctgctccgacagcaggtt

SEQ ID NO: 24937 - DNA, 20 bp, human
gccgccgtcaccgggtggaa

SEQ ID NO: 24938 - DNA, 20 bp, human
gcggcggcgttgatgtaccg

SEQ ID NO: 24939 - DNA, 20 bp, human
gcaacgccgccgtcaccggg

SEQ ID NO: 24940 - DNA, 20 bp, human
gagcccgacgagggagcggg

SEQ ID NO: 24941 - DNA, 20 bp, human
gccggctgggagcccgacga

SEQ ID NO: 24942 - DNA, 20 bp, human
gtacagcctgagcgccgggc

SEQ ID NO: 24943 - DNA, 20 bp, human
gcagcgcccggtggacatcc

SEQ ID NO: 24944 - DNA, 20 bp, human
gtcccggaggacgagctgga

SEQ ID NO: 24945 - DNA, 20 bp, human
ggcgccggcgagcggactag

SEQ ID NO: 24946 - DNA, 20 bp, human
gtggcactgtgcactctcac

SEQ ID NO: 24947 - DNA, 20 bp, human
gtggactcagtggtatctct

SEQ ID NO: 24948 - DNA, 20 bp, human
gacagtgccacttcgcccca

SEQ ID NO: 24949 - DNA, 20 bp, human
gttcactggcatgaaatgtt

SEQ ID NO: 24950 - DNA, 20 bp, human
gtgtgtcaatggtagctaag

SEQ ID NO: 24951 - DNA, 20 bp, human
gttaaagaaacagtagtaac

SEQ ID NO: 24952 - DNA, 20 bp, human
gctctcacaggtcttgcttc

SEQ ID NO: 24953 - DNA, 20 bp, human
gaagaaattacctctctgac

SEQ ID NO: 24954 - DNA, 20 bp, human
ggtaatagagtctcttgtta

SEQ ID NO: 24955 - DNA, 20 bp, human
gcaaatcagaagatgatatg

SEQ ID NO: 24956 - DNA, 20 bp, human
gcccaccgaggcctcagatt

SEQ ID NO: 24957 - DNA, 20 bp, human
gcggggagtgcggttaccta

SEQ ID NO: 24958 - DNA, 20 bp, human
ggcagtgggagaggtcgtcg

SEQ ID NO: 24959 - DNA, 20 bp, human
gatggctccgaagtccccgc

SEQ ID NO: 24960 - DNA, 20 bp, human
gtcaggagccgccggcaagg

SEQ ID NO: 24961 - DNA, 20 bp, human
gcgcggccggaaagcaggtg

SEQ ID NO: 24962 - DNA, 20 bp, human
gggagggtcctcagagtcgg

SEQ ID NO: 24963 - DNA, 20 bp, human
gcgccggcaagggggcaacg

SEQ ID NO: 24964 - DNA, 20 bp, human
ggcaagcgccaagtctcctc

SEQ ID NO: 24965 - DNA, 20 bp, human
ggcctggacttgtccaagag

SEQ ID NO: 24966 - DNA, 20 bp, human
gtgtgagctgcgcctgacgg

SEQ ID NO: 24967 - DNA, 20 bp, human
gtgctcatggtgccaccgtc

SEQ ID NO: 24968 - DNA, 20 bp, human
ggctaccgagccctttgtga

SEQ ID NO: 24969 - DNA, 20 bp, human
gcagctcacagccctcacaa

SEQ ID NO: 24970 - DNA, 20 bp, human
gggagggaccagaaacccca

SEQ ID NO: 24971 - DNA, 20 bp, human
gcagcgcgccggctcggacg

SEQ ID NO: 24972 - DNA, 20 bp, human
gctgggcgccttggtacccc

SEQ ID NO: 24973 - DNA, 20 bp, human
gagacaggcgacacagccag

SEQ ID NO: 24974 - DNA, 20 bp, human
gagcccagcccggggtacca

SEQ ID NO: 24975 - DNA, 20 bp, human
gtagccggccgcgtccgagc

SEQ ID NO: 24976 - DNA, 20 bp, human
gaggcggcggcgaggactga

SEQ ID NO: 24977 - DNA, 20 bp, human
gcggcggcgaggactgacgg

SEQ ID NO: 24978 - DNA, 20 bp, human
gcacccgagcgaggagggaa

SEQ ID NO: 24979 - DNA, 20 bp, human
ggcagccacccgagcgagga

SEQ ID NO: 24980 - DNA, 20 bp, human
gggactgacggcggcccccg

SEQ ID NO: 24981 - DNA, 20 bp, human
gtgcgccgcggggcccgtgt

SEQ ID NO: 24982 - DNA, 20 bp, human
ggcggccgggctgcgagact

SEQ ID NO: 24983 - DNA, 20 bp, human
gtcccagcgcagcgagcagg

SEQ ID NO: 24984 - DNA, 20 bp, human
gggccgccgctcctcttccc

SEQ ID NO: 24985 - DNA, 20 bp, human
ggaaggctcccaaacttagg

SEQ ID NO: 24986 - DNA, 20 bp, human
gccggcagcctcagcatcag

SEQ ID NO: 24987 - DNA, 20 bp, human
gaggatgtacaagcagtcaa

SEQ ID NO: 24988 - DNA, 20 bp, human
ggagagaccggttaaccgtg

SEQ ID NO: 24989 - DNA, 20 bp, human
gtacgctgcggcgaacgatg

SEQ ID NO: 24990 - DNA, 20 bp, human
gcacggcccagcccatcggg

SEQ ID NO: 24991 - DNA, 20 bp, human
gtgtcccgagctgctatccc

SEQ ID NO: 24992 - DNA, 20 bp, human
gggctgggagagagacccgg

SEQ ID NO: 24993 - DNA, 20 bp, human
gctcgggtcgggggctcaga

SEQ ID NO: 24994 - DNA, 20 bp, human
gcgggcagcccggggcgcaa

SEQ ID NO: 24995 - DNA, 20 bp, human
gagggctccgggttacgctg

SEQ ID NO: 24996 - DNA, 20 bp, human
gggccccgcccggcaggata

SEQ ID NO: 24997 - DNA, 20 bp, human
gggccgggcgaggtccgctg

SEQ ID NO: 24998 - DNA, 20 bp, human
gcgcgaagcgcatcaccgag

SEQ ID NO: 24999 - DNA, 20 bp, human
ggccgcctcacccgactccg

SEQ ID NO: 25000 - DNA, 20 bp, human
gcgagtggccatatcctgcc

SEQ ID NO: 25001 - DNA, 20 bp, human
ggccgccggggcccccatag

SEQ ID NO: 25002 - DNA, 20 bp, human
gggagcagccacggagccgc

SEQ ID NO: 25003 - DNA, 20 bp, human
ggtggccatatcctgccggg

SEQ ID NO: 25004 - DNA, 20 bp, human
gcggcccagcggccccggca

SEQ ID NO: 25005 - DNA, 20 bp, human
ggctgaagacgaagagcgag

SEQ ID NO: 25006 - DNA, 20 bp, human
ggaaacagctcctgccagag

SEQ ID NO: 25007 - DNA, 20 bp, human
gatgggaatcaggtaatcgt

SEQ ID NO: 25008 - DNA, 20 bp, human
ggaagaaacgctgcagacca

SEQ ID NO: 25009 - DNA, 20 bp, human
gggagaggcagggcgagaag

SEQ ID NO: 25010 - DNA, 20 bp, human
gaagggagccggcaactcct

SEQ ID NO: 25011 - DNA, 20 bp, human
gttctgcagaggcagcgaga

SEQ ID NO: 25012 - DNA, 20 bp, human
gagccggcaactcctgggcg

SEQ ID NO: 25013 - DNA, 20 bp, human
ggaactgagcaccgcacctc

SEQ ID NO: 25014 - DNA, 20 bp, human
gggaatcaggtaatcgtcgg

SEQ ID NO: 25015 - DNA, 20 bp, human
gggctttcgcgcaagattcg

SEQ ID NO: 25016 - DNA, 20 bp, human
gcctgctgaagcgagaataa

SEQ ID NO: 25017 - DNA, 20 bp, human
gcagccggagctcacatccg

SEQ ID NO: 25018 - DNA, 20 bp, human
ggccgctggctcgggaccgc

SEQ ID NO: 25019 - DNA, 20 bp, human
ggcccgcggtcccgagccag

SEQ ID NO: 25020 - DNA, 20 bp, human
gcggagctcacatccgggga

SEQ ID NO: 25021 - DNA, 20 bp, human
ggaccgcggctcctacctct

SEQ ID NO: 25022 - DNA, 20 bp, human
gagctcacatccggggacgg

SEQ ID NO: 25023 - DNA, 20 bp, human
gcaccaagaggtaggagccg

SEQ ID NO: 25024 - DNA, 20 bp, human
ggcgtctctccgctagagga

SEQ ID NO: 25025 - DNA, 20 bp, human
gtgaagcgagaataagggca

SEQ ID NO: 25026 - DNA, 20 bp, human
gccacctagttcagggagag

SEQ ID NO: 25027 - DNA, 20 bp, human
ggaggaatggagcttcgcag

SEQ ID NO: 25028 - DNA, 20 bp, human
gagctcgcggagctccccag

SEQ ID NO: 25029 - DNA, 20 bp, human
gggcccgctaggtaacagtt

SEQ ID NO: 25030 - DNA, 20 bp, human
gagacgcaccacctagttca

SEQ ID NO: 25031 - DNA, 20 bp, human
gctccgcgagctcttcggag

SEQ ID NO: 25032 - DNA, 20 bp, human
gtagattcaacagttcacag

SEQ ID NO: 25033 - DNA, 20 bp, human
gccagcagagacgcatccaa

SEQ ID NO: 25034 - DNA, 20 bp, human
ggtggtgcgtctgccagaag

SEQ ID NO: 25035 - DNA, 20 bp, human
ggttgcatgctgatccgggg

SEQ ID NO: 25036 - DNA, 20 bp, human
ggaaagatgtcggaatctga

SEQ ID NO: 25037 - DNA, 20 bp, human
ggatgtcggaatctgaaggc

SEQ ID NO: 25038 - DNA, 20 bp, human
gaatctcgaaagaaagatgt

SEQ ID NO: 25039 - DNA, 20 bp, human
gtaacagtattgacatcccg

SEQ ID NO: 25040 - DNA, 20 bp, human
gtcccctagaggctctctgg

SEQ ID NO: 25041 - DNA, 20 bp, human
gtaacctcaacctcaacccc

SEQ ID NO: 25042 - DNA, 20 bp, human
gccttgctccaagggtctgc

SEQ ID NO: 25043 - DNA, 20 bp, human
ggggctctaccttgctccaa

SEQ ID NO: 25044 - DNA, 20 bp, human
gggggtttagactctaacag

SEQ ID NO: 25045 - DNA, 20 bp, human
gtcactttaggtctgtatct

SEQ ID NO: 25046 - DNA, 20 bp, human
gggccccgggcgatccggag

SEQ ID NO: 25047 - DNA, 20 bp, human
ggccccggcgggggcacatc

SEQ ID NO: 25048 - DNA, 20 bp, human
gagcgagcgagcgaaagcgg

SEQ ID NO: 25049 - DNA, 20 bp, human
gtcctcctccggccgagacg

SEQ ID NO: 25050 - DNA, 20 bp, human
gcggcgaagccgccccgaga

SEQ ID NO: 25051 - DNA, 20 bp, human
gcgctccgcgtctcggccgg

SEQ ID NO: 25052 - DNA, 20 bp, human
ggaagccggaacaaagtgag

SEQ ID NO: 25053 - DNA, 20 bp, human
ggctcgctcgctccgcgtct

SEQ ID NO: 25054 - DNA, 20 bp, human
gccgaaggtagcgccgaatc

SEQ ID NO: 25055 - DNA, 20 bp, human
gccggcgacagctacggcag

SEQ ID NO: 25056 - DNA, 20 bp, human
gcgcgggccggggaccggtg

SEQ ID NO: 25057 - DNA, 20 bp, human
ggcgcggcgcaggaaacttc

SEQ ID NO: 25058 - DNA, 20 bp, human
gagcagagcgaggtgagacg

SEQ ID NO: 25059 - DNA, 20 bp, human
gggctcgctcgctgcctcac

SEQ ID NO: 25060 - DNA, 20 bp, human
gtcctgcgccgcgcgcggac

SEQ ID NO: 25061 - DNA, 20 bp, human
gcaggaaacttcgggctgag

SEQ ID NO: 25062 - DNA, 20 bp, human
ggcttcgcgcaagttgaaga

SEQ ID NO: 25063 - DNA, 20 bp, human
ggagcggacgggtgaggccg

SEQ ID NO: 25064 - DNA, 20 bp, human
gaaagacaaagacatcccgg

SEQ ID NO: 25065 - DNA, 20 bp, human
gcccggccgcggctcgactc

SEQ ID NO: 25066 - DNA, 20 bp, human
ggggctgctgcagatgagga

SEQ ID NO: 25067 - DNA, 20 bp, human
gtggtggtgagcgagctcag

SEQ ID NO: 25068 - DNA, 20 bp, human
gcttgatgcaccagttccgg

SEQ ID NO: 25069 - DNA, 20 bp, human
ggagctcagagggtgggtct

SEQ ID NO: 25070 - DNA, 20 bp, human
ggctgctccgtggtgactcc

SEQ ID NO: 25071 - DNA, 20 bp, human
gggcaataggcgccaggtct

SEQ ID NO: 25072 - DNA, 20 bp, human
gcagagagggtggcacgtgg

SEQ ID NO: 25073 - DNA, 20 bp, human
gggccactgggccttggtgg

SEQ ID NO: 25074 - DNA, 20 bp, human
ggctccggctgggagacctg

SEQ ID NO: 25075 - DNA, 20 bp, human
ggaggatcagctccatccag

SEQ ID NO: 25076 - DNA, 20 bp, human
gtcagccagcctagtcccca

SEQ ID NO: 25077 - DNA, 20 bp, human
gaggcctggcacttagacat

SEQ ID NO: 25078 - DNA, 20 bp, human
ggcgggggcattggggacac

SEQ ID NO: 25079 - DNA, 20 bp, human
gggaagggaaagcactgggg

SEQ ID NO: 25080 - DNA, 20 bp, human
gcagcctagtccccaaggcg

SEQ ID NO: 25081 - DNA, 20 bp, human
gtgatgcaggccttcctcag

SEQ ID NO: 25082 - DNA, 20 bp, human
gagctgggggaaggagccct

SEQ ID NO: 25083 - DNA, 20 bp, human
ggaccctggagaaccccctg

SEQ ID NO: 25084 - DNA, 20 bp, human
ggtcaggcagaacaaggccc

SEQ ID NO: 25085 - DNA, 20 bp, human
ggcacaaacttcctacagga

SEQ ID NO: 25086 - DNA, 20 bp, human
gagagacttgtggaagcgag

SEQ ID NO: 25087 - DNA, 20 bp, human
gtggcaggcagagagacttg

SEQ ID NO: 25088 - DNA, 20 bp, human
ggagcggcgctggaaaccgc

SEQ ID NO: 25089 - DNA, 20 bp, human
gcccctccctgcccaagcgg

SEQ ID NO: 25090 - DNA, 20 bp, human
gggaagcgagaggctccgtc

SEQ ID NO: 25091 - DNA, 20 bp, human
gtcttaggcaagtcagaggg

SEQ ID NO: 25092 - DNA, 20 bp, human
gttgcctccgccgccatcaa

SEQ ID NO: 25093 - DNA, 20 bp, human
gggctgcaggaatcggggaa

SEQ ID NO: 25094 - DNA, 20 bp, human
gacgtgacggccgaagggaa

SEQ ID NO: 25095 - DNA, 20 bp, human
gggcccgccgacttacgtga

SEQ ID NO: 25096 - DNA, 20 bp, human
gcggcgagcagcggtagaag

SEQ ID NO: 25097 - DNA, 20 bp, human
gaaggagtagcgcggaccgg

SEQ ID NO: 25098 - DNA, 20 bp, human
gtctccgcgaggggcctccg

SEQ ID NO: 25099 - DNA, 20 bp, human
gaggcccctcgcggagaagg

SEQ ID NO: 25100 - DNA, 20 bp, human
gacgggccgcagcgcctctg

SEQ ID NO: 25101 - DNA, 20 bp, human
gaggcgccgcaggtccgagc

SEQ ID NO: 25102 - DNA, 20 bp, human
ggcttggagccagcgctgca

SEQ ID NO: 25103 - DNA, 20 bp, human
gccccagcagcacacgtaag

SEQ ID NO: 25104 - DNA, 20 bp, human
gcggtgccggctcggacctg

SEQ ID NO: 25105 - DNA, 20 bp, human
gcagcacacgtaagtggcct

SEQ ID NO: 25106 - DNA, 20 bp, human
gcccgaaaggcaggtgcgag

SEQ ID NO: 25107 - DNA, 20 bp, human
gagaggctcacctcaagtga

SEQ ID NO: 25108 - DNA, 20 bp, human
gatctcactcggcaacctgc

SEQ ID NO: 25109 - DNA, 20 bp, human
gtcgcgcgcccggctcactt

SEQ ID NO: 25110 - DNA, 20 bp, human
gccggcctcgccgcccgacg

SEQ ID NO: 25111 - DNA, 20 bp, human
ggcaggagccggcacttaca

SEQ ID NO: 25112 - DNA, 20 bp, human
gggactcgaccccccaaact

SEQ ID NO: 25113 - DNA, 20 bp, human
ggcccgaggagcatctgctc

SEQ ID NO: 25114 - DNA, 20 bp, human
gctcggcaacctgcgggcag

SEQ ID NO: 25115 - DNA, 20 bp, human
ggacgcgggtcccgaaaggc

SEQ ID NO: 25116 - DNA, 20 bp, human
gcctcggagacagggactgg

SEQ ID NO: 25117 - DNA, 20 bp, human
gcaagcaggcctcggagaca

SEQ ID NO: 25118 - DNA, 20 bp, human
gcccagcccgggaagaaagt

SEQ ID NO: 25119 - DNA, 20 bp, human
ggaggcctgcttgctaggtg

SEQ ID NO: 25120 - DNA, 20 bp, human
gggacaggccaagattcctc

SEQ ID NO: 25121 - DNA, 20 bp, human
ggagaggccagcggattaaa

SEQ ID NO: 25122 - DNA, 20 bp, human
gctccccacccaggactgag

SEQ ID NO: 25123 - DNA, 20 bp, human
gcagcctctcagtcctgggt

SEQ ID NO: 25124 - DNA, 20 bp, human
ggaagacctcggccctcctg

SEQ ID NO: 25125 - DNA, 20 bp, human
gttggcctgtccccacgcag

SEQ ID NO: 25126 - DNA, 20 bp, human
gcctcggagacagggactgg

SEQ ID NO: 25127 - DNA, 20 bp, human
gcccagcccgggaagaaagt

SEQ ID NO: 25128 - DNA, 20 bp, human
gcaagcaggcctcggagaca

SEQ ID NO: 25129 - DNA, 20 bp, human
gggacaggccaagattcctc

SEQ ID NO: 25130 - DNA, 20 bp, human
ggaggcctgcttgctaggtg

SEQ ID NO: 25131 - DNA, 20 bp, human
gctccccacccaggactgag

SEQ ID NO: 25132 - DNA, 20 bp, human
gcagcctctcagtcctgggt

SEQ ID NO: 25133 - DNA, 20 bp, human
ggaagacctcggccctcctg

SEQ ID NO: 25134 - DNA, 20 bp, human
ggccaaggcacggaagacaa

SEQ ID NO: 25135 - DNA, 20 bp, human
ggagaggccagcggattaaa

SEQ ID NO: 25136 - DNA, 20 bp, human
gccgagctgggtggctggac

SEQ ID NO: 25137 - DNA, 20 bp, human
ggtgggagccgaaagcagcg

SEQ ID NO: 25138 - DNA, 20 bp, human
gaggcagccgaaggccgagc

SEQ ID NO: 25139 - DNA, 20 bp, human
ggcaggaaggaggcagccga

SEQ ID NO: 25140 - DNA, 20 bp, human
gccgggctccctcagcgcat

SEQ ID NO: 25141 - DNA, 20 bp, human
gccttgacgcgggggagata

SEQ ID NO: 25142 - DNA, 20 bp, human
gagcggcaggaaccttgacg

SEQ ID NO: 25143 - DNA, 20 bp, human
gctccctcagcgcatgggag

SEQ ID NO: 25144 - DNA, 20 bp, human
ggcttgggcaccagcttcag

SEQ ID NO: 25145 - DNA, 20 bp, human
gtcccaggagatccccatgg

SEQ ID NO: 25146 - DNA, 20 bp, human
gatggaactgctagagaacg

SEQ ID NO: 25147 - DNA, 20 bp, human
ggagaggggagccctcagcg

SEQ ID NO: 25148 - DNA, 20 bp, human
ggtggcgcaggagatccaga

SEQ ID NO: 25149 - DNA, 20 bp, human
ggagaacgtggctcccgcgg

SEQ ID NO: 25150 - DNA, 20 bp, human
ggctctcgctacctgtgcgg

SEQ ID NO: 25151 - DNA, 20 bp, human
ggaaaggtcctcgccaggag

SEQ ID NO: 25152 - DNA, 20 bp, human
gtccaagtcgcctcccacag

SEQ ID NO: 25153 - DNA, 20 bp, human
gcgcgctctcgctacctgtg

SEQ ID NO: 25154 - DNA, 20 bp, human
gcccggcggctcacaaagga

SEQ ID NO: 25155 - DNA, 20 bp, human
gcgaagcagccagcccccgg

SEQ ID NO: 25156 - DNA, 20 bp, human
gcagggagtgaaagccccgg

SEQ ID NO: 25157 - DNA, 20 bp, human
ggatatctgtgtaagcgcaa

SEQ ID NO: 25158 - DNA, 20 bp, human
gctgcagctgcggacgataa

SEQ ID NO: 25159 - DNA, 20 bp, human
gaaggagctggggttctccg

SEQ ID NO: 25160 - DNA, 20 bp, human
ggcaagggctttcgtttgtg

SEQ ID NO: 25161 - DNA, 20 bp, human
gttcagaagcctgatccagg

SEQ ID NO: 25162 - DNA, 20 bp, human
gggacgataaaggcgctgtc

SEQ ID NO: 25163 - DNA, 20 bp, human
gttcttcagccttcctccct

SEQ ID NO: 25164 - DNA, 20 bp, human
gtttagaacgagttgatgct

SEQ ID NO: 25165 - DNA, 20 bp, human
gggctttcgtttgtggggag

SEQ ID NO: 25166 - DNA, 20 bp, human
gcccgtgctaggtggaaggt

SEQ ID NO: 25167 - DNA, 20 bp, human
ggggtccccgagcacctacg

SEQ ID NO: 25168 - DNA, 20 bp, human
gcccgccgccacggccccgt

SEQ ID NO: 25169 - DNA, 20 bp, human
gaggggaacgaacccgtgct

SEQ ID NO: 25170 - DNA, 20 bp, human
gtaggagtcgtcatacatgg

SEQ ID NO: 25171 - DNA, 20 bp, human
gggaacgaacccgtgctagg

SEQ ID NO: 25172 - DNA, 20 bp, human
gccgcccccaccctcatcgt

SEQ ID NO: 25173 - DNA, 20 bp, human
gcgaacccgtgctaggtgga

SEQ ID NO: 25174 - DNA, 20 bp, human
gacggccccgtaggtgctcg

SEQ ID NO: 25175 - DNA, 20 bp, human
gagcacctacggggccgtgg

SEQ ID NO: 25176 - DNA, 20 bp, human
gccgaggcgggagcaaaacc

SEQ ID NO: 25177 - DNA, 20 bp, human
gccgctccaagctaggaagg

SEQ ID NO: 25178 - DNA, 20 bp, human
gagcgtgcagagcagcggcc

SEQ ID NO: 25179 - DNA, 20 bp, human
gggagactgcaccgatgggg

SEQ ID NO: 25180 - DNA, 20 bp, human
gactcagggacaggcgctag

SEQ ID NO: 25181 - DNA, 20 bp, human
gctgaggagccagaaaaaaa

SEQ ID NO: 25182 - DNA, 20 bp, human
gcgaggccaggcgtgcaggc

SEQ ID NO: 25183 - DNA, 20 bp, human
gggcagcctagcagccagaa

SEQ ID NO: 25184 - DNA, 20 bp, human
gaggggctagattacaagaa

SEQ ID NO: 25185 - DNA, 20 bp, human
gcctagcagccagaatggta

SEQ ID NO: 25186 - DNA, 20 bp, human
gagggtgaggttatccccag

SEQ ID NO: 25187 - DNA, 20 bp, human
ggggaagccgagccaatcag

SEQ ID NO: 25188 - DNA, 20 bp, human
gccagtctgtggttgaggaa

SEQ ID NO: 25189 - DNA, 20 bp, human
gtaggaaagcggcctctgat

SEQ ID NO: 25190 - DNA, 20 bp, human
ggaaagctaacatcattctg

SEQ ID NO: 25191 - DNA, 20 bp, human
gctaagaaataagaagcggg

SEQ ID NO: 25192 - DNA, 20 bp, human
gtcttgcctggtaaatccac

SEQ ID NO: 25193 - DNA, 20 bp, human
gacagactggtgactgagct

SEQ ID NO: 25194 - DNA, 20 bp, human
gttaggcaacgcagggaaca

SEQ ID NO: 25195 - DNA, 20 bp, human
ggcaaagcattcaagagtgt

SEQ ID NO: 25196 - DNA, 20 bp, human
gccggcggctgcgtctccta

SEQ ID NO: 25197 - DNA, 20 bp, human
gagccgccggaccctgccca

SEQ ID NO: 25198 - DNA, 20 bp, human
ggccgaggcgtgggtgccct

SEQ ID NO: 25199 - DNA, 20 bp, human
ggtgacaagccgagcttggg

SEQ ID NO: 25200 - DNA, 20 bp, human
gcggctgcgtctcctagggc

SEQ ID NO: 25201 - DNA, 20 bp, human
ggtttctctgcctagaaata

SEQ ID NO: 25202 - DNA, 20 bp, human
gaagttgcccttgcgaagga

SEQ ID NO: 25203 - DNA, 20 bp, human
gatccgccagaggccgaagt

SEQ ID NO: 25204 - DNA, 20 bp, human
gaacctgccttccttcgcaa

SEQ ID NO: 25205 - DNA, 20 bp, human
gcaggtgacaagccgagctt

SEQ ID NO: 25206 - DNA, 20 bp, human
gccagccggtagcgagtggg

SEQ ID NO: 25207 - DNA, 20 bp, human
gggtagtgttggcgaagtgg

SEQ ID NO: 25208 - DNA, 20 bp, human
gcacccgtaatgcagtaggt

SEQ ID NO: 25209 - DNA, 20 bp, human
gctgggctcccggagcttag

SEQ ID NO: 25210 - DNA, 20 bp, human
gcgcccagccggtagcgagt

SEQ ID NO: 25211 - DNA, 20 bp, human
gccaggagctttgcagatag

SEQ ID NO: 25212 - DNA, 20 bp, human
gctaaaatgagcgctctcct

SEQ ID NO: 25213 - DNA, 20 bp, human
gttctcctggagaatcgagg

SEQ ID NO: 25214 - DNA, 20 bp, human
gcgctgcccgggcaaaacca

SEQ ID NO: 25215 - DNA, 20 bp, human
gcggcggttattgttgttgg

SEQ ID NO: 25216 - DNA, 20 bp, human
ggcggcaaaggctcctacag

SEQ ID NO: 25217 - DNA, 20 bp, human
gaggagcgtggtaaagacga

SEQ ID NO: 25218 - DNA, 20 bp, human
gaaagacgagggtccgtgca

SEQ ID NO: 25219 - DNA, 20 bp, human
gggcgcatctcaaaccgagc

SEQ ID NO: 25220 - DNA, 20 bp, human
gcagccgggtaacctagtac

SEQ ID NO: 25221 - DNA, 20 bp, human
gctttgccttgagtctcccg

SEQ ID NO: 25222 - DNA, 20 bp, human
ggagggccataggcgaccca

SEQ ID NO: 25223 - DNA, 20 bp, human
ggaagggtgcaggctccggg

SEQ ID NO: 25224 - DNA, 20 bp, human
gactcacacagagacctctc

SEQ ID NO: 25225 - DNA, 20 bp, human
gtgcagtgggcacggactac

SEQ ID NO: 25226 - DNA, 20 bp, human
gcgctggggctcaaactccg

SEQ ID NO: 25227 - DNA, 20 bp, human
gcccgggcgtgcctgcgctc

SEQ ID NO: 25228 - DNA, 20 bp, human
gggtcgcatcgcaccatggt

SEQ ID NO: 25229 - DNA, 20 bp, human
gcacccgccacagaccagag

SEQ ID NO: 25230 - DNA, 20 bp, human
ggtgtgctgcatcgaaggta

SEQ ID NO: 25231 - DNA, 20 bp, human
gcggcgggcggcggactatg

SEQ ID NO: 25232 - DNA, 20 bp, human
gggcgggtgtgctgcatcga

SEQ ID NO: 25233 - DNA, 20 bp, human
gcgaggcgcggcgacgagtg

SEQ ID NO: 25234 - DNA, 20 bp, human
ggggctcaaactccgaggcg

SEQ ID NO: 25235 - DNA, 20 bp, human
gatggccatgagcgagaagg

SEQ ID NO: 25236 - DNA, 20 bp, human
gagaagcgactgcaaagagg

SEQ ID NO: 25237 - DNA, 20 bp, human
gcgtcccgggcagcctagcg

SEQ ID NO: 25238 - DNA, 20 bp, human
gcgatcgcgcaccctggaag

SEQ ID NO: 25239 - DNA, 20 bp, human
gagcccagctcaacaggtgg

SEQ ID NO: 25240 - DNA, 20 bp, human
gtccacgacggacttgaatg

SEQ ID NO: 25241 - DNA, 20 bp, human
gctggtccaatgtccctcgc

SEQ ID NO: 25242 - DNA, 20 bp, human
gtccggctgactggacgggg

SEQ ID NO: 25243 - DNA, 20 bp, human
gcacggtcattggcgccgag

SEQ ID NO: 25244 - DNA, 20 bp, human
gtgtcccaaggatgtatcgg

SEQ ID NO: 25245 - DNA, 20 bp, human
gggtaagagccgggaagacc

SEQ ID NO: 25246 - DNA, 20 bp, human
ggtccccccaagagctccag

SEQ ID NO: 25247 - DNA, 20 bp, human
gcctggctggggctcagaag

SEQ ID NO: 25248 - DNA, 20 bp, human
gtcaatccgggtctcaagag

SEQ ID NO: 25249 - DNA, 20 bp, human
ggtacccaggaagggacctg

SEQ ID NO: 25250 - DNA, 20 bp, human
ggctccagaggaatgagaac

SEQ ID NO: 25251 - DNA, 20 bp, human
gctatctctaaacctcaggg

SEQ ID NO: 25252 - DNA, 20 bp, human
gagatctgagcaccccacta

SEQ ID NO: 25253 - DNA, 20 bp, human
gagaattcggcttcccagga

SEQ ID NO: 25254 - DNA, 20 bp, human
gtctgagcccaagggaaccc

SEQ ID NO: 25255 - DNA, 20 bp, human
gattcaggaaaaggggatag

SEQ ID NO: 25256 - DNA, 20 bp, human
gggtccgagggtcccggagt

SEQ ID NO: 25257 - DNA, 20 bp, human
gctgggcctggcgatcccgg

SEQ ID NO: 25258 - DNA, 20 bp, human
gcggctccgtccgccgagtg

SEQ ID NO: 25259 - DNA, 20 bp, human
gtccgagtcgcagcgagcgt

SEQ ID NO: 25260 - DNA, 20 bp, human
ggaggccgggtccctgagga

SEQ ID NO: 25261 - DNA, 20 bp, human
gcgggacgcccgaattcgag

SEQ ID NO: 25262 - DNA, 20 bp, human
gcgaattcgagcggctatgg

SEQ ID NO: 25263 - DNA, 20 bp, human
ggggcaacaagggacccgag

SEQ ID NO: 25264 - DNA, 20 bp, human
ggcccacgctcgctgcgact

SEQ ID NO: 25265 - DNA, 20 bp, human
ggggacccgagtggctccag

SEQ ID NO: 25266 - DNA, 20 bp, human
ggtcagagcgcggccatggt

SEQ ID NO: 25267 - DNA, 20 bp, human
gcggagaagaaggaccccgg

SEQ ID NO: 25268 - DNA, 20 bp, human
gagagcgcggccatggtcgg

SEQ ID NO: 25269 - DNA, 20 bp, human
gacgggaccccccaccgcgg

SEQ ID NO: 25270 - DNA, 20 bp, human
gatggtcggcggctggtgga

SEQ ID NO: 25271 - DNA, 20 bp, human
gccagaggcccgagtgcgtg

SEQ ID NO: 25272 - DNA, 20 bp, human
gggcctctggtgcgagaagg

SEQ ID NO: 25273 - DNA, 20 bp, human
gacgacgggaccccccaccg

SEQ ID NO: 25274 - DNA, 20 bp, human
gctcgcattagaggagaaga

SEQ ID NO: 25275 - DNA, 20 bp, human
gcacggccggcggcgacgac

SEQ ID NO: 25276 - DNA, 20 bp, human
gcgtagacttcaggagtcaa

SEQ ID NO: 25277 - DNA, 20 bp, human
ggcctccagcaaccagagga

SEQ ID NO: 25278 - DNA, 20 bp, human
gctttgggagggaggaacca

SEQ ID NO: 25279 - DNA, 20 bp, human
gcacaactcggatttctcga

SEQ ID NO: 25280 - DNA, 20 bp, human
gtaccaggaacgaggagact

SEQ ID NO: 25281 - DNA, 20 bp, human
gggtgaactggatgtcatag

SEQ ID NO: 25282 - DNA, 20 bp, human
gaggaagtggaagaaggcat

SEQ ID NO: 25283 - DNA, 20 bp, human
gggaccaaggtggagttagt

SEQ ID NO: 25284 - DNA, 20 bp, human
gttgggggaaagagaggccg

SEQ ID NO: 25285 - DNA, 20 bp, human
gccagttggatatgtgagac

SEQ ID NO: 25286 - DNA, 20 bp, human
gagcgtgtgtcccgacccat

SEQ ID NO: 25287 - DNA, 20 bp, human
gtaacctggcagcggaagga

SEQ ID NO: 25288 - DNA, 20 bp, human
gctcaggagcgcccgaccga

SEQ ID NO: 25289 - DNA, 20 bp, human
gggccactggcccagccgat

SEQ ID NO: 25290 - DNA, 20 bp, human
gggtcgggcgctcctgaggt

SEQ ID NO: 25291 - DNA, 20 bp, human
gggatctccaaccctcggtc

SEQ ID NO: 25292 - DNA, 20 bp, human
ggtgtcccgacccatcggct

SEQ ID NO: 25293 - DNA, 20 bp, human
gctggcccagccgatgggtc

SEQ ID NO: 25294 - DNA, 20 bp, human
gccgagggttggagatcccg

SEQ ID NO: 25295 - DNA, 20 bp, human
gtcagagcgggagccgaagt

SEQ ID NO: 25296 - DNA, 20 bp, human
gcggggctctagtctgggag

SEQ ID NO: 25297 - DNA, 20 bp, human
gagaggcagccgtaaagcag

SEQ ID NO: 25298 - DNA, 20 bp, human
ggccgactagcttgaagacg

SEQ ID NO: 25299 - DNA, 20 bp, human
gtcctgtccacggagaccgc

SEQ ID NO: 25300 - DNA, 20 bp, human
gcgctccggggctctagtct

SEQ ID NO: 25301 - DNA, 20 bp, human
gttgaagacgcggctgacgg

SEQ ID NO: 25302 - DNA, 20 bp, human
gccagcagctgcccccccgg

SEQ ID NO: 25303 - DNA, 20 bp, human
gcaaggaggggctcccgatg

SEQ ID NO: 25304 - DNA, 20 bp, human
gtgcccccccggaggctctc

SEQ ID NO: 25305 - DNA, 20 bp, human
ggacggcggtgggcgctccg

SEQ ID NO: 25306 - DNA, 20 bp, human
ggcccacggaaacggcggta

SEQ ID NO: 25307 - DNA, 20 bp, human
gatcttgcgcagggtcggtg

SEQ ID NO: 25308 - DNA, 20 bp, human
gtcgagcccagcaggcgagt

SEQ ID NO: 25309 - DNA, 20 bp, human
gccgcgatcttgcgcagggt

SEQ ID NO: 25310 - DNA, 20 bp, human
gtgactggcgcgggaccggg

SEQ ID NO: 25311 - DNA, 20 bp, human
gcggtgcggggagtgggtct

SEQ ID NO: 25312 - DNA, 20 bp, human
gaatgaagcttcctgtccac

SEQ ID NO: 25313 - DNA, 20 bp, human
gagtgaggtgtcccccggga

SEQ ID NO: 25314 - DNA, 20 bp, human
gggcgagtgaggtgtccccc

SEQ ID NO: 25315 - DNA, 20 bp, human
ggggaaggcggcgcactgac

SEQ ID NO: 25316 - DNA, 20 bp, human
gcgagtacggagaagcggga

SEQ ID NO: 25317 - DNA, 20 bp, human
gtaggagcctcgggcgcgct

SEQ ID NO: 25318 - DNA, 20 bp, human
ggcagggctgggctccggta

SEQ ID NO: 25319 - DNA, 20 bp, human
gtagccacgtggaccgactc

SEQ ID NO: 25320 - DNA, 20 bp, human
ggatgagcacgccccagtgg

SEQ ID NO: 25321 - DNA, 20 bp, human
ggctggagagaagccgggcg

SEQ ID NO: 25322 - DNA, 20 bp, human
ggcccatgggcaccgaatgg

SEQ ID NO: 25323 - DNA, 20 bp, human
gttatggcgctggggcccat

SEQ ID NO: 25324 - DNA, 20 bp, human
ggctccggtagggcaccctt

SEQ ID NO: 25325 - DNA, 20 bp, human
ggaaggactgcaaactccac

SEQ ID NO: 25326 - DNA, 20 bp, human
gctgaggcaggtgcccgaca

SEQ ID NO: 25327 - DNA, 20 bp, human
gagccaacgccgccagtctg

SEQ ID NO: 25328 - DNA, 20 bp, human
ggcactacactcgccatgtc

SEQ ID NO: 25329 - DNA, 20 bp, human
gagcggatcccagtgtgcgg

SEQ ID NO: 25330 - DNA, 20 bp, human
gtcccagtgtgcggcggcag

SEQ ID NO: 25331 - DNA, 20 bp, human
gcgagtgtagtgctgccgag

SEQ ID NO: 25332 - DNA, 20 bp, human
gagtgtggagaggaaactca

SEQ ID NO: 25333 - DNA, 20 bp, human
gttcggatgtaggaagtggg

SEQ ID NO: 25334 - DNA, 20 bp, human
gcgggggctgtaaagcatgg

SEQ ID NO: 25335 - DNA, 20 bp, human
gtgcagagtggagtgagaat

SEQ ID NO: 25336 - DNA, 20 bp, human
gtacgaagcaccagacacaa

SEQ ID NO: 25337 - DNA, 20 bp, human
gggatcggcggcagcagaag

SEQ ID NO: 25338 - DNA, 20 bp, human
ggccgggaggaggacaccag

SEQ ID NO: 25339 - DNA, 20 bp, human
gggcgagggctgcaaggagt

SEQ ID NO: 25340 - DNA, 20 bp, human
gcacaagggcaagctcagag

SEQ ID NO: 25341 - DNA, 20 bp, human
gacccgcggactcggatcgg

SEQ ID NO: 25342 - DNA, 20 bp, human
ggtggaagcagcgctagtgg

SEQ ID NO: 25343 - DNA, 20 bp, human
gcgctgcagccggagcatcc

SEQ ID NO: 25344 - DNA, 20 bp, human
gcggctgcaccaccagcagg

SEQ ID NO: 25345 - DNA, 20 bp, human
ggcaaagcacccgcagaatg

SEQ ID NO: 25346 - DNA, 20 bp, human
gtcggccccgggctccgaag

SEQ ID NO: 25347 - DNA, 20 bp, human
ggggctccgaagcggctcgg

SEQ ID NO: 25348 - DNA, 20 bp, human
ggacacaagggtattagcag

SEQ ID NO: 25349 - DNA, 20 bp, human
gggcgagcctgaatccccgg

SEQ ID NO: 25350 - DNA, 20 bp, human
gctcccaggacggtgagtga

SEQ ID NO: 25351 - DNA, 20 bp, human
gcccacagtccacagagaca

SEQ ID NO: 25352 - DNA, 20 bp, human
gactacgatgttgaccgaaa

SEQ ID NO: 25353 - DNA, 20 bp, human
gggaggtggggagtgacccg

SEQ ID NO: 25354 - DNA, 20 bp, human
gcagtcgcggggattaaata

SEQ ID NO: 25355 - DNA, 20 bp, human
gcggtccccacctcggcccc

SEQ ID NO: 25356 - DNA, 20 bp, human
gccgggcccggcgcttccag

SEQ ID NO: 25357 - DNA, 20 bp, human
gactgagggatagaggacaa

SEQ ID NO: 25358 - DNA, 20 bp, human
gggacgaggagccagacggg

SEQ ID NO: 25359 - DNA, 20 bp, human
ggacagagggacgcagagac

SEQ ID NO: 25360 - DNA, 20 bp, human
gtcagagacgggcggacaga

SEQ ID NO: 25361 - DNA, 20 bp, human
gcagcgggaccggcctgggg

SEQ ID NO: 25362 - DNA, 20 bp, human
gggcggcggcaccatgggcc

SEQ ID NO: 25363 - DNA, 20 bp, human
gggatagaggacaagggtag

SEQ ID NO: 25364 - DNA, 20 bp, human
gagcggccactggaagcgcc

SEQ ID NO: 25365 - DNA, 20 bp, human
gcgcgcaggctggatcccgg

SEQ ID NO: 25366 - DNA, 20 bp, human
gcgcagccggatgccatctg

SEQ ID NO: 25367 - DNA, 20 bp, human
ggaatcggatgagatcgtgg

SEQ ID NO: 25368 - DNA, 20 bp, human
gccgggcagaggatcagtcg

SEQ ID NO: 25369 - DNA, 20 bp, human
ggaagaatcggatgagatcg

SEQ ID NO: 25370 - DNA, 20 bp, human
ggctctcgctccctgacctg

SEQ ID NO: 25371 - DNA, 20 bp, human
gacccgggagagctgatccc

SEQ ID NO: 25372 - DNA, 20 bp, human
gatgcagccaagagccgaag

SEQ ID NO: 25373 - DNA, 20 bp, human
ggacaggcgcgcgccggacg

SEQ ID NO: 25374 - DNA, 20 bp, human
gtgctcggctcggccccgtc

SEQ ID NO: 25375 - DNA, 20 bp, human
ggcgtccgtggactcgaggt

SEQ ID NO: 25376 - DNA, 20 bp, human
gccaagcgcctcacccccgg

SEQ ID NO: 25377 - DNA, 20 bp, human
ggctgcgcccgcgggtctga

SEQ ID NO: 25378 - DNA, 20 bp, human
ggcagcggccgcagaacgaa

SEQ ID NO: 25379 - DNA, 20 bp, human
ggctggacgatgagcaggag

SEQ ID NO: 25380 - DNA, 20 bp, human
gtgctgcctccgggccatgt

SEQ ID NO: 25381 - DNA, 20 bp, human
gtgggctgcttggcgttgaa

SEQ ID NO: 25382 - DNA, 20 bp, human
gcgacgtgtccggaaagccc

SEQ ID NO: 25383 - DNA, 20 bp, human
gggctgccaccagcacatcg

SEQ ID NO: 25384 - DNA, 20 bp, human
ggcctccgggccatgtcggt

SEQ ID NO: 25385 - DNA, 20 bp, human
gcgaagaggagtcggacgag

SEQ ID NO: 25386 - DNA, 20 bp, human
gcaaaacccggtgcagaggg

SEQ ID NO: 25387 - DNA, 20 bp, human
gagagccaggtccgtagcgt

SEQ ID NO: 25388 - DNA, 20 bp, human
ggcccgagcgaccctactgt

SEQ ID NO: 25389 - DNA, 20 bp, human
gctggatggcgcgctgtata

SEQ ID NO: 25390 - DNA, 20 bp, human
ggcgggcggacgtcacacag

SEQ ID NO: 25391 - DNA, 20 bp, human
ggtttcttggacccacgcta

SEQ ID NO: 25392 - DNA, 20 bp, human
gagacaccgcacccacagta

SEQ ID NO: 25393 - DNA, 20 bp, human
ggcggtgtcttcccagagag

SEQ ID NO: 25394 - DNA, 20 bp, human
gggaaggcgtgttgagtagc

SEQ ID NO: 25395 - DNA, 20 bp, human
gagtttgtgagagtccttgg

SEQ ID NO: 25396 - DNA, 20 bp, human
gttccaggaacggtaatggt

SEQ ID NO: 25397 - DNA, 20 bp, human
gtcagcgtgtgcgcgagtca

SEQ ID NO: 25398 - DNA, 20 bp, human
gcgctgccgggcgctgtcct

SEQ ID NO: 25399 - DNA, 20 bp, human
ggaactgggtgcggggtgta

SEQ ID NO: 25400 - DNA, 20 bp, human
gacagtttggcggccagtcg

SEQ ID NO: 25401 - DNA, 20 bp, human
ggatcaggaggctcagaaaa

SEQ ID NO: 25402 - DNA, 20 bp, human
gtgtctgtgtccgcgcgagg

SEQ ID NO: 25403 - DNA, 20 bp, human
ggagggataatgggatcagg

SEQ ID NO: 25404 - DNA, 20 bp, human
ggtctttccaggaacggtaa

SEQ ID NO: 25405 - DNA, 20 bp, human
gcagatctcgaaaaactgtg

SEQ ID NO: 25406 - DNA, 20 bp, human
gcggccaggtgcaggtaagg

SEQ ID NO: 25407 - DNA, 20 bp, human
gtgctgctgcgggccagcca

SEQ ID NO: 25408 - DNA, 20 bp, human
gcgcggagcgggagcggtgc

SEQ ID NO: 25409 - DNA, 20 bp, human
gtaaaggtgcaaatgcgggt

SEQ ID NO: 25410 - DNA, 20 bp, human
gaggggacctgcggtgaagg

SEQ ID NO: 25411 - DNA, 20 bp, human
ggtctccgagcggctcgcca

SEQ ID NO: 25412 - DNA, 20 bp, human
ggctcggccaggtgcaggta

SEQ ID NO: 25413 - DNA, 20 bp, human
ggatggcagggggaacctgg

SEQ ID NO: 25414 - DNA, 20 bp, human
gagggggcggcgctgaatgc

SEQ ID NO: 25415 - DNA, 20 bp, human
gggctctggcactcgcgctg

SEQ ID NO: 25416 - DNA, 20 bp, human
ggactgtccgatccaaccta

SEQ ID NO: 25417 - DNA, 20 bp, human
gggaccgcgcacagagcctg

SEQ ID NO: 25418 - DNA, 20 bp, human
gggaagcggcggcgacactt

SEQ ID NO: 25419 - DNA, 20 bp, human
ggtgtcgccgccgcttccac

SEQ ID NO: 25420 - DNA, 20 bp, human
gcagacggtgcgatcaggga

SEQ ID NO: 25421 - DNA, 20 bp, human
gcggcggcgacacttgggct

SEQ ID NO: 25422 - DNA, 20 bp, human
gctggagcccagcagtccca

SEQ ID NO: 25423 - DNA, 20 bp, human
gtacctgagccaggatctcg

SEQ ID NO: 25424 - DNA, 20 bp, human
gaacctggaacagagcggat

SEQ ID NO: 25425 - DNA, 20 bp, human
gggccagtctcgggacactc

SEQ ID NO: 25426 - DNA, 20 bp, human
gtcaggctgtcttacctgaa

SEQ ID NO: 25427 - DNA, 20 bp, human
ggaattgtctgataccagtg

SEQ ID NO: 25428 - DNA, 20 bp, human
ggaggctgcctgcctgcaac

SEQ ID NO: 25429 - DNA, 20 bp, human
gagcatcttggtcctgttgc

SEQ ID NO: 25430 - DNA, 20 bp, human
gtcagtacaccacacttaag

SEQ ID NO: 25431 - DNA, 20 bp, human
gccttaccccggccccctgt

SEQ ID NO: 25432 - DNA, 20 bp, human
gtctgataccagtgtggttc

SEQ ID NO: 25433 - DNA, 20 bp, human
gatgcttaaaaaccgacagg

SEQ ID NO: 25434 - DNA, 20 bp, human
gcaggaagggggagaacttt

SEQ ID NO: 25435 - DNA, 20 bp, human
gatgagtacataccttaccc

SEQ ID NO: 25436 - DNA, 20 bp, human
gatcccgggaaggctcacca

SEQ ID NO: 25437 - DNA, 20 bp, human
gcaccagggaggcgcctcag

SEQ ID NO: 25438 - DNA, 20 bp, human
gcgcctcagaggaaagctca

SEQ ID NO: 25439 - DNA, 20 bp, human
ggcgagcggccggtcgaccc

SEQ ID NO: 25440 - DNA, 20 bp, human
gctcagggttccgacctccc

SEQ ID NO: 25441 - DNA, 20 bp, human
gcaggtgtggtgttcatccc

SEQ ID NO: 25442 - DNA, 20 bp, human
gccggaccggaatcccggga

SEQ ID NO: 25443 - DNA, 20 bp, human
gagtttcagggcagcgcgag

SEQ ID NO: 25444 - DNA, 20 bp, human
ggtgttcatcccgggtcgac

SEQ ID NO: 25445 - DNA, 20 bp, human
ggaacgaaacatgctcccga

SEQ ID NO: 25446 - DNA, 20 bp, human
ggaacagctgatccgtctgt

SEQ ID NO: 25447 - DNA, 20 bp, human
gttgttgttggtgaaaggtg

SEQ ID NO: 25448 - DNA, 20 bp, human
gagcactccgacttctggag

SEQ ID NO: 25449 - DNA, 20 bp, human
gggagagagggaagacgtgt

SEQ ID NO: 25450 - DNA, 20 bp, human
gagaaacttggcctaattgg

SEQ ID NO: 25451 - DNA, 20 bp, human
gttacgacgctgaatccctg

SEQ ID NO: 25452 - DNA, 20 bp, human
gggcctttggatttgcgtag

SEQ ID NO: 25453 - DNA, 20 bp, human
ggtctgttgggtaagaaact

SEQ ID NO: 25454 - DNA, 20 bp, human
gtcccatcccctactctgta

SEQ ID NO: 25455 - DNA, 20 bp, human
gctcccctacgcaaatccaa

SEQ ID NO: 25456 - DNA, 20 bp, human
gcagggacagcaaccagcag

SEQ ID NO: 25457 - DNA, 20 bp, human
gcagcggcgcgacagcaaca

SEQ ID NO: 25458 - DNA, 20 bp, human
gggactgcaagtctgaatgt

SEQ ID NO: 25459 - DNA, 20 bp, human
gccctggtgagtgcctcaag

SEQ ID NO: 25460 - DNA, 20 bp, human
ggacagcaacagggcagagt

SEQ ID NO: 25461 - DNA, 20 bp, human
ggccaacggcgatgacatcc

SEQ ID NO: 25462 - DNA, 20 bp, human
gacctccgcctcgaagccaa

SEQ ID NO: 25463 - DNA, 20 bp, human
ggtgagtgcctcaagtggaa

SEQ ID NO: 25464 - DNA, 20 bp, human
gatcgccgttggcttcgagg

SEQ ID NO: 25465 - DNA, 20 bp, human
gacagggcagagtgggacgg

SEQ ID NO: 25466 - DNA, 20 bp, human
gaacaggacccctaccatgg

SEQ ID NO: 25467 - DNA, 20 bp, human
gcataacaggacccctacca

SEQ ID NO: 25468 - DNA, 20 bp, human
gccagcaagacagctgatgt

SEQ ID NO: 25469 - DNA, 20 bp, human
gtctttgatggtctcctcca

SEQ ID NO: 25470 - DNA, 20 bp, human
gtgaaatgtggaacagagta

SEQ ID NO: 25471 - DNA, 20 bp, human
gctcgtcgaaaggattggat

SEQ ID NO: 25472 - DNA, 20 bp, human
ggtgtcaagctaaaataaga

SEQ ID NO: 25473 - DNA, 20 bp, human
gcacagagagtcacacagtt

SEQ ID NO: 25474 - DNA, 20 bp, human
gacatgtgacgtcccctcca

SEQ ID NO: 25475 - DNA, 20 bp, human
ggatgtggggggatctttga

SEQ ID NO: 25476 - DNA, 20 bp, human
gggtgagcctcctggactct

SEQ ID NO: 25477 - DNA, 20 bp, human
gagcccaccagcgtctgggt

SEQ ID NO: 25478 - DNA, 20 bp, human
gagcccacccagacgctggt

SEQ ID NO: 25479 - DNA, 20 bp, human
gttcacagctgggagagcgc

SEQ ID NO: 25480 - DNA, 20 bp, human
ggccgggaaggtgagcctcc

SEQ ID NO: 25481 - DNA, 20 bp, human
ggtggttcagacccaagtct

SEQ ID NO: 25482 - DNA, 20 bp, human
gcgcccagtgacagaattcc

SEQ ID NO: 25483 - DNA, 20 bp, human
gattctgtcactgggcggct

SEQ ID NO: 25484 - DNA, 20 bp, human
gagtgacagaattccaggta

SEQ ID NO: 25485 - DNA, 20 bp, human
ggttcgcaggtgtggctcca

SEQ ID NO: 25486 - DNA, 20 bp, human
gttgatggtcctaaagcagg

SEQ ID NO: 25487 - DNA, 20 bp, human
gttcagttagcagagcttga

SEQ ID NO: 25488 - DNA, 20 bp, human
ggcaatgtgatcctgcaatt

SEQ ID NO: 25489 - DNA, 20 bp, human
gatttacccacaagcaaggt

SEQ ID NO: 25490 - DNA, 20 bp, human
ggtattcatgttggggtagt

SEQ ID NO: 25491 - DNA, 20 bp, human
gtagataatattgtttacca

SEQ ID NO: 25492 - DNA, 20 bp, human
gcaagtattaaaaatctaaa

SEQ ID NO: 25493 - DNA, 20 bp, human
ggtagtattctcatatagtt

SEQ ID NO: 25494 - DNA, 20 bp, human
gatttccttaagagctggac

SEQ ID NO: 25495 - DNA, 20 bp, human
gagagatttacccacaagca

SEQ ID NO: 25496 - DNA, 20 bp, human
gcccgaggactaagtcggaa

SEQ ID NO: 25497 - DNA, 20 bp, human
gagagagcaagcaggcgggc

SEQ ID NO: 25498 - DNA, 20 bp, human
gttcttcccgaggactaagt

SEQ ID NO: 25499 - DNA, 20 bp, human
gatggcagtgaagcccagtc

SEQ ID NO: 25500 - DNA, 20 bp, human
gaggactaagtcggaaagga

SEQ ID NO: 25501 - DNA, 20 bp, human
gtatcaggtataatctcata

SEQ ID NO: 25502 - DNA, 20 bp, human
gccttccgggaatatccgta

SEQ ID NO: 25503 - DNA, 20 bp, human
ggcagtaggcttgctaacac

SEQ ID NO: 25504 - DNA, 20 bp, human
gagtttcagactacaaggta

SEQ ID NO: 25505 - DNA, 20 bp, human
ggtgagcagtctggtgcagt

SEQ ID NO: 25506 - DNA, 20 bp, human
ggagagcccgagtcatgagg

SEQ ID NO: 25507 - DNA, 20 bp, human
gcaggagagcccgagtcatg

SEQ ID NO: 25508 - DNA, 20 bp, human
gtcgaaggccgagtacatct

SEQ ID NO: 25509 - DNA, 20 bp, human
gggtgcccacctcatgactc

SEQ ID NO: 25510 - DNA, 20 bp, human
gtggccgtcacgctactcga

SEQ ID NO: 25511 - DNA, 20 bp, human
gcaagcagaaagagcaccag

SEQ ID NO: 25512 - DNA, 20 bp, human
ggcagcaggggccctcttgg

SEQ ID NO: 25513 - DNA, 20 bp, human
ggtccatgctggccgaagag

SEQ ID NO: 25514 - DNA, 20 bp, human
gaacatgtagcgcaacacag

SEQ ID NO: 25515 - DNA, 20 bp, human
gaccaggagtccttcatgaa

SEQ ID NO: 25516 - DNA, 20 bp, human
gctgcccccaggccaaggat

SEQ ID NO: 25517 - DNA, 20 bp, human
ggagtctgcgcgccagtgag

SEQ ID NO: 25518 - DNA, 20 bp, human
gcaagatacctgcacagggt

SEQ ID NO: 25519 - DNA, 20 bp, human
ggtgtcagcggagcatggtg

SEQ ID NO: 25520 - DNA, 20 bp, human
gtggagggaacctcagctag

SEQ ID NO: 25521 - DNA, 20 bp, human
gggagagaggcccctagctg

SEQ ID NO: 25522 - DNA, 20 bp, human
gcataaactggctcaaagtg

SEQ ID NO: 25523 - DNA, 20 bp, human
gtcttctgcacgggggcctg

SEQ ID NO: 25524 - DNA, 20 bp, human
gtcccggcgccaccaggcag

SEQ ID NO: 25525 - DNA, 20 bp, human
gtaaggaaggggccctccct

SEQ ID NO: 25526 - DNA, 20 bp, human
gaggaggccgcagagaaaca

SEQ ID NO: 25527 - DNA, 20 bp, human
gtactggatcccgggagcct

SEQ ID NO: 25528 - DNA, 20 bp, human
gggacaggctctcaccacaa

SEQ ID NO: 25529 - DNA, 20 bp, human
ggggatccagtaggcactta

SEQ ID NO: 25530 - DNA, 20 bp, human
gggcaccggaggaaggaccc

SEQ ID NO: 25531 - DNA, 20 bp, human
gagagaaacagggcgagcgg

SEQ ID NO: 25532 - DNA, 20 bp, human
gccggcccgcagggcaccgg

SEQ ID NO: 25533 - DNA, 20 bp, human
gggagtggcgccggcccgca

SEQ ID NO: 25534 - DNA, 20 bp, human
gctcgccaaccggcagtctg

SEQ ID NO: 25535 - DNA, 20 bp, human
gatcaccacagactgccggt

SEQ ID NO: 25536 - DNA, 20 bp, human
ggccgcctgactacgagtaa

SEQ ID NO: 25537 - DNA, 20 bp, human
gctgactacgagtaacggca

SEQ ID NO: 25538 - DNA, 20 bp, human
gagtggtgctgggagtgtcg

SEQ ID NO: 25539 - DNA, 20 bp, human
ggaccaagtccagctccaag

SEQ ID NO: 25540 - DNA, 20 bp, human
gttggtcgtaggccgtccac

SEQ ID NO: 25541 - DNA, 20 bp, human
gatctcggcgacctctgcca

SEQ ID NO: 25542 - DNA, 20 bp, human
gcagactcgcgctccggcag

SEQ ID NO: 25543 - DNA, 20 bp, human
ggtaggccgtccacgggcag

SEQ ID NO: 25544 - DNA, 20 bp, human
gccggccgcaactgcagcgg

SEQ ID NO: 25545 - DNA, 20 bp, human
gcagcagctgcgcttaaagg

SEQ ID NO: 25546 - DNA, 20 bp, human
ggtacaaaccagccaatcag

SEQ ID NO: 25547 - DNA, 20 bp, human
gggaggcgaattagtccgag

SEQ ID NO: 25548 - DNA, 20 bp, human
ggcccccctgaagagaatgg

SEQ ID NO: 25549 - DNA, 20 bp, human
gaagccgcaccgcgtcccgg

SEQ ID NO: 25550 - DNA, 20 bp, human
gcggtggagcggcccctgag

SEQ ID NO: 25551 - DNA, 20 bp, human
ggacagcccagtgcacggga

SEQ ID NO: 25552 - DNA, 20 bp, human
ggcaaagtagcgcccctcag

SEQ ID NO: 25553 - DNA, 20 bp, human
gtggatgcggcggagggatc

SEQ ID NO: 25554 - DNA, 20 bp, human
gctccgccgcatccagataa

SEQ ID NO: 25555 - DNA, 20 bp, human
gaggtggtgaagctcctcgg

SEQ ID NO: 25556 - DNA, 20 bp, human
gggccgttgagggaccgttg

SEQ ID NO: 25557 - DNA, 20 bp, human
gcgccccaacggtccctcaa

SEQ ID NO: 25558 - DNA, 20 bp, human
ggggacgtctggatcaccag

SEQ ID NO: 25559 - DNA, 20 bp, human
gggaggatcgggaccctcag

SEQ ID NO: 25560 - DNA, 20 bp, human
gctctgaggcgggcttaacg

SEQ ID NO: 25561 - DNA, 20 bp, human
gggtcccgatcctccatccg

SEQ ID NO: 25562 - DNA, 20 bp, human
ggaaccccggatggaggatc

SEQ ID NO: 25563 - DNA, 20 bp, human
gcccggacgccccccactct

SEQ ID NO: 25564 - DNA, 20 bp, human
gggctctgtcgccccctcag

SEQ ID NO: 25565 - DNA, 20 bp, human
gctcagtgggacccctcaaa

SEQ ID NO: 25566 - DNA, 20 bp, human
gtggcaggtggagatccggg

SEQ ID NO: 25567 - DNA, 20 bp, human
ggctgcgacacgtcatgacc

SEQ ID NO: 25568 - DNA, 20 bp, human
gtgttcgacaaggacggcaa

SEQ ID NO: 25569 - DNA, 20 bp, human
ggagaagctgagtgacgagg

SEQ ID NO: 25570 - DNA, 20 bp, human
gagatcgaccgggacggcaa

SEQ ID NO: 25571 - DNA, 20 bp, human
gaaggacacggacaacgagg

SEQ ID NO: 25572 - DNA, 20 bp, human
gtccgcgtgttcgacaagga

SEQ ID NO: 25573 - DNA, 20 bp, human
ggccttccgcgtgttcgaca

SEQ ID NO: 25574 - DNA, 20 bp, human
gctgggccagaaccccacgg

SEQ ID NO: 25575 - DNA, 20 bp, human
ggaggtggacgagatgatcc

SEQ ID NO: 25576 - DNA, 20 bp, human
gggcctcggctgctacccgt

SEQ ID NO: 25577 - DNA, 20 bp, human
gctgggagcagcaagcccac

SEQ ID NO: 25578 - DNA, 20 bp, human
gagcccacgggtagcagccg

SEQ ID NO: 25579 - DNA, 20 bp, human
ggaggaaagggaactgaacg

SEQ ID NO: 25580 - DNA, 20 bp, human
gagggccaagagctgcgggg

SEQ ID NO: 25581 - DNA, 20 bp, human
ggcagctcttggccctgggt

SEQ ID NO: 25582 - DNA, 20 bp, human
gagagagaccattaaaggta

SEQ ID NO: 25583 - DNA, 20 bp, human
gcagtgtgacttacaagcca

SEQ ID NO: 25584 - DNA, 20 bp, human
gcgctaagacagaacttact

SEQ ID NO: 25585 - DNA, 20 bp, human
ggagaaaggaaaacagtcag

SEQ ID NO: 25586 - DNA, 20 bp, human
ggacgctgcccggatccctg

SEQ ID NO: 25587 - DNA, 20 bp, human
gcaggcagccgcagggatcc

SEQ ID NO: 25588 - DNA, 20 bp, human
gagctcgtggtccagagtgc

SEQ ID NO: 25589 - DNA, 20 bp, human
gtgccaaggcagaactgtct

SEQ ID NO: 25590 - DNA, 20 bp, human
gcagcaggttgagggccggt

SEQ ID NO: 25591 - DNA, 20 bp, human
ggcccgcctgagctcgtcca

SEQ ID NO: 25592 - DNA, 20 bp, human
gggcgacggccacatcaccg

SEQ ID NO: 25593 - DNA, 20 bp, human
gccagctcctcctgcggcag

SEQ ID NO: 25594 - DNA, 20 bp, human
gtccgcgccttcgaccagga

SEQ ID NO: 25595 - DNA, 20 bp, human
gagagcagcaggttgagggc

SEQ ID NO: 25596 - DNA, 20 bp, human
gctgcagggtggtgacacca

SEQ ID NO: 25597 - DNA, 20 bp, human
ggcccaccagagactccatc

SEQ ID NO: 25598 - DNA, 20 bp, human
gaggaagccgagagcagggt

SEQ ID NO: 25599 - DNA, 20 bp, human
ggcccaggaagcagaaccct

SEQ ID NO: 25600 - DNA, 20 bp, human
gcaccctggccccggaacaa

SEQ ID NO: 25601 - DNA, 20 bp, human
gagcagccttaccatgtcgg

SEQ ID NO: 25602 - DNA, 20 bp, human
ggcccgatggagtctctggt

SEQ ID NO: 25603 - DNA, 20 bp, human
ggtgacaccagggctgctgt

SEQ ID NO: 25604 - DNA, 20 bp, human
gctgacaggattctgcaggg

SEQ ID NO: 25605 - DNA, 20 bp, human
gtgtctgacaggattctgca

SEQ ID NO: 25606 - DNA, 20 bp, human
gaccgagggagccattggag

SEQ ID NO: 25607 - DNA, 20 bp, human
gtgcgctgcttggaaaccga

SEQ ID NO: 25608 - DNA, 20 bp, human
gtggaaaccgagggagccat

SEQ ID NO: 25609 - DNA, 20 bp, human
ggcgctccgagtcgacgagg

SEQ ID NO: 25610 - DNA, 20 bp, human
ggagggagccattggagagg

SEQ ID NO: 25611 - DNA, 20 bp, human
gggagccattggagaggcgg

SEQ ID NO: 25612 - DNA, 20 bp, human
gccaacctccgcctctccaa

SEQ ID NO: 25613 - DNA, 20 bp, human
gttccaagcagcgcaacctg

SEQ ID NO: 25614 - DNA, 20 bp, human
gccagctcctccgagggtcg

SEQ ID NO: 25615 - DNA, 20 bp, human
gctgcgccccagctcctccg

SEQ ID NO: 25616 - DNA, 20 bp, human
ggtgccctgctccttcctga

SEQ ID NO: 25617 - DNA, 20 bp, human
gtcctcagaatgatggaccg

SEQ ID NO: 25618 - DNA, 20 bp, human
gggagaatctctaagccatc

SEQ ID NO: 25619 - DNA, 20 bp, human
gtgacaggcaagtcgagtca

SEQ ID NO: 25620 - DNA, 20 bp, human
gggaaattctccaagatcca

SEQ ID NO: 25621 - DNA, 20 bp, human
gctgcagctcctcagaatga

SEQ ID NO: 25622 - DNA, 20 bp, human
gtaagccatcaggaaggagc

SEQ ID NO: 25623 - DNA, 20 bp, human
gtacctcctgctgatctcgg

SEQ ID NO: 25624 - DNA, 20 bp, human
gtctccaaggggaaaggacc

SEQ ID NO: 25625 - DNA, 20 bp, human
gggcagggcaccgatttgac

SEQ ID NO: 25626 - DNA, 20 bp, human
gctgcagagccgctgccgga

SEQ ID NO: 25627 - DNA, 20 bp, human
ggacgtgtcaaactagaggt

SEQ ID NO: 25628 - DNA, 20 bp, human
ggcagcatggcgggccgagg

SEQ ID NO: 25629 - DNA, 20 bp, human
gcggcagcggctctgcagta

SEQ ID NO: 25630 - DNA, 20 bp, human
ggtgagagcctcgagatgat

SEQ ID NO: 25631 - DNA, 20 bp, human
gacccgacgtgtcaaactag

SEQ ID NO: 25632 - DNA, 20 bp, human
ggccctttaaaacgaccctc

SEQ ID NO: 25633 - DNA, 20 bp, human
gttagcccgaggatctctga

SEQ ID NO: 25634 - DNA, 20 bp, human
gtaaaacgaccctccggcag

SEQ ID NO: 25635 - DNA, 20 bp, human
gagcggctctgcagtacgga

SEQ ID NO: 25636 - DNA, 20 bp, human
gtatgacctgagggtcccat

SEQ ID NO: 25637 - DNA, 20 bp, human
gggggaaggggaaataacac

SEQ ID NO: 25638 - DNA, 20 bp, human
gtgcccaaatcgggagtcat

SEQ ID NO: 25639 - DNA, 20 bp, human
gagcgaccaatgggaccctc

SEQ ID NO: 25640 - DNA, 20 bp, human
gcccgcgccgcagcgaccaa

SEQ ID NO: 25641 - DNA, 20 bp, human
gagagcattggagaaaccga

SEQ ID NO: 25642 - DNA, 20 bp, human
ggccatatgcatgctgcgag

SEQ ID NO: 25643 - DNA, 20 bp, human
gattggtggactgcaaccat

SEQ ID NO: 25644 - DNA, 20 bp, human
gcaccggttagaggtgataa

SEQ ID NO: 25645 - DNA, 20 bp, human
ggtgccacaactacctagag

SEQ ID NO: 25646 - DNA, 20 bp, human
ggtggccgccgctcacccac

SEQ ID NO: 25647 - DNA, 20 bp, human
gctacgaggaaaggtaagta

SEQ ID NO: 25648 - DNA, 20 bp, human
gctgtgggggctacgaggaa

SEQ ID NO: 25649 - DNA, 20 bp, human
gctcgtagcccccacagcac

SEQ ID NO: 25650 - DNA, 20 bp, human
ggagcgcgcggtaagacggg

SEQ ID NO: 25651 - DNA, 20 bp, human
gatgccctccgaccttccgg

SEQ ID NO: 25652 - DNA, 20 bp, human
ggccacggcatcctgtgctg

SEQ ID NO: 25653 - DNA, 20 bp, human
gttgcctccggaaggtcgga

SEQ ID NO: 25654 - DNA, 20 bp, human
ggagacagcggcaccgagtg

SEQ ID NO: 25655 - DNA, 20 bp, human
gatacaagcaggatggtgag

SEQ ID NO: 25656 - DNA, 20 bp, human
gagctcacaggcggctccac

SEQ ID NO: 25657 - DNA, 20 bp, human
gtaagggtgtctccgaggtg

SEQ ID NO: 25658 - DNA, 20 bp, human
gtgtggaaatagctcacagg

SEQ ID NO: 25659 - DNA, 20 bp, human
ggatcgcagcctggagttaa

SEQ ID NO: 25660 - DNA, 20 bp, human
gctgctgcaggacgcggtcg

SEQ ID NO: 25661 - DNA, 20 bp, human
gaaatgtggaaatagctcac

SEQ ID NO: 25662 - DNA, 20 bp, human
ggcctccggcggacagagct

SEQ ID NO: 25663 - DNA, 20 bp, human
ggtggggagggcgacagaag

SEQ ID NO: 25664 - DNA, 20 bp, human
gtggtaccccctccccacct

SEQ ID NO: 25665 - DNA, 20 bp, human
ggcagccagaggaggcccga

SEQ ID NO: 25666 - DNA, 20 bp, human
gagaactcagggccctggag

SEQ ID NO: 25667 - DNA, 20 bp, human
gcgcggcgcgcacctacccc

SEQ ID NO: 25668 - DNA, 20 bp, human
gagggccctgagttctgaac

SEQ ID NO: 25669 - DNA, 20 bp, human
gcactgcggacagtttgtaa

SEQ ID NO: 25670 - DNA, 20 bp, human
gaccctggagatgtactaca

SEQ ID NO: 25671 - DNA, 20 bp, human
gacagtttgtaatggagcca

SEQ ID NO: 25672 - DNA, 20 bp, human
gggccgggtcagggtcggtg

SEQ ID NO: 25673 - DNA, 20 bp, human
gagtacatctccagggtcag

SEQ ID NO: 25674 - DNA, 20 bp, human
gggcggccaccgaacccccc

SEQ ID NO: 25675 - DNA, 20 bp, human
ggtgtccccaaccgcagaag

SEQ ID NO: 25676 - DNA, 20 bp, human
gcagctgggcctgactggaa

SEQ ID NO: 25677 - DNA, 20 bp, human
gcgcccgggagagtgcccag

SEQ ID NO: 25678 - DNA, 20 bp, human
gcttgggaaaggatacccag

SEQ ID NO: 25679 - DNA, 20 bp, human
gcacgcagcggtgaggaccg

SEQ ID NO: 25680 - DNA, 20 bp, human
gcaggcgtgtgggtcagaca

SEQ ID NO: 25681 - DNA, 20 bp, human
ggcccaggcacgcagcggtg

SEQ ID NO: 25682 - DNA, 20 bp, human
gccagctccagcaagagcgc

SEQ ID NO: 25683 - DNA, 20 bp, human
ggctccagcaagagcgcggg

SEQ ID NO: 25684 - DNA, 20 bp, human
gggcatttggaggtatccat

SEQ ID NO: 25685 - DNA, 20 bp, human
gaaacacgtggacacccctc

SEQ ID NO: 25686 - DNA, 20 bp, human
gcaggcggcggcaaaggagc

SEQ ID NO: 25687 - DNA, 20 bp, human
gcggcggtggcaggagaagt

SEQ ID NO: 25688 - DNA, 20 bp, human
gcgccgagaacgggacaatg

SEQ ID NO: 25689 - DNA, 20 bp, human
gcaaaggagccggcgcgcgg

SEQ ID NO: 25690 - DNA, 20 bp, human
ggtttctgccgcggtagtgg

SEQ ID NO: 25691 - DNA, 20 bp, human
ggaggacgcggtgacaggct

SEQ ID NO: 25692 - DNA, 20 bp, human
ggaccctcggaacgtaagtg

SEQ ID NO: 25693 - DNA, 20 bp, human
gggaagtcgcgcgcccgcgt

SEQ ID NO: 25694 - DNA, 20 bp, human
gggctccgcagcgccgagaa

SEQ ID NO: 25695 - DNA, 20 bp, human
ggggaacggcgcccacccgg

SEQ ID NO: 25696 - DNA, 20 bp, human
gagatggacggggtccctct

SEQ ID NO: 25697 - DNA, 20 bp, human
gggaccccgtccatctgctg

SEQ ID NO: 25698 - DNA, 20 bp, human
gcagctcctacaggtctgtg

SEQ ID NO: 25699 - DNA, 20 bp, human
gctaatcctcacagacctgt

SEQ ID NO: 25700 - DNA, 20 bp, human
gttgtcttacccagggactc

SEQ ID NO: 25701 - DNA, 20 bp, human
ggcgtgcagcacctagtgag

SEQ ID NO: 25702 - DNA, 20 bp, human
gtaacaccccagcagatgga

SEQ ID NO: 25703 - DNA, 20 bp, human
gaagcagggttgtcttaccc

SEQ ID NO: 25704 - DNA, 20 bp, human
gggattcttcccgagtccct

SEQ ID NO: 25705 - DNA, 20 bp, human
gctgcaatgcctgcattcta

SEQ ID NO: 25706 - DNA, 20 bp, human
ggagactgaaaactccctaa

SEQ ID NO: 25707 - DNA, 20 bp, human
gggaagactgtgggatggtg

SEQ ID NO: 25708 - DNA, 20 bp, human
ggacacagcccctaccctta

SEQ ID NO: 25709 - DNA, 20 bp, human
ggaaaactccctaagggtag

SEQ ID NO: 25710 - DNA, 20 bp, human
gtaggggctgtgtctcttct

SEQ ID NO: 25711 - DNA, 20 bp, human
gcaggcttagagaagaggtc

SEQ ID NO: 25712 - DNA, 20 bp, human
ggcgtctactcacaatatgt

SEQ ID NO: 25713 - DNA, 20 bp, human
gtgtgagtagacgctggcct

SEQ ID NO: 25714 - DNA, 20 bp, human
gatgtaggtgatgacgccga

SEQ ID NO: 25715 - DNA, 20 bp, human
ggctctgttttaaaacttgg

SEQ ID NO: 25716 - DNA, 20 bp, human
gccgggctcgtcagtcaaac

SEQ ID NO: 25717 - DNA, 20 bp, human
gtgcactcggcagcacgggc

SEQ ID NO: 25718 - DNA, 20 bp, human
gaagtcctggaaggcatggg

SEQ ID NO: 25719 - DNA, 20 bp, human
ggccaggccagtgtgtatgt

SEQ ID NO: 25720 - DNA, 20 bp, human
ggcaagtggtccctaggttc

SEQ ID NO: 25721 - DNA, 20 bp, human
gtgctctgctcccgaaccta

SEQ ID NO: 25722 - DNA, 20 bp, human
gtgtttgcactcggcagcac

SEQ ID NO: 25723 - DNA, 20 bp, human
gctctggacactctgtacac

SEQ ID NO: 25724 - DNA, 20 bp, human
gggaggtcagggtctctagt

SEQ ID NO: 25725 - DNA, 20 bp, human
gagtgtccagagtcgggcgt

SEQ ID NO: 25726 - DNA, 20 bp, human
ggcgggcgcgggagacacct

SEQ ID NO: 25727 - DNA, 20 bp, human
gtcgtagagctggtactcgt

SEQ ID NO: 25728 - DNA, 20 bp, human
gaagcgggtgcaggtcaccg

SEQ ID NO: 25729 - DNA, 20 bp, human
gaccagctctacgaggatat

SEQ ID NO: 25730 - DNA, 20 bp, human
gtattggcaagtaagagcag

SEQ ID NO: 25731 - DNA, 20 bp, human
ggcgcgccgccggcttctct

SEQ ID NO: 25732 - DNA, 20 bp, human
gcgtcggggacgaccctctg

SEQ ID NO: 25733 - DNA, 20 bp, human
gcgggtgcaggtcaccgtgg

SEQ ID NO: 25734 - DNA, 20 bp, human
gggcgcgctcctggcgagga

SEQ ID NO: 25735 - DNA, 20 bp, human
gctggagcgccgggaggggt

SEQ ID NO: 25736 - DNA, 20 bp, human
gagcccgcgcggcttcaaga

SEQ ID NO: 25737 - DNA, 20 bp, human
gcccgcggcgctgtcaccca

SEQ ID NO: 25738 - DNA, 20 bp, human
ggcgcggcttcaagacggcg

SEQ ID NO: 25739 - DNA, 20 bp, human
gggcctggggacggcagaag

SEQ ID NO: 25740 - DNA, 20 bp, human
ggcgaagcgaggcaccttgg

SEQ ID NO: 25741 - DNA, 20 bp, human
ggaggggagggagtccgagg

SEQ ID NO: 25742 - DNA, 20 bp, human
gtaaagtactcaagaagagg

SEQ ID NO: 25743 - DNA, 20 bp, human
gcggcgagagaaagagcgct

SEQ ID NO: 25744 - DNA, 20 bp, human
gggaggatcggcggactgtg

SEQ ID NO: 25745 - DNA, 20 bp, human
ggcacagcccggaccgagga

SEQ ID NO: 25746 - DNA, 20 bp, human
gggtgactgtgcaccgacgt

SEQ ID NO: 25747 - DNA, 20 bp, human
ggcccggccgagggagcaag

SEQ ID NO: 25748 - DNA, 20 bp, human
ggtgcagcccgcgccgacgt

SEQ ID NO: 25749 - DNA, 20 bp, human
ggctggagggcacccgggag

SEQ ID NO: 25750 - DNA, 20 bp, human
gaagccgcatagctcccggg

SEQ ID NO: 25751 - DNA, 20 bp, human
gccgcggacaccgcagaccc

SEQ ID NO: 25752 - DNA, 20 bp, human
ggttgggaggtggtcgggag

SEQ ID NO: 25753 - DNA, 20 bp, human
gcagaccccggaccgctccc

SEQ ID NO: 25754 - DNA, 20 bp, human
gtgcgaggcgcgtgggacct

SEQ ID NO: 25755 - DNA, 20 bp, human
gagggcacccgggagcggtc

SEQ ID NO: 25756 - DNA, 20 bp, human
gcagggactgaaagacaggg

SEQ ID NO: 25757 - DNA, 20 bp, human
ggcagactgggagctgcgag

SEQ ID NO: 25758 - DNA, 20 bp, human
gcggttcggggaggcagact

SEQ ID NO: 25759 - DNA, 20 bp, human
ggggcaccggggaggaaacc

SEQ ID NO: 25760 - DNA, 20 bp, human
gaccgaggagggcgcacccc

SEQ ID NO: 25761 - DNA, 20 bp, human
gcgaggagaaatgccggccg

SEQ ID NO: 25762 - DNA, 20 bp, human
gacgtccctgcgagcccgga

SEQ ID NO: 25763 - DNA, 20 bp, human
gagaggaagagggtcggaga

SEQ ID NO: 25764 - DNA, 20 bp, human
gaaacagggactgaaagaca

SEQ ID NO: 25765 - DNA, 20 bp, human
gagctagaacggagagacag

SEQ ID NO: 25766 - DNA, 20 bp, human
gcggctcccctgctgaggta

SEQ ID NO: 25767 - DNA, 20 bp, human
gtgctgaggtagggccggtc

SEQ ID NO: 25768 - DNA, 20 bp, human
ggtggcgagcatcgaatccg

SEQ ID NO: 25769 - DNA, 20 bp, human
gttgcccgcgaagaaggagt

SEQ ID NO: 25770 - DNA, 20 bp, human
gtagggcaggatctcggaca

SEQ ID NO: 25771 - DNA, 20 bp, human
gcggggcgggagcgggactg

SEQ ID NO: 25772 - DNA, 20 bp, human
gcaccgtgttcccgggagaa

SEQ ID NO: 25773 - DNA, 20 bp, human
ggcttcggcgcagaccccga

SEQ ID NO: 25774 - DNA, 20 bp, human
gcggctggtgcgctggtctg

SEQ ID NO: 25775 - DNA, 20 bp, human
gcctacagcgaagacaagat

SEQ ID NO: 25776 - DNA, 20 bp, human
gggcggccggcttctcgctc

SEQ ID NO: 25777 - DNA, 20 bp, human
gtaggtagggagaaatcgaa

SEQ ID NO: 25778 - DNA, 20 bp, human
gtggcagcctgcgagaagga

SEQ ID NO: 25779 - DNA, 20 bp, human
gccggcctaggcgctctggt

SEQ ID NO: 25780 - DNA, 20 bp, human
gagtcggagctgggacggta

SEQ ID NO: 25781 - DNA, 20 bp, human
gcctaggccggtgcagctgt

SEQ ID NO: 25782 - DNA, 20 bp, human
ggaagtggcagcctgcgaga

SEQ ID NO: 25783 - DNA, 20 bp, human
gcgctgcccgagcgagaagc

SEQ ID NO: 25784 - DNA, 20 bp, human
gcatcttcgcagcgggactc

SEQ ID NO: 25785 - DNA, 20 bp, human
gggtgggagctgtcacccaa

SEQ ID NO: 25786 - DNA, 20 bp, human
gcggtccgcagacagaagcg

SEQ ID NO: 25787 - DNA, 20 bp, human
gccccgagcctgcaagggag

SEQ ID NO: 25788 - DNA, 20 bp, human
ggcgcgcagcaggagcgagt

SEQ ID NO: 25789 - DNA, 20 bp, human
gccgccccaccgcctcgctg

SEQ ID NO: 25790 - DNA, 20 bp, human
gccggccccgcagacagaag

SEQ ID NO: 25791 - DNA, 20 bp, human
gggcccactccgcacagacg

SEQ ID NO: 25792 - DNA, 20 bp, human
gtgcggaccgcatccatccc

SEQ ID NO: 25793 - DNA, 20 bp, human
ggcgcccaggtagggatcgg

SEQ ID NO: 25794 - DNA, 20 bp, human
gtgggccccagcgaggcggt

SEQ ID NO: 25795 - DNA, 20 bp, human
gagtgcaccggggatggatg

SEQ ID NO: 25796 - DNA, 20 bp, human
gggctaccgccagctcacct

SEQ ID NO: 25797 - DNA, 20 bp, human
gccgggggccgggtccgtca

SEQ ID NO: 25798 - DNA, 20 bp, human
ggcgctctgcgcccccagct

SEQ ID NO: 25799 - DNA, 20 bp, human
gacccggcccccggtgaccc

SEQ ID NO: 25800 - DNA, 20 bp, human
gcatggcacacaaagcccgg

SEQ ID NO: 25801 - DNA, 20 bp, human
gttggaaccggggtcaccgg

SEQ ID NO: 25802 - DNA, 20 bp, human
gcccacctgtcaaacgcgag

SEQ ID NO: 25803 - DNA, 20 bp, human
gccacgaaccctgacggacc

SEQ ID NO: 25804 - DNA, 20 bp, human
gagccgaggaggccatcccg

SEQ ID NO: 25805 - DNA, 20 bp, human
gctggggctcccaacacgga

SEQ ID NO: 25806 - DNA, 20 bp, human
ggtgagagaggagtgaccag

SEQ ID NO: 25807 - DNA, 20 bp, human
gggcgtcacaggtcctgaca

SEQ ID NO: 25808 - DNA, 20 bp, human
gcgcccggtggaagctcctg

SEQ ID NO: 25809 - DNA, 20 bp, human
gtggagccttccacacccgg

SEQ ID NO: 25810 - DNA, 20 bp, human
gccaagaggaggaatcatgt

SEQ ID NO: 25811 - DNA, 20 bp, human
ggtggggagcgggacagcca

SEQ ID NO: 25812 - DNA, 20 bp, human
gaagctcctgcggcaggtaa

SEQ ID NO: 25813 - DNA, 20 bp, human
gcggcgggcgcaccagagac

SEQ ID NO: 25814 - DNA, 20 bp, human
gaagcgtcccatccaagagg

SEQ ID NO: 25815 - DNA, 20 bp, human
ggagactacgggcccccgag

SEQ ID NO: 25816 - DNA, 20 bp, human
gggaggttcgctagccgaag

SEQ ID NO: 25817 - DNA, 20 bp, human
ggcgccagatgcagccgctt

SEQ ID NO: 25818 - DNA, 20 bp, human
gctgccccgcgtgctcggag

SEQ ID NO: 25819 - DNA, 20 bp, human
gtggtcccccgtgaggatag

SEQ ID NO: 25820 - DNA, 20 bp, human
gtcggcccctatcctcacgg

SEQ ID NO: 25821 - DNA, 20 bp, human
gaagcggctggcgatgctgg

SEQ ID NO: 25822 - DNA, 20 bp, human
gggcggctctgggaacgggg

SEQ ID NO: 25823 - DNA, 20 bp, human
gggcaagcggctggcgatgc

SEQ ID NO: 25824 - DNA, 20 bp, human
gacggcttgggggttctggg

SEQ ID NO: 25825 - DNA, 20 bp, human
gaatccgctccgagcacgcg

SEQ ID NO: 25826 - DNA, 20 bp, human
gatgttggccgccgctgcga

SEQ ID NO: 25827 - DNA, 20 bp, human
ggacgggaggatggagtcga

SEQ ID NO: 25828 - DNA, 20 bp, human
ggtccacagtctgggagggg

SEQ ID NO: 25829 - DNA, 20 bp, human
gctgcgagggcgatgactag

SEQ ID NO: 25830 - DNA, 20 bp, human
gaggccccgggaaaattgag

SEQ ID NO: 25831 - DNA, 20 bp, human
ggtggcagtggcggtgatgt

SEQ ID NO: 25832 - DNA, 20 bp, human
gctcccgtccacagtctggg

SEQ ID NO: 25833 - DNA, 20 bp, human
ggagcgactaggaacatcct

SEQ ID NO: 25834 - DNA, 20 bp, human
gggttcagggatgagaactt

SEQ ID NO: 25835 - DNA, 20 bp, human
gatcctcccgtccacagtct

SEQ ID NO: 25836 - DNA, 20 bp, human
ggcataaaggaggctcctgt

SEQ ID NO: 25837 - DNA, 20 bp, human
gccatgaagacccaaaggga

SEQ ID NO: 25838 - DNA, 20 bp, human
ggaggctcctgtgggctaga

SEQ ID NO: 25839 - DNA, 20 bp, human
gaccagtgaccaccgcccca

SEQ ID NO: 25840 - DNA, 20 bp, human
gtgccacagcaggaattata

SEQ ID NO: 25841 - DNA, 20 bp, human
gctcaggctgggcataaagg

SEQ ID NO: 25842 - DNA, 20 bp, human
gggggaccatgaagacccaa

SEQ ID NO: 25843 - DNA, 20 bp, human
gagctccaggcactagaatg

SEQ ID NO: 25844 - DNA, 20 bp, human
gcctgggcaatgatggccag

SEQ ID NO: 25845 - DNA, 20 bp, human
gtccctggggcggtggtcac

SEQ ID NO: 25846 - DNA, 20 bp, human
gagcccgcggcccaaagagg

SEQ ID NO: 25847 - DNA, 20 bp, human
gcaaggcctacggccgaggt

SEQ ID NO: 25848 - DNA, 20 bp, human
gccgagcccgcggcccaaag

SEQ ID NO: 25849 - DNA, 20 bp, human
gctcggcacctcctccgctc

SEQ ID NO: 25850 - DNA, 20 bp, human
gccgcgtcgtagcggtccag

SEQ ID NO: 25851 - DNA, 20 bp, human
gggatctgcgccaaggccta

SEQ ID NO: 25852 - DNA, 20 bp, human
gcaaagaggcggcggcagga

SEQ ID NO: 25853 - DNA, 20 bp, human
gcggtccaggggcacgaggt

SEQ ID NO: 25854 - DNA, 20 bp, human
gctgcagtggatctgcgcca

SEQ ID NO: 25855 - DNA, 20 bp, human
ggcccagccccgaccctgtg

SEQ ID NO: 25856 - DNA, 20 bp, human
gcccgggcataggaatgtgg

SEQ ID NO: 25857 - DNA, 20 bp, human
ggcggacggacggacggaga

SEQ ID NO: 25858 - DNA, 20 bp, human
gcctcgcgcggacggacgga

SEQ ID NO: 25859 - DNA, 20 bp, human
gagatgtggaccacatcagg

SEQ ID NO: 25860 - DNA, 20 bp, human
gggagccgcggtgaaagatg

SEQ ID NO: 25861 - DNA, 20 bp, human
gccgagatgtggaccacatc

SEQ ID NO: 25862 - DNA, 20 bp, human
gagggagggattcgagaatc

SEQ ID NO: 25863 - DNA, 20 bp, human
gcaccactaacctgtcccaa

SEQ ID NO: 25864 - DNA, 20 bp, human
gcgagaagacaggcacgggg

SEQ ID NO: 25865 - DNA, 20 bp, human
gtccctcccgacccccgtgg

SEQ ID NO: 25866 - DNA, 20 bp, human
gaaggtcctccgcagcggcc

SEQ ID NO: 25867 - DNA, 20 bp, human
ggaccagtacgatttctcgc

SEQ ID NO: 25868 - DNA, 20 bp, human
gggtccagcgacttgatctc

SEQ ID NO: 25869 - DNA, 20 bp, human
gaagctcggaggccccggcg

SEQ ID NO: 25870 - DNA, 20 bp, human
gccgggtccgcgctcggact

SEQ ID NO: 25871 - DNA, 20 bp, human
gggccgagcaggaagctcgg

SEQ ID NO: 25872 - DNA, 20 bp, human
gcagcgcaagcggccgcacc

SEQ ID NO: 25873 - DNA, 20 bp, human
gggcccgcgagaaatcgtac

SEQ ID NO: 25874 - DNA, 20 bp, human
ggcttcctgctcggcccggg

SEQ ID NO: 25875 - DNA, 20 bp, human
ggcagcgtcgccagcgcaag

SEQ ID NO: 25876 - DNA, 20 bp, human
gcggggtcccggtcgcgagg

SEQ ID NO: 25877 - DNA, 20 bp, human
gcggccccgccggacatccc

SEQ ID NO: 25878 - DNA, 20 bp, human
gggatgcccggtccgggtgg

SEQ ID NO: 25879 - DNA, 20 bp, human
gcgcctcccccacccggacc

SEQ ID NO: 25880 - DNA, 20 bp, human
gggaggcgccggccctccgc

SEQ ID NO: 25881 - DNA, 20 bp, human
gggagcgcggccgagtcctg

SEQ ID NO: 25882 - DNA, 20 bp, human
gcggacatcccgggcatcgg

SEQ ID NO: 25883 - DNA, 20 bp, human
gcccggcgctgggtccacgg

SEQ ID NO: 25884 - DNA, 20 bp, human
ggcggcggggatgcccggtc

SEQ ID NO: 25885 - DNA, 20 bp, human
gcggccccgcgagtcacctc

SEQ ID NO: 25886 - DNA, 20 bp, human
gccccagcgccggctgacag

SEQ ID NO: 25887 - DNA, 20 bp, human
gggtcccaggagaacctccg

SEQ ID NO: 25888 - DNA, 20 bp, human
gccaggagaacctccgaggt

SEQ ID NO: 25889 - DNA, 20 bp, human
gtcaccgcagggccccacgg

SEQ ID NO: 25890 - DNA, 20 bp, human
gactctgggcggccccccgg

SEQ ID NO: 25891 - DNA, 20 bp, human
gccccgggaggtaagagcca

SEQ ID NO: 25892 - DNA, 20 bp, human
ggagtgccaagcgtccgatc

SEQ ID NO: 25893 - DNA, 20 bp, human
gccagagcggtagatggggt

SEQ ID NO: 25894 - DNA, 20 bp, human
gccgtcacccgcgggacccc

SEQ ID NO: 25895 - DNA, 20 bp, human
gtccttgggctgcacttggg

SEQ ID NO: 25896 - DNA, 20 bp, human
ggtgagaacgagctcatggg

SEQ ID NO: 25897 - DNA, 20 bp, human
ggagcgagtgcggagcgagt

SEQ ID NO: 25898 - DNA, 20 bp, human
gggagcgagacggccctgag

SEQ ID NO: 25899 - DNA, 20 bp, human
gcgcggctgcgagaaccccg

SEQ ID NO: 25900 - DNA, 20 bp, human
ggtacagaagggcctctacg

SEQ ID NO: 25901 - DNA, 20 bp, human
ggcgagaggaggagctccag

SEQ ID NO: 25902 - DNA, 20 bp, human
ggctccgcactcgctcccta

SEQ ID NO: 25903 - DNA, 20 bp, human
gggccctgagtggaagtgtc

SEQ ID NO: 25904 - DNA, 20 bp, human
gagaggaggagctccagtgg

SEQ ID NO: 25905 - DNA, 20 bp, human
ggctgcgagaaccccgaggt

SEQ ID NO: 25906 - DNA, 20 bp, human
ggagccggggctctgatcgg

SEQ ID NO: 25907 - DNA, 20 bp, human
gccggcgggagggaatatgg

SEQ ID NO: 25908 - DNA, 20 bp, human
gtgatcgggggtgagaggta

SEQ ID NO: 25909 - DNA, 20 bp, human
gcggccggcgggagggaata

SEQ ID NO: 25910 - DNA, 20 bp, human
gggccggacacacacgaggg

SEQ ID NO: 25911 - DNA, 20 bp, human
gctggagatgtggaaggcgg

SEQ ID NO: 25912 - DNA, 20 bp, human
ggggggccggacacacacga

SEQ ID NO: 25913 - DNA, 20 bp, human
gtggaaggcggcggtgctca

SEQ ID NO: 25914 - DNA, 20 bp, human
gggccgaggcagggtgcaga

SEQ ID NO: 25915 - DNA, 20 bp, human
ggtggagccggggctctgat

SEQ ID NO: 25916 - DNA, 20 bp, human
gggaggagtcacataatcag

SEQ ID NO: 25917 - DNA, 20 bp, human
gaggtgcccacactaatcag

SEQ ID NO: 25918 - DNA, 20 bp, human
ggccaagccccgccgatcgc

SEQ ID NO: 25919 - DNA, 20 bp, human
gcacactaattagagaggag

SEQ ID NO: 25920 - DNA, 20 bp, human
gtggctccggtgcccgcgat

SEQ ID NO: 25921 - DNA, 20 bp, human
ggctgggctaacggccggga

SEQ ID NO: 25922 - DNA, 20 bp, human
ggagtcacataatcagaggg

SEQ ID NO: 25923 - DNA, 20 bp, human
ggcccagtctgcgagtcagg

SEQ ID NO: 25924 - DNA, 20 bp, human
gcggccaccttcctccgtcc

SEQ ID NO: 25925 - DNA, 20 bp, human
ggtccccacactaattagag

SEQ ID NO: 25926 - DNA, 20 bp, human
gcgcgccgcagtaaagagag

SEQ ID NO: 25927 - DNA, 20 bp, human
ggcagtaaagagagaggcgg

SEQ ID NO: 25928 - DNA, 20 bp, human
gcacgtgccgcagaaccaag

SEQ ID NO: 25929 - DNA, 20 bp, human
gtctgcggcacgtgacggtc

SEQ ID NO: 25930 - DNA, 20 bp, human
gcacagggccgggcttcgtg

SEQ ID NO: 25931 - DNA, 20 bp, human
ggcccaggcagccggcaaag

SEQ ID NO: 25932 - DNA, 20 bp, human
ggaggtgggctggagtaact

SEQ ID NO: 25933 - DNA, 20 bp, human
gagcgaggaggcccgaatcc

SEQ ID NO: 25934 - DNA, 20 bp, human
ggggctcgctcgcgcggcag

SEQ ID NO: 25935 - DNA, 20 bp, human
gagcggtggccgaggcctct

SEQ ID NO: 25936 - DNA, 20 bp, human
gttggcctctagcaagacaa

SEQ ID NO: 25937 - DNA, 20 bp, human
gtactcaggaggcctaggac

SEQ ID NO: 25938 - DNA, 20 bp, human
gtgctagaggccaattatat

SEQ ID NO: 25939 - DNA, 20 bp, human
gctattgttgaggctcatga

SEQ ID NO: 25940 - DNA, 20 bp, human
ggaatagattctagataaaa

SEQ ID NO: 25941 - DNA, 20 bp, human
gggactcacactcctgtcct

SEQ ID NO: 25942 - DNA, 20 bp, human
gcttggaactgctattgttg

SEQ ID NO: 25943 - DNA, 20 bp, human
ggcagcctttgtcttgctag

SEQ ID NO: 25944 - DNA, 20 bp, human
gttcaaaccttgggagatga

SEQ ID NO: 25945 - DNA, 20 bp, human
gtatcatctcaagacgtaaa

SEQ ID NO: 25946 - DNA, 20 bp, human
gtgatcgcagtccggaggtg

SEQ ID NO: 25947 - DNA, 20 bp, human
gcagagttccgcctcacctc

SEQ ID NO: 25948 - DNA, 20 bp, human
ggaggcggaactctgaggtg

SEQ ID NO: 25949 - DNA, 20 bp, human
gccagtgagggcccggaagt

SEQ ID NO: 25950 - DNA, 20 bp, human
gggagcatcaacaggagaca

SEQ ID NO: 25951 - DNA, 20 bp, human
gcagactagcctcttctcta

SEQ ID NO: 25952 - DNA, 20 bp, human
gtcgcgcggagattgctggg

SEQ ID NO: 25953 - DNA, 20 bp, human
gaactggggctggttatcta

SEQ ID NO: 25954 - DNA, 20 bp, human
gcgcgcccaagagtccgggt

SEQ ID NO: 25955 - DNA, 20 bp, human
ggaagactctccgatctcgg

SEQ ID NO: 25956 - DNA, 20 bp, human
gcaggcaggctggcgttccc

SEQ ID NO: 25957 - DNA, 20 bp, human
gaaatgggtaatggatcctt

SEQ ID NO: 25958 - DNA, 20 bp, human
gtgccgaggacgggacccca

SEQ ID NO: 25959 - DNA, 20 bp, human
gcctcggcaatgcaaatccg

SEQ ID NO: 25960 - DNA, 20 bp, human
gtgccctggggtcccgtcct

SEQ ID NO: 25961 - DNA, 20 bp, human
gagcagcgcgaggggaataa

SEQ ID NO: 25962 - DNA, 20 bp, human
gggagcagcgtgactgacac

SEQ ID NO: 25963 - DNA, 20 bp, human
gtggaagactcacagcccgg

SEQ ID NO: 25964 - DNA, 20 bp, human
gggctgtgagtcttccaggg

SEQ ID NO: 25965 - DNA, 20 bp, human
gtacctgcttcgctgccctg

SEQ ID NO: 25966 - DNA, 20 bp, human
gagcctaggactctcgggag

SEQ ID NO: 25967 - DNA, 20 bp, human
gctcggagcaaggcgttggc

SEQ ID NO: 25968 - DNA, 20 bp, human
gacctgggctccccatgtag

SEQ ID NO: 25969 - DNA, 20 bp, human
ggcccgttcgacccctacat

SEQ ID NO: 25970 - DNA, 20 bp, human
gcaacaacagcgaaacaaaa

SEQ ID NO: 25971 - DNA, 20 bp, human
gcgcccagggcctcggagca

SEQ ID NO: 25972 - DNA, 20 bp, human
gagaaaaggcgggagagggt

SEQ ID NO: 25973 - DNA, 20 bp, human
ggtccggtcgccggggacct

SEQ ID NO: 25974 - DNA, 20 bp, human
ggacggcgcgcccctaagag

SEQ ID NO: 25975 - DNA, 20 bp, human
ggcggctgagacagcgccca

SEQ ID NO: 25976 - DNA, 20 bp, human
gtgtccccaagacaggactg

SEQ ID NO: 25977 - DNA, 20 bp, human
ggggaagtgagaagccgggt

SEQ ID NO: 25978 - DNA, 20 bp, human
ggtgccagacctcctgacgg

SEQ ID NO: 25979 - DNA, 20 bp, human
gtaggagtgttgaaaggtga

SEQ ID NO: 25980 - DNA, 20 bp, human
ggagtgttgaaaggtgaagg

SEQ ID NO: 25981 - DNA, 20 bp, human
gtggcctccgtcaggaggtc

SEQ ID NO: 25982 - DNA, 20 bp, human
gtgcacatggaggaactctt

SEQ ID NO: 25983 - DNA, 20 bp, human
gactccaccctggcacaatg

SEQ ID NO: 25984 - DNA, 20 bp, human
gggtgtgatgctatttgggt

SEQ ID NO: 25985 - DNA, 20 bp, human
gcagtgtggtggcctccgtc

SEQ ID NO: 25986 - DNA, 20 bp, human
gcaccgggaagccagcctca

SEQ ID NO: 25987 - DNA, 20 bp, human
gtacccagcttcttacctgg

SEQ ID NO: 25988 - DNA, 20 bp, human
ggcttcccggtggcagctca

SEQ ID NO: 25989 - DNA, 20 bp, human
gggggtcgctgcagtccctg

SEQ ID NO: 25990 - DNA, 20 bp, human
gggagcctccagacagcaca

SEQ ID NO: 25991 - DNA, 20 bp, human
ggcggggccgagattacctc

SEQ ID NO: 25992 - DNA, 20 bp, human
gcctgccctgagctgccacc

SEQ ID NO: 25993 - DNA, 20 bp, human
gggccagggtcaaggaatcc

SEQ ID NO: 25994 - DNA, 20 bp, human
gggcaccgcggggaacggag

SEQ ID NO: 25995 - DNA, 20 bp, human
gctgccggacactcagcaaa

SEQ ID NO: 25996 - DNA, 20 bp, human
gcccagccctccaagcccga

SEQ ID NO: 25997 - DNA, 20 bp, human
gccaagcccgagggccccgc

SEQ ID NO: 25998 - DNA, 20 bp, human
gcttctgaggagaacaacgg

SEQ ID NO: 25999 - DNA, 20 bp, human
gctgggcgggggtatgaagg

SEQ ID NO: 26000 - DNA, 20 bp, human
gcagaagagcgaggagtccg

SEQ ID NO: 26001 - DNA, 20 bp, human
gggccgggcgcccacttctg

SEQ ID NO: 26002 - DNA, 20 bp, human
gcggcccgctagtctcccat

SEQ ID NO: 26003 - DNA, 20 bp, human
gaaggaggtacgaaaagagg

SEQ ID NO: 26004 - DNA, 20 bp, human
ggactagcgggccggcgtac

SEQ ID NO: 26005 - DNA, 20 bp, human
gccgcgaggacatcacgtgg

SEQ ID NO: 26006 - DNA, 20 bp, human
gtccccaggtaggcactcat

SEQ ID NO: 26007 - DNA, 20 bp, human
ggccccatgagtgcctacct

SEQ ID NO: 26008 - DNA, 20 bp, human
gggctagagcctccccccag

SEQ ID NO: 26009 - DNA, 20 bp, human
gcctggggagtacagcatgc

SEQ ID NO: 26010 - DNA, 20 bp, human
gtgacagttgaaggttctgg

SEQ ID NO: 26011 - DNA, 20 bp, human
gggggagtacagcatgctgg

SEQ ID NO: 26012 - DNA, 20 bp, human
gctgaggatctcatcttcct

SEQ ID NO: 26013 - DNA, 20 bp, human
gagcatgctggtggctagct

SEQ ID NO: 26014 - DNA, 20 bp, human
ggccggccatcccactgtca

SEQ ID NO: 26015 - DNA, 20 bp, human
gcactggtggtcagactggg

SEQ ID NO: 26016 - DNA, 20 bp, human
gcagctgctgcacaagacgg

SEQ ID NO: 26017 - DNA, 20 bp, human
gctgcacaagacggaggacg

SEQ ID NO: 26018 - DNA, 20 bp, human
gcaccacgaaaccagacctg

SEQ ID NO: 26019 - DNA, 20 bp, human
gacctcatggaccctgactc

SEQ ID NO: 26020 - DNA, 20 bp, human
gtcagggtccatgaggtcaa

SEQ ID NO: 26021 - DNA, 20 bp, human
gcggggagttctggtcagtg

SEQ ID NO: 26022 - DNA, 20 bp, human
ggcagggagatgaaggacca

SEQ ID NO: 26023 - DNA, 20 bp, human
gatgcagctgctgcacaaga

SEQ ID NO: 26024 - DNA, 20 bp, human
gtgtgcagggagtgaaggat

SEQ ID NO: 26025 - DNA, 20 bp, human
gcagctgccctcgtagaagg

SEQ ID NO: 26026 - DNA, 20 bp, human
gatcgcgtggggtctaggta

SEQ ID NO: 26027 - DNA, 20 bp, human
gctcaggtgaggaatcgcgt

SEQ ID NO: 26028 - DNA, 20 bp, human
ggccctagctccaggagtgg

SEQ ID NO: 26029 - DNA, 20 bp, human
gccccgcgaggatgagccca

SEQ ID NO: 26030 - DNA, 20 bp, human
gctgtgtgggacggggtctc

SEQ ID NO: 26031 - DNA, 20 bp, human
gtgtgctagggacacggcag

SEQ ID NO: 26032 - DNA, 20 bp, human
gcaggctcaggtctcatcta

SEQ ID NO: 26033 - DNA, 20 bp, human
gcaggagatttaagcccgga

SEQ ID NO: 26034 - DNA, 20 bp, human
gagagccctagctccaggag

SEQ ID NO: 26035 - DNA, 20 bp, human
ggaggaatcgcgtggggtct

SEQ ID NO: 26036 - DNA, 20 bp, human
gctctcaggttagagagtgg

SEQ ID NO: 26037 - DNA, 20 bp, human
gggagacgggcaggttccac

SEQ ID NO: 26038 - DNA, 20 bp, human
gacggtgaacacagccctca

SEQ ID NO: 26039 - DNA, 20 bp, human
gtagaatgatcagaaatcga

SEQ ID NO: 26040 - DNA, 20 bp, human
gaccgtaagggacacattga

SEQ ID NO: 26041 - DNA, 20 bp, human
gagagcatggccggccgtct

SEQ ID NO: 26042 - DNA, 20 bp, human
gagggctgtgttcaccgtaa

SEQ ID NO: 26043 - DNA, 20 bp, human
gcactgctctttctccaaga

SEQ ID NO: 26044 - DNA, 20 bp, human
gagaaaaactagggcaaagt

SEQ ID NO: 26045 - DNA, 20 bp, human
ggctctttctccaagacggc

SEQ ID NO: 26046 - DNA, 20 bp, human
ggcatgaggataaggactgt

SEQ ID NO: 26047 - DNA, 20 bp, human
gcccgtacggagccccaaag

SEQ ID NO: 26048 - DNA, 20 bp, human
gctctgctggctcagaccca

SEQ ID NO: 26049 - DNA, 20 bp, human
gggcagttagcaaccccgta

SEQ ID NO: 26050 - DNA, 20 bp, human
ggacaaaaggaactccaaca

SEQ ID NO: 26051 - DNA, 20 bp, human
gtgggccacgcatgaggata

SEQ ID NO: 26052 - DNA, 20 bp, human
gggggacgatcattagacaa

SEQ ID NO: 26053 - DNA, 20 bp, human
gccccaaaactggctatcaa

SEQ ID NO: 26054 - DNA, 20 bp, human
gcagcagaggaaccactttg

SEQ ID NO: 26055 - DNA, 20 bp, human
gtaagacgatgctactgcag

SEQ ID NO: 26056 - DNA, 20 bp, human
gggaggctcaggagacaact

SEQ ID NO: 26057 - DNA, 20 bp, human
gcctgggcaagctctaatcc

SEQ ID NO: 26058 - DNA, 20 bp, human
ggctaacttggacccaccct

SEQ ID NO: 26059 - DNA, 20 bp, human
ggctcaggagacaactggga

SEQ ID NO: 26060 - DNA, 20 bp, human
gcagattccttctcatcagg

SEQ ID NO: 26061 - DNA, 20 bp, human
gagagtctcatagggcctct

SEQ ID NO: 26062 - DNA, 20 bp, human
gggccctatgagactctaca

SEQ ID NO: 26063 - DNA, 20 bp, human
gggcagccagcttatcactg

SEQ ID NO: 26064 - DNA, 20 bp, human
gtagggcctctgggctaact

SEQ ID NO: 26065 - DNA, 20 bp, human
gggctgaagtctattcctca

SEQ ID NO: 26066 - DNA, 20 bp, human
ggggccccgccgctctccgg

SEQ ID NO: 26067 - DNA, 20 bp, human
ggccgggcgctacgctacga

SEQ ID NO: 26068 - DNA, 20 bp, human
gacgctacgaaggcagcgta

SEQ ID NO: 26069 - DNA, 20 bp, human
gcgcgccgggctccgagcca

SEQ ID NO: 26070 - DNA, 20 bp, human
ggcttcgcagaggaacccag

SEQ ID NO: 26071 - DNA, 20 bp, human
gcgggggccgcgcacaccgg

SEQ ID NO: 26072 - DNA, 20 bp, human
ggctgggcgatgcttcgcag

SEQ ID NO: 26073 - DNA, 20 bp, human
gccagaggaaggcgggaagt

SEQ ID NO: 26074 - DNA, 20 bp, human
gcacttgaggccagccccgg

SEQ ID NO: 26075 - DNA, 20 bp, human
gtacgaaggcagcgtaaggc

SEQ ID NO: 26076 - DNA, 20 bp, human
gactgcgcagagaaaggtcg

SEQ ID NO: 26077 - DNA, 20 bp, human
gggccgtactgcgcagagaa

SEQ ID NO: 26078 - DNA, 20 bp, human
gagtggaagcgccccacggt

SEQ ID NO: 26079 - DNA, 20 bp, human
gccgcccaggaaagcgtggt

SEQ ID NO: 26080 - DNA, 20 bp, human
gggtgaatcatcgctcgcag

SEQ ID NO: 26081 - DNA, 20 bp, human
gatcgagtggaagcgcccca

SEQ ID NO: 26082 - DNA, 20 bp, human
gggaagcgcgcggcaggacg

SEQ ID NO: 26083 - DNA, 20 bp, human
gccgcgcgcttcctaccgtg

SEQ ID NO: 26084 - DNA, 20 bp, human
ggaatcatcgctcgcagcgg

SEQ ID NO: 26085 - DNA, 20 bp, human
ggccaagctggcgaaggacc

SEQ ID NO: 26086 - DNA, 20 bp, human
gctcatccggtgggaactca

SEQ ID NO: 26087 - DNA, 20 bp, human
ggcccatcagaaggtcgtac

SEQ ID NO: 26088 - DNA, 20 bp, human
gagagagaggtctcatccgg

SEQ ID NO: 26089 - DNA, 20 bp, human
gcagatgcgctaatgacggt

SEQ ID NO: 26090 - DNA, 20 bp, human
gaaaagagagaggtctcatc

SEQ ID NO: 26091 - DNA, 20 bp, human
gacctgtacgaccttctgat

SEQ ID NO: 26092 - DNA, 20 bp, human
gcatttctcaggagaactta

SEQ ID NO: 26093 - DNA, 20 bp, human
gttctggctataaaagagag

SEQ ID NO: 26094 - DNA, 20 bp, human
gaagttgaaagcccatcaga

SEQ ID NO: 26095 - DNA, 20 bp, human
ggccacagatgcgctaatga

SEQ ID NO: 26096 - DNA, 20 bp, human
gacgactcggagacacccag

SEQ ID NO: 26097 - DNA, 20 bp, human
gctcggagacacccagaggg

SEQ ID NO: 26098 - DNA, 20 bp, human
gtggaagcgcctaacacccg

SEQ ID NO: 26099 - DNA, 20 bp, human
gccgcactaggaaaacgact

SEQ ID NO: 26100 - DNA, 20 bp, human
ggaagtgacagtctagcccc

SEQ ID NO: 26101 - DNA, 20 bp, human
ggccgggctcccgggatgca

SEQ ID NO: 26102 - DNA, 20 bp, human
gctccgggaccacgaatcag

SEQ ID NO: 26103 - DNA, 20 bp, human
gagagaaggggggaactgta

SEQ ID NO: 26104 - DNA, 20 bp, human
gctctggccggagatccagc

SEQ ID NO: 26105 - DNA, 20 bp, human
ggaccacgaatcagtggagg

SEQ ID NO: 26106 - DNA, 20 bp, human
gctaacagcagcagcggcaa

SEQ ID NO: 26107 - DNA, 20 bp, human
ggctagaaggaggccctgaa

SEQ ID NO: 26108 - DNA, 20 bp, human
ggactgaacagacttttagt

SEQ ID NO: 26109 - DNA, 20 bp, human
gtccaggaaataaaactcca

SEQ ID NO: 26110 - DNA, 20 bp, human
gtgtggctgaacaaagattc

SEQ ID NO: 26111 - DNA, 20 bp, human
gtaactcaggtgagtagaga

SEQ ID NO: 26112 - DNA, 20 bp, human
gacaggggatggtgttgagg

SEQ ID NO: 26113 - DNA, 20 bp, human
ggacttttagtggggttacc

SEQ ID NO: 26114 - DNA, 20 bp, human
ggccgctgctgctgttagcc

SEQ ID NO: 26115 - DNA, 20 bp, human
ggtgttgagggggagaagcg

SEQ ID NO: 26116 - DNA, 20 bp, human
gcacgaaggccgctactccg

SEQ ID NO: 26117 - DNA, 20 bp, human
ggaaggccgctactccgagg

SEQ ID NO: 26118 - DNA, 20 bp, human
gccgctggggccgcgaagtg

SEQ ID NO: 26119 - DNA, 20 bp, human
ggcgcccctcagcccagacc

SEQ ID NO: 26120 - DNA, 20 bp, human
gcctgcgtcgggcggctggt

SEQ ID NO: 26121 - DNA, 20 bp, human
gtcggcggccccagcttcta

SEQ ID NO: 26122 - DNA, 20 bp, human
gcaacaagaggagggccggg

SEQ ID NO: 26123 - DNA, 20 bp, human
ggcttctaaggagctcgtga

SEQ ID NO: 26124 - DNA, 20 bp, human
gcgagggaaaagcaaagccg

SEQ ID NO: 26125 - DNA, 20 bp, human
gacccggcttgtagcccacc

SEQ ID NO: 26126 - DNA, 20 bp, human
gctctgtagggtggacagaa

SEQ ID NO: 26127 - DNA, 20 bp, human
gctggaagcggcccacggta

SEQ ID NO: 26128 - DNA, 20 bp, human
gcttatagctcccctcccag

SEQ ID NO: 26129 - DNA, 20 bp, human
gggcagcgggcagccactca

SEQ ID NO: 26130 - DNA, 20 bp, human
gcctgggctgccatggccgt

SEQ ID NO: 26131 - DNA, 20 bp, human
gtggacatgctgggaactca

SEQ ID NO: 26132 - DNA, 20 bp, human
gcaacagtgcttggactcag

SEQ ID NO: 26133 - DNA, 20 bp, human
ggctgtggaccctaagtgtc

SEQ ID NO: 26134 - DNA, 20 bp, human
gagacacctgctccactggg

SEQ ID NO: 26135 - DNA, 20 bp, human
ggggcagccactcaaggtct

SEQ ID NO: 26136 - DNA, 20 bp, human
gccgcaggaagtggaaacag

SEQ ID NO: 26137 - DNA, 20 bp, human
gctggggcccggtagaggta

SEQ ID NO: 26138 - DNA, 20 bp, human
ggacccaagccagccttcca

SEQ ID NO: 26139 - DNA, 20 bp, human
gctctcactgtagaacaggg

SEQ ID NO: 26140 - DNA, 20 bp, human
gaacagctcagagggccact

SEQ ID NO: 26141 - DNA, 20 bp, human
ggctggcttgggtccggcag

SEQ ID NO: 26142 - DNA, 20 bp, human
gggcaggagtgcctgcagag

SEQ ID NO: 26143 - DNA, 20 bp, human
ggcttgggtccggcagtgga

SEQ ID NO: 26144 - DNA, 20 bp, human
gtcaagaaggaacagctcag

SEQ ID NO: 26145 - DNA, 20 bp, human
gggcctctcactgtagaaca

SEQ ID NO: 26146 - DNA, 20 bp, human
ggaaccgactcccagaactc

SEQ ID NO: 26147 - DNA, 20 bp, human
gccagaactccggacgtgtg

SEQ ID NO: 26148 - DNA, 20 bp, human
gcacggcctaaagggcccca

SEQ ID NO: 26149 - DNA, 20 bp, human
ggggctcgggtctaagatcg

SEQ ID NO: 26150 - DNA, 20 bp, human
ggtgtcacctctggctctgt

SEQ ID NO: 26151 - DNA, 20 bp, human
ggaactccggacgtgtgcgg

SEQ ID NO: 26152 - DNA, 20 bp, human
ggagcccagcctgaatgtag

SEQ ID NO: 26153 - DNA, 20 bp, human
ggcttaccgccgcacacgtc

SEQ ID NO: 26154 - DNA, 20 bp, human
gagaatttaggtattcccag

SEQ ID NO: 26155 - DNA, 20 bp, human
gcgtccggagttctgggagt

SEQ ID NO: 26156 - DNA, 20 bp, human
ggcggcagcaatcttagaga

SEQ ID NO: 26157 - DNA, 20 bp, human
gcatgacagacacaatgctc

SEQ ID NO: 26158 - DNA, 20 bp, human
gctggctggaccagacatgg

SEQ ID NO: 26159 - DNA, 20 bp, human
gtattggaaggagcagatcg

SEQ ID NO: 26160 - DNA, 20 bp, human
gtcagtttaacaagcaaatg

SEQ ID NO: 26161 - DNA, 20 bp, human
gttgcaaaggctctattgga

SEQ ID NO: 26162 - DNA, 20 bp, human
ggtgacacgactggtaagct

SEQ ID NO: 26163 - DNA, 20 bp, human
gagaatattcatcagatcag

SEQ ID NO: 26164 - DNA, 20 bp, human
ggctggaccagacatggagg

SEQ ID NO: 26165 - DNA, 20 bp, human
gtggtgaaatgctgctgagt

SEQ ID NO: 26166 - DNA, 20 bp, human
ggctctcgcctcactaggag

SEQ ID NO: 26167 - DNA, 20 bp, human
gtgaggcgagagccgggagc

SEQ ID NO: 26168 - DNA, 20 bp, human
gccgccaacggccactgcaa

SEQ ID NO: 26169 - DNA, 20 bp, human
gtcccggctctcgcctcact

SEQ ID NO: 26170 - DNA, 20 bp, human
ggccgctggaaatcacgagt

SEQ ID NO: 26171 - DNA, 20 bp, human
gactgcaacggtccctaccg

SEQ ID NO: 26172 - DNA, 20 bp, human
gtcgccgcgccggccgccaa

SEQ ID NO: 26173 - DNA, 20 bp, human
ggccggcttccggagaaggg

SEQ ID NO: 26174 - DNA, 20 bp, human
gcagccctctgggtcgcgag

SEQ ID NO: 26175 - DNA, 20 bp, human
gacccgctggagcttccgag

SEQ ID NO: 26176 - DNA, 20 bp, human
gtcctcgcccgcggcctctg

SEQ ID NO: 26177 - DNA, 20 bp, human
gcgcgggcgaggaccgggag

SEQ ID NO: 26178 - DNA, 20 bp, human
gtgggcgcgagcggctgagt

SEQ ID NO: 26179 - DNA, 20 bp, human
gggcttctgcgtacccgggg

SEQ ID NO: 26180 - DNA, 20 bp, human
gcgcttctgcaaggccccgg

SEQ ID NO: 26181 - DNA, 20 bp, human
gcgcaggtcagcctcccccg

SEQ ID NO: 26182 - DNA, 20 bp, human
gctccgtggccgctcgggag

SEQ ID NO: 26183 - DNA, 20 bp, human
ggcgagcggctgagtcggct

SEQ ID NO: 26184 - DNA, 20 bp, human
ggcgcaagggccactgatta

SEQ ID NO: 26185 - DNA, 20 bp, human
gcggccacggagagccctgc

SEQ ID NO: 26186 - DNA, 20 bp, human
gcactagcaacagtctcccc

SEQ ID NO: 26187 - DNA, 20 bp, human
gagctaacacaaggccccgc

SEQ ID NO: 26188 - DNA, 20 bp, human
ggcaggaagtgggaccgcaa

SEQ ID NO: 26189 - DNA, 20 bp, human
gcgggacgggagcagatccc

SEQ ID NO: 26190 - DNA, 20 bp, human
gcctggacgctgatgagttc

SEQ ID NO: 26191 - DNA, 20 bp, human
ggccaccatggagaaactcc

SEQ ID NO: 26192 - DNA, 20 bp, human
gtccgccaactagaccggga

SEQ ID NO: 26193 - DNA, 20 bp, human
gacgctgatgagttccggca

SEQ ID NO: 26194 - DNA, 20 bp, human
gaggactctgggacagacgc

SEQ ID NO: 26195 - DNA, 20 bp, human
ggatgagttccggcagggtc

SEQ ID NO: 26196 - DNA, 20 bp, human
gatgggagtgaagggagagt

SEQ ID NO: 26197 - DNA, 20 bp, human
gttgctgagtaacaggtctg

SEQ ID NO: 26198 - DNA, 20 bp, human
gttggccttaagaacttctt

SEQ ID NO: 26199 - DNA, 20 bp, human
gtccaactcaacaggtaatg

SEQ ID NO: 26200 - DNA, 20 bp, human
gttcacctggcacaattaga

SEQ ID NO: 26201 - DNA, 20 bp, human
gtacattagtttagtgaaaa

SEQ ID NO: 26202 - DNA, 20 bp, human
gattttgtggtttcccacaa

SEQ ID NO: 26203 - DNA, 20 bp, human
gccagctttcttcactctgc

SEQ ID NO: 26204 - DNA, 20 bp, human
ggcagaaaaatcatttcacc

SEQ ID NO: 26205 - DNA, 20 bp, human
gacctgttgagttggaaatt

SEQ ID NO: 26206 - DNA, 20 bp, human
gttcagttcgaagcaactgg

SEQ ID NO: 26207 - DNA, 20 bp, human
gtgcactgacagcctagtga

SEQ ID NO: 26208 - DNA, 20 bp, human
ggaggctaaggtggcttggg

SEQ ID NO: 26209 - DNA, 20 bp, human
gttgcttcgaactgaaacta

SEQ ID NO: 26210 - DNA, 20 bp, human
ggaggaaagagcttggtact

SEQ ID NO: 26211 - DNA, 20 bp, human
gcgaagcaactggtggcaaa

SEQ ID NO: 26212 - DNA, 20 bp, human
gtgagcagtcattaggtact

SEQ ID NO: 26213 - DNA, 20 bp, human
gtatttgagtgtgaagggtt

SEQ ID NO: 26214 - DNA, 20 bp, human
gctaggtatttgagtgtgaa

SEQ ID NO: 26215 - DNA, 20 bp, human
gatactaagagagtggacca

SEQ ID NO: 26216 - DNA, 20 bp, human
gggtgagccccaactgctaa

SEQ ID NO: 26217 - DNA, 20 bp, human
gaggaactggggccaccgtg

SEQ ID NO: 26218 - DNA, 20 bp, human
ggtcggatgaggagaaggta

SEQ ID NO: 26219 - DNA, 20 bp, human
ggggccagaacagcccaaga

SEQ ID NO: 26220 - DNA, 20 bp, human
ggtcgaggaacgaggaactg

SEQ ID NO: 26221 - DNA, 20 bp, human
ggatgatcgtgtgtcggatg

SEQ ID NO: 26222 - DNA, 20 bp, human
gggccccagttccctgtcgg

SEQ ID NO: 26223 - DNA, 20 bp, human
gtgagagaaaaggagagtcg

SEQ ID NO: 26224 - DNA, 20 bp, human
ggcctcaggcctgagagaaa

SEQ ID NO: 26225 - DNA, 20 bp, human
gtctggcccagcccggctac

SEQ ID NO: 26226 - DNA, 20 bp, human
gttctggcgacaaaccgcgg

SEQ ID NO: 26227 - DNA, 20 bp, human
gtccttctggcgacaaaccg

SEQ ID NO: 26228 - DNA, 20 bp, human
gggcctcgggtgacggacag

SEQ ID NO: 26229 - DNA, 20 bp, human
gctgggcgcagtaaggatgg

SEQ ID NO: 26230 - DNA, 20 bp, human
gcgcggcccgacagcaggag

SEQ ID NO: 26231 - DNA, 20 bp, human
ggcctggcctgtgagtgtag

SEQ ID NO: 26232 - DNA, 20 bp, human
gccggggaccagggacgcaa

SEQ ID NO: 26233 - DNA, 20 bp, human
gtgaggaccgcacggaaacg

SEQ ID NO: 26234 - DNA, 20 bp, human
ggcaggcactgggcgcagta

SEQ ID NO: 26235 - DNA, 20 bp, human
gcgacagcaggagagggtcc

SEQ ID NO: 26236 - DNA, 20 bp, human
gagcagacagagatcatcaa

SEQ ID NO: 26237 - DNA, 20 bp, human
gtccatgaaagcaggcagtc

SEQ ID NO: 26238 - DNA, 20 bp, human
gttattacaggcccctccag

SEQ ID NO: 26239 - DNA, 20 bp, human
gtgtggtgagacaagagtac

SEQ ID NO: 26240 - DNA, 20 bp, human
ggcacagaagaacaactctc

SEQ ID NO: 26241 - DNA, 20 bp, human
ggttaacaccttgatgggaa

SEQ ID NO: 26242 - DNA, 20 bp, human
ggaaagcaggcagtctggca

SEQ ID NO: 26243 - DNA, 20 bp, human
gtgaaatgaggagtgttcaa

SEQ ID NO: 26244 - DNA, 20 bp, human
gttcttatgacctcatcagg

SEQ ID NO: 26245 - DNA, 20 bp, human
gcatggtatcattcagaatg

SEQ ID NO: 26246 - DNA, 20 bp, human
gccggcgcttccacttcccc

SEQ ID NO: 26247 - DNA, 20 bp, human
gagacctagccctagaccgg

SEQ ID NO: 26248 - DNA, 20 bp, human
ggtcccggtcccggcgtcag

SEQ ID NO: 26249 - DNA, 20 bp, human
gccacgccagggtcaccgag

SEQ ID NO: 26250 - DNA, 20 bp, human
gtagcctgggccggagagac

SEQ ID NO: 26251 - DNA, 20 bp, human
ggagccactgacgccgggac

SEQ ID NO: 26252 - DNA, 20 bp, human
gctggggacacggttcggga

SEQ ID NO: 26253 - DNA, 20 bp, human
gggacacggttcgggaggga

SEQ ID NO: 26254 - DNA, 20 bp, human
ggcgccggcggcaccctcct

SEQ ID NO: 26255 - DNA, 20 bp, human
gaggaagggggcccacgcca

SEQ ID NO: 26256 - DNA, 20 bp, human
gtgagccgcgggtcccgagt

SEQ ID NO: 26257 - DNA, 20 bp, human
ggtcatcgacgagcaggacg

SEQ ID NO: 26258 - DNA, 20 bp, human
ggacccgcggctcaccggtg

SEQ ID NO: 26259 - DNA, 20 bp, human
gctcaccggtgcggttgacg

SEQ ID NO: 26260 - DNA, 20 bp, human
gtagcgtgcggggtgagtcg

SEQ ID NO: 26261 - DNA, 20 bp, human
gcgcacgctacagtcgcctc

SEQ ID NO: 26262 - DNA, 20 bp, human
gcccaggtcgtggcccactc

SEQ ID NO: 26263 - DNA, 20 bp, human
gcgctgtgggagcgaatcga

SEQ ID NO: 26264 - DNA, 20 bp, human
gcgtgccgcgtcaaccgcac

SEQ ID NO: 26265 - DNA, 20 bp, human
ggttgacgcggcacgggaag

SEQ ID NO: 26266 - DNA, 20 bp, human
ggtcgcctggaggaagccgg

SEQ ID NO: 26267 - DNA, 20 bp, human
ggacgctcaaagagacacgg

SEQ ID NO: 26268 - DNA, 20 bp, human
ggcaggagtccgaaggccag

SEQ ID NO: 26269 - DNA, 20 bp, human
gcccggagccgtcctccgag

SEQ ID NO: 26270 - DNA, 20 bp, human
gcggccctgcagcccctggg

SEQ ID NO: 26271 - DNA, 20 bp, human
gaggggcgccgcccgcccag

SEQ ID NO: 26272 - DNA, 20 bp, human
ggggagaaaaagggttggaa

SEQ ID NO: 26273 - DNA, 20 bp, human
gcccagcatcgcgggaccag

SEQ ID NO: 26274 - DNA, 20 bp, human
gggcgggcggcgcccctcgg

SEQ ID NO: 26275 - DNA, 20 bp, human
ggcacgaggcggggagttgg

SEQ ID NO: 26276 - DNA, 20 bp, human
ggagcaggtcagcctacgga

SEQ ID NO: 26277 - DNA, 20 bp, human
gtaagtgcgcgcagtccatc

SEQ ID NO: 26278 - DNA, 20 bp, human
gtggctgctgttggtagcag

SEQ ID NO: 26279 - DNA, 20 bp, human
gaggctgacctgctcttcgc

SEQ ID NO: 26280 - DNA, 20 bp, human
gggccccatcagacctgtgt

SEQ ID NO: 26281 - DNA, 20 bp, human
gtgaccctctgccccccatg

SEQ ID NO: 26282 - DNA, 20 bp, human
gctgaatgtggcccaatctc

SEQ ID NO: 26283 - DNA, 20 bp, human
gagtccatccggcgaagagc

SEQ ID NO: 26284 - DNA, 20 bp, human
gattcagtcctcgcttccct

SEQ ID NO: 26285 - DNA, 20 bp, human
ggttcagttcagccagagat

SEQ ID NO: 26286 - DNA, 20 bp, human
gcagcccacacaagaagggt

SEQ ID NO: 26287 - DNA, 20 bp, human
gctctcctacccttcttgtg

SEQ ID NO: 26288 - DNA, 20 bp, human
gcatatatggggactactga

SEQ ID NO: 26289 - DNA, 20 bp, human
gcctgtcgtaagtctgacag

SEQ ID NO: 26290 - DNA, 20 bp, human
ggacttacgacaggtaagca

SEQ ID NO: 26291 - DNA, 20 bp, human
gcactccatgcacatatatg

SEQ ID NO: 26292 - DNA, 20 bp, human
ggaaaggaacagagacttta

SEQ ID NO: 26293 - DNA, 20 bp, human
gggaactagaagatttttgc

SEQ ID NO: 26294 - DNA, 20 bp, human
gaaagagttgtggaaagggc

SEQ ID NO: 26295 - DNA, 20 bp, human
gttagtatctgtggaagttt

SEQ ID NO: 26296 - DNA, 20 bp, human
ggcaaaagtgagggacaggg

SEQ ID NO: 26297 - DNA, 20 bp, human
gaagctatcatcagtatctg

SEQ ID NO: 26298 - DNA, 20 bp, human
ggtttatgtgagcaaaagtg

SEQ ID NO: 26299 - DNA, 20 bp, human
gtggaaggcgcttgctcttc

SEQ ID NO: 26300 - DNA, 20 bp, human
gcacaactttttcctcccag

SEQ ID NO: 26301 - DNA, 20 bp, human
gtgagcaaaagtgagggaca

SEQ ID NO: 26302 - DNA, 20 bp, human
gaggaaggtaaaaagaaagg

SEQ ID NO: 26303 - DNA, 20 bp, human
ggctttcctttcctttctaa

SEQ ID NO: 26304 - DNA, 20 bp, human
ggtcccaaaaacaggcccct

SEQ ID NO: 26305 - DNA, 20 bp, human
gtgctttccagggactaatg

SEQ ID NO: 26306 - DNA, 20 bp, human
gcagccatggctcctcacgt

SEQ ID NO: 26307 - DNA, 20 bp, human
ggtgccaacgtgaggagcca

SEQ ID NO: 26308 - DNA, 20 bp, human
ggtgagtcttccccagtaag

SEQ ID NO: 26309 - DNA, 20 bp, human
gtcttccccagtaagaggat

SEQ ID NO: 26310 - DNA, 20 bp, human
gaagaggataggtcttaggg

SEQ ID NO: 26311 - DNA, 20 bp, human
gggggaagactcaccagcca

SEQ ID NO: 26312 - DNA, 20 bp, human
gtcacaaagcctaatgagaa

SEQ ID NO: 26313 - DNA, 20 bp, human
gcattgcaagtgccaacgtg

SEQ ID NO: 26314 - DNA, 20 bp, human
gtaagacctatcctcttact

SEQ ID NO: 26315 - DNA, 20 bp, human
gacacttgcaatgacaggca

SEQ ID NO: 26316 - DNA, 20 bp, human
gatctctgagggagtactct

SEQ ID NO: 26317 - DNA, 20 bp, human
gcgcaaatggcagctgactg

SEQ ID NO: 26318 - DNA, 20 bp, human
gtgcagatacaagcacagtg

SEQ ID NO: 26319 - DNA, 20 bp, human
gagacacgttaacttctcgg

SEQ ID NO: 26320 - DNA, 20 bp, human
gtctctttctatgatctctg

SEQ ID NO: 26321 - DNA, 20 bp, human
gcggagcactctctgatccg

SEQ ID NO: 26322 - DNA, 20 bp, human
gacgtgtctaagatagaatc

SEQ ID NO: 26323 - DNA, 20 bp, human
gccatgccttaagccgcaaa

SEQ ID NO: 26324 - DNA, 20 bp, human
gagatctcctgaagaaaagt

SEQ ID NO: 26325 - DNA, 20 bp, human
gtgtcaatgatgcctagtgt

SEQ ID NO: 26326 - DNA, 20 bp, human
gtgtgagtttcaggagcccc

SEQ ID NO: 26327 - DNA, 20 bp, human
gtggctgtgggcggtaaacg

SEQ ID NO: 26328 - DNA, 20 bp, human
gtcgagggaaacaagctctc

SEQ ID NO: 26329 - DNA, 20 bp, human
gagggctgtctgagattcga

SEQ ID NO: 26330 - DNA, 20 bp, human
gtaatgttcatagagaagga

SEQ ID NO: 26331 - DNA, 20 bp, human
gttgttgcttggacactgcc

SEQ ID NO: 26332 - DNA, 20 bp, human
gggagcggaggcttgttgct

SEQ ID NO: 26333 - DNA, 20 bp, human
gttcttctcaagtgaccaag

SEQ ID NO: 26334 - DNA, 20 bp, human
gggagaatccccttaagctt

SEQ ID NO: 26335 - DNA, 20 bp, human
gggccatcttcaatgtgagt

SEQ ID NO: 26336 - DNA, 20 bp, human
gtaacgctcgcagaggaggt

SEQ ID NO: 26337 - DNA, 20 bp, human
gtgggagaatccccttaggt

SEQ ID NO: 26338 - DNA, 20 bp, human
gaccagagaaaccgacctaa

SEQ ID NO: 26339 - DNA, 20 bp, human
gcaggatgccgagcttccag

SEQ ID NO: 26340 - DNA, 20 bp, human
gccccttaggtcggtttctc

SEQ ID NO: 26341 - DNA, 20 bp, human
ggtacaggaaggagaaacgg

SEQ ID NO: 26342 - DNA, 20 bp, human
ggaaataacgctcgcagagg

SEQ ID NO: 26343 - DNA, 20 bp, human
gcgtgtcagaaggggaaata

SEQ ID NO: 26344 - DNA, 20 bp, human
gtggtgactttagggtagga

SEQ ID NO: 26345 - DNA, 20 bp, human
gggagccctagtgtacagga

SEQ ID NO: 26346 - DNA, 20 bp, human
gcccaggactgtctaccgtg

SEQ ID NO: 26347 - DNA, 20 bp, human
gcaggaagtgcacaggcgtc

SEQ ID NO: 26348 - DNA, 20 bp, human
gaacccatcaggaagtgcac

SEQ ID NO: 26349 - DNA, 20 bp, human
gggacagttttgacagacaa

SEQ ID NO: 26350 - DNA, 20 bp, human
gcgcctgtgcacttcctgat

SEQ ID NO: 26351 - DNA, 20 bp, human
ggccacacggtagacagtcc

SEQ ID NO: 26352 - DNA, 20 bp, human
ggtcaaaactgtcctgaatg

SEQ ID NO: 26353 - DNA, 20 bp, human
gggaagaccctcaggtgggt

SEQ ID NO: 26354 - DNA, 20 bp, human
gctggagacatagttgcccc

SEQ ID NO: 26355 - DNA, 20 bp, human
ggagttaagcagaacccatc

SEQ ID NO: 26356 - DNA, 20 bp, human
gagagcagtcccacgacagt

SEQ ID NO: 26357 - DNA, 20 bp, human
gtgctctgcgcgctcccggt

SEQ ID NO: 26358 - DNA, 20 bp, human
gcgcattatgctggtctcca

SEQ ID NO: 26359 - DNA, 20 bp, human
gtcccaaccagaggctcact

SEQ ID NO: 26360 - DNA, 20 bp, human
gatgcgcaggcgcgccccac

SEQ ID NO: 26361 - DNA, 20 bp, human
gtatgctggtctccatggcg

SEQ ID NO: 26362 - DNA, 20 bp, human
ggttagtcaagcaaagctga

SEQ ID NO: 26363 - DNA, 20 bp, human
gggtcgacggtggccgatag

SEQ ID NO: 26364 - DNA, 20 bp, human
gatatctggctggagtctag

SEQ ID NO: 26365 - DNA, 20 bp, human
ggccgagtgagcctctggtt

SEQ ID NO: 26366 - DNA, 20 bp, human
ggctctcagtcggagcgaag

SEQ ID NO: 26367 - DNA, 20 bp, human
gcagaacggattgcagggta

SEQ ID NO: 26368 - DNA, 20 bp, human
gagcggctggcggagcagaa

SEQ ID NO: 26369 - DNA, 20 bp, human
gggccaggggcgcctatcct

SEQ ID NO: 26370 - DNA, 20 bp, human
ggtcggagcgaagcggctgg

SEQ ID NO: 26371 - DNA, 20 bp, human
gcggagcagaacggattgca

SEQ ID NO: 26372 - DNA, 20 bp, human
gccggcgagtcccccgtcca

SEQ ID NO: 26373 - DNA, 20 bp, human
gggggtgggtgtggcaacag

SEQ ID NO: 26374 - DNA, 20 bp, human
gtcagtcggagcgaagcggc

SEQ ID NO: 26375 - DNA, 20 bp, human
ggggtagggagctcttctcg

SEQ ID NO: 26376 - DNA, 20 bp, human
ggcgaggacccagggccatc

SEQ ID NO: 26377 - DNA, 20 bp, human
ggccccacagcgaggaccca

SEQ ID NO: 26378 - DNA, 20 bp, human
ggccctgggtcctcgctgtg

SEQ ID NO: 26379 - DNA, 20 bp, human
ggcgggggcagctgggaatc

SEQ ID NO: 26380 - DNA, 20 bp, human
gctccgtgcggggtgacaga

SEQ ID NO: 26381 - DNA, 20 bp, human
gaatccggaatgctgcccga

SEQ ID NO: 26382 - DNA, 20 bp, human
gcctcgctgtggggcaatcc

SEQ ID NO: 26383 - DNA, 20 bp, human
gcgggcttgcagacgaggta

SEQ ID NO: 26384 - DNA, 20 bp, human
ggcagaggcggtcagcggtc

SEQ ID NO: 26385 - DNA, 20 bp, human
gccccgcgagccagcagagg

SEQ ID NO: 26386 - DNA, 20 bp, human
gtcggcctcggcctgcacgg

SEQ ID NO: 26387 - DNA, 20 bp, human
ggcgccggggaacaccgaca

SEQ ID NO: 26388 - DNA, 20 bp, human
gcgcgaacggcgagatccag

SEQ ID NO: 26389 - DNA, 20 bp, human
ggggccctgcgctaccgtgt

SEQ ID NO: 26390 - DNA, 20 bp, human
ggcgcccgcctcctcaccat

SEQ ID NO: 26391 - DNA, 20 bp, human
gccccggggccccgtactca

SEQ ID NO: 26392 - DNA, 20 bp, human
gccctggcaccggccctcca

SEQ ID NO: 26393 - DNA, 20 bp, human
gccgtactcacggctgtaga

SEQ ID NO: 26394 - DNA, 20 bp, human
ggccggatctaagatggcag

SEQ ID NO: 26395 - DNA, 20 bp, human
gcctggagccggatctaaga

SEQ ID NO: 26396 - DNA, 20 bp, human
gcagagagacgaaggagtca

SEQ ID NO: 26397 - DNA, 20 bp, human
gtggcgggcggactcggacc

SEQ ID NO: 26398 - DNA, 20 bp, human
gccggagctggggtacctgg

SEQ ID NO: 26399 - DNA, 20 bp, human
gggcaggagccactcggtct

SEQ ID NO: 26400 - DNA, 20 bp, human
ggtcgagggtcacagacgta

SEQ ID NO: 26401 - DNA, 20 bp, human
ggagctggggtacctggcgg

SEQ ID NO: 26402 - DNA, 20 bp, human
gtccctgcagagagaggcca

SEQ ID NO: 26403 - DNA, 20 bp, human
gcggaccgggcgggatgcag

SEQ ID NO: 26404 - DNA, 20 bp, human
gggacctgtgagccgcactg

SEQ ID NO: 26405 - DNA, 20 bp, human
gctccactcccaaagtctag

SEQ ID NO: 26406 - DNA, 20 bp, human
gaatcccggacccgcagctg

SEQ ID NO: 26407 - DNA, 20 bp, human
gtgcccggaggaatctgcca

SEQ ID NO: 26408 - DNA, 20 bp, human
gagccatggcagattcctcc

SEQ ID NO: 26409 - DNA, 20 bp, human
gccctcacgcaggagtccca

SEQ ID NO: 26410 - DNA, 20 bp, human
ggtgtctgtagccgcagctg

SEQ ID NO: 26411 - DNA, 20 bp, human
ggcagtgcccgaggtctgag

SEQ ID NO: 26412 - DNA, 20 bp, human
gcgggtgcatgggttctgag

SEQ ID NO: 26413 - DNA, 20 bp, human
gggtgcccggctccgaggga

SEQ ID NO: 26414 - DNA, 20 bp, human
gggtcccagtggccgtccct

SEQ ID NO: 26415 - DNA, 20 bp, human
gcagattcctccgggcagca

SEQ ID NO: 26416 - DNA, 20 bp, human
ggcggccagcgcctacgact

SEQ ID NO: 26417 - DNA, 20 bp, human
ggcggagacgggagccacgc

SEQ ID NO: 26418 - DNA, 20 bp, human
ggtagtcctcaacatgtcag

SEQ ID NO: 26419 - DNA, 20 bp, human
gcggcgtgcgccacgattag

SEQ ID NO: 26420 - DNA, 20 bp, human
gcccgtctccgcccagtcgt

SEQ ID NO: 26421 - DNA, 20 bp, human
ggccagcgcctacgactggg

SEQ ID NO: 26422 - DNA, 20 bp, human
gcgcgcggcccaccaggagg

SEQ ID NO: 26423 - DNA, 20 bp, human
gctacgcgcggcccaggcct

SEQ ID NO: 26424 - DNA, 20 bp, human
ggcctacgactgggcggaga

SEQ ID NO: 26425 - DNA, 20 bp, human
gacatgttgaggactacgcg

SEQ ID NO: 26426 - DNA, 20 bp, human
gtgagcaacagggaccccag

SEQ ID NO: 26427 - DNA, 20 bp, human
gccagcggctcagagacccg

SEQ ID NO: 26428 - DNA, 20 bp, human
ggggcacgggtacccaacag

SEQ ID NO: 26429 - DNA, 20 bp, human
gagacccgcggtcagtacct

SEQ ID NO: 26430 - DNA, 20 bp, human
ggacacagggaatggtcgag

SEQ ID NO: 26431 - DNA, 20 bp, human
gggtagcatcagcagcaggg

SEQ ID NO: 26432 - DNA, 20 bp, human
gagcagggcggcgcccagga

SEQ ID NO: 26433 - DNA, 20 bp, human
gccggcccctctgagcaaca

SEQ ID NO: 26434 - DNA, 20 bp, human
gtgtcccaggtactgaccgc

SEQ ID NO: 26435 - DNA, 20 bp, human
ggatggagagctcccgcgtg

SEQ ID NO: 26436 - DNA, 20 bp, human
gagagggccgacccacccca

SEQ ID NO: 26437 - DNA, 20 bp, human
gctggaccaggcggacaggt

SEQ ID NO: 26438 - DNA, 20 bp, human
gctgcagtagtccgcagagt

SEQ ID NO: 26439 - DNA, 20 bp, human
gagtcggagcagaaattgtg

SEQ ID NO: 26440 - DNA, 20 bp, human
gttacctggaccaggcggac

SEQ ID NO: 26441 - DNA, 20 bp, human
gcctgtcgtccgggcaaccc

SEQ ID NO: 26442 - DNA, 20 bp, human
gctcataccttggggtgggt

SEQ ID NO: 26443 - DNA, 20 bp, human
gtgtgtggacaaacgctccc

SEQ ID NO: 26444 - DNA, 20 bp, human
gacagcgaagcgggtcggtt

SEQ ID NO: 26445 - DNA, 20 bp, human
gattttacagcgaagcgggt

SEQ ID NO: 26446 - DNA, 20 bp, human
ggcgcgaccctggtcctcaa

SEQ ID NO: 26447 - DNA, 20 bp, human
gggaccagggtcgcgccgag

SEQ ID NO: 26448 - DNA, 20 bp, human
gacagtacagaggacatgta

SEQ ID NO: 26449 - DNA, 20 bp, human
gcatcgcggagggaagcgag

SEQ ID NO: 26450 - DNA, 20 bp, human
gtggtgccgagccccctcta

SEQ ID NO: 26451 - DNA, 20 bp, human
gggtcgcgccgagaggccgg

SEQ ID NO: 26452 - DNA, 20 bp, human
gcgacgagccattgaggacc

SEQ ID NO: 26453 - DNA, 20 bp, human
gctacggcgggagcttgcag

SEQ ID NO: 26454 - DNA, 20 bp, human
ggacagggatgcggtagtag

SEQ ID NO: 26455 - DNA, 20 bp, human
gccgccgtgcgccaccctga

SEQ ID NO: 26456 - DNA, 20 bp, human
gcgcgcttcgcaagacaccg

SEQ ID NO: 26457 - DNA, 20 bp, human
gtgcgtaagtacctcgccgg

SEQ ID NO: 26458 - DNA, 20 bp, human
ggtaagtacctcgccggtgg

SEQ ID NO: 26459 - DNA, 20 bp, human
gtaagatggcggaccggcgg

SEQ ID NO: 26460 - DNA, 20 bp, human
gccgtaagatggcggaccgg

SEQ ID NO: 26461 - DNA, 20 bp, human
gtctccgtaagatggcggac

SEQ ID NO: 26462 - DNA, 20 bp, human
ggccgttctccgtaagatgg

SEQ ID NO: 26463 - DNA, 20 bp, human
gtcgcaagacaccgaggacg

SEQ ID NO: 26464 - DNA, 20 bp, human
ggtgcttcgggctccgacag

SEQ ID NO: 26465 - DNA, 20 bp, human
ggtggccgttctccgtaaga

SEQ ID NO: 26466 - DNA, 20 bp, human
gctcccaaccgtgaggtgtt

SEQ ID NO: 26467 - DNA, 20 bp, human
gtccccgcctcccaaccgtg

SEQ ID NO: 26468 - DNA, 20 bp, human
gatgcgaggatgacaaggta

SEQ ID NO: 26469 - DNA, 20 bp, human
gaggaggcgggcttaccggt

SEQ ID NO: 26470 - DNA, 20 bp, human
gaacccaacacctcacggtt

SEQ ID NO: 26471 - DNA, 20 bp, human
gcgtcctcgccttcaactac

SEQ ID NO: 26472 - DNA, 20 bp, human
gtggagttgcccggcggaca

SEQ ID NO: 26473 - DNA, 20 bp, human
gcaccagcacgagagagggc

SEQ ID NO: 26474 - DNA, 20 bp, human
ggaaaaaaaccggaaagggg

SEQ ID NO: 26475 - DNA, 20 bp, human
ggggtcgggttcaaagcctc

SEQ ID NO: 26476 - DNA, 20 bp, human
ggcgagccgggcgttgtgag

SEQ ID NO: 26477 - DNA, 20 bp, human
ggttgtgagcggactgctag

SEQ ID NO: 26478 - DNA, 20 bp, human
ggccctgccgtcctctgtca

SEQ ID NO: 26479 - DNA, 20 bp, human
gaacagccgagaggtcccta

SEQ ID NO: 26480 - DNA, 20 bp, human
gccctagggaagagcggcag

SEQ ID NO: 26481 - DNA, 20 bp, human
gagtccgcgagccctgacag

SEQ ID NO: 26482 - DNA, 20 bp, human
ggttcctgcggtgggaggta

SEQ ID NO: 26483 - DNA, 20 bp, human
ggccctgacagaggacggca

SEQ ID NO: 26484 - DNA, 20 bp, human
gcgcgtgcgcatcacctagg

SEQ ID NO: 26485 - DNA, 20 bp, human
gtacttcactgaggcgagcc

SEQ ID NO: 26486 - DNA, 20 bp, human
gggcccgctcacctcggtag

SEQ ID NO: 26487 - DNA, 20 bp, human
gaaccggcacggcggagcag

SEQ ID NO: 26488 - DNA, 20 bp, human
ggtcggccgcggccgaggag

SEQ ID NO: 26489 - DNA, 20 bp, human
ggggagacgctccagatcag

SEQ ID NO: 26490 - DNA, 20 bp, human
gggaaaggggcgccgcacag

SEQ ID NO: 26491 - DNA, 20 bp, human
gggccggcggaaggccgcgt

SEQ ID NO: 26492 - DNA, 20 bp, human
gggcgtgtgttgggcgatgg

SEQ ID NO: 26493 - DNA, 20 bp, human
gcggcacggcggagcagcgg

SEQ ID NO: 26494 - DNA, 20 bp, human
gcgcgtcgccgcctccccca

SEQ ID NO: 26495 - DNA, 20 bp, human
gctgaggtccggctcctgag

SEQ ID NO: 26496 - DNA, 20 bp, human
gagggctcgcgggtcctgag

SEQ ID NO: 26497 - DNA, 20 bp, human
gcatggagcgaggatcgccg

SEQ ID NO: 26498 - DNA, 20 bp, human
gcatggtccggaggggatag

SEQ ID NO: 26499 - DNA, 20 bp, human
ggctcgcgggtcctgagggg

SEQ ID NO: 26500 - DNA, 20 bp, human
gtggagggcttcgaaaacgg

SEQ ID NO: 26501 - DNA, 20 bp, human
gggagcagctcgggctacag

SEQ ID NO: 26502 - DNA, 20 bp, human
gggctgggcactgagctctt

SEQ ID NO: 26503 - DNA, 20 bp, human
gcgtcggccatggtccggag

SEQ ID NO: 26504 - DNA, 20 bp, human
gcgagcgtcctcggcaccga

SEQ ID NO: 26505 - DNA, 20 bp, human
gaggggaggaggcgatcccg

SEQ ID NO: 26506 - DNA, 20 bp, human
ggagcccgaggagggcgaag

SEQ ID NO: 26507 - DNA, 20 bp, human
gagggcacggaccaagggtc

SEQ ID NO: 26508 - DNA, 20 bp, human
ggacgttgtcgggtccccgg

SEQ ID NO: 26509 - DNA, 20 bp, human
gggtgaaggcggaggacgta

SEQ ID NO: 26510 - DNA, 20 bp, human
gtgagctcggcgcggctcag

SEQ ID NO: 26511 - DNA, 20 bp, human
ggggtggagggcacggacca

SEQ ID NO: 26512 - DNA, 20 bp, human
ggaaggccagtgagtgccgg

SEQ ID NO: 26513 - DNA, 20 bp, human
ggccgccccttcgccctcct

SEQ ID NO: 26514 - DNA, 20 bp, human
gggcactcactggccttccc

SEQ ID NO: 26515 - DNA, 20 bp, human
gctctgcagcagcctctgcg

SEQ ID NO: 26516 - DNA, 20 bp, human
gcggagcccgcggccgacac

SEQ ID NO: 26517 - DNA, 20 bp, human
gtccctggcactcaggacgg

SEQ ID NO: 26518 - DNA, 20 bp, human
gtccgcgtgggagtgcccct

SEQ ID NO: 26519 - DNA, 20 bp, human
gagcccgcggccgacacggg

SEQ ID NO: 26520 - DNA, 20 bp, human
gggcccaccggggaacaaag

SEQ ID NO: 26521 - DNA, 20 bp, human
ggctggagggacattccggg

SEQ ID NO: 26522 - DNA, 20 bp, human
gacccaggggcactcccacg

SEQ ID NO: 26523 - DNA, 20 bp, human
ggcccgaggtataaacgcgg

SEQ ID NO: 26524 - DNA, 20 bp, human
ggcccagcccaggcccaccg

SEQ ID NO: 26525 - DNA, 20 bp, human
gacgtcccaagcccaaccca

SEQ ID NO: 26526 - DNA, 20 bp, human
gttcagtcacacaagaaggg

SEQ ID NO: 26527 - DNA, 20 bp, human
gagtttcagtcacacaagaa

SEQ ID NO: 26528 - DNA, 20 bp, human
gcatgttgaaagtctgacag

SEQ ID NO: 26529 - DNA, 20 bp, human
gtcgcatgtttatttaactc

SEQ ID NO: 26530 - DNA, 20 bp, human
ggaaaggaactgaggcttta

SEQ ID NO: 26531 - DNA, 20 bp, human
ggaagaaagagttttggaag

SEQ ID NO: 26532 - DNA, 20 bp, human
gttgagtagaagcaaggaaa

SEQ ID NO: 26533 - DNA, 20 bp, human
gaaagagttttggaaggggc

SEQ ID NO: 26534 - DNA, 20 bp, human
ggtttacttgagtagaagca

SEQ ID NO: 26535 - DNA, 20 bp, human
gattcttgcagactttagaa

SEQ ID NO: 26536 - DNA, 20 bp, human
gacaaggcaaatgctagatg

SEQ ID NO: 26537 - DNA, 20 bp, human
gtgagactctggagtaagaa

SEQ ID NO: 26538 - DNA, 20 bp, human
ggaattgtcaagaaaccaca

SEQ ID NO: 26539 - DNA, 20 bp, human
gtcagcaggaaactagtatc

SEQ ID NO: 26540 - DNA, 20 bp, human
gagctcacagagacaaagtt

SEQ ID NO: 26541 - DNA, 20 bp, human
gagccctgaggtcaaatgag

SEQ ID NO: 26542 - DNA, 20 bp, human
gccccggtaaaaggctatgt

SEQ ID NO: 26543 - DNA, 20 bp, human
gagtctcttcccaagcaaat

SEQ ID NO: 26544 - DNA, 20 bp, human
gaaactgaatcttcaggact

SEQ ID NO: 26545 - DNA, 20 bp, human
gaagaagctcccatttgctt

SEQ ID NO: 26546 - DNA, 20 bp, human
ggagcaggagaagccatggc

SEQ ID NO: 26547 - DNA, 20 bp, human
gcttctcctgctccccggac

SEQ ID NO: 26548 - DNA, 20 bp, human
gaacaagctggtccactgag

SEQ ID NO: 26549 - DNA, 20 bp, human
gacggtgagggtgagaagcc

SEQ ID NO: 26550 - DNA, 20 bp, human
gtccctgccagccttgataa

SEQ ID NO: 26551 - DNA, 20 bp, human
gagaagccaggcggttgaac

SEQ ID NO: 26552 - DNA, 20 bp, human
gcacagctttttcctgtccg

SEQ ID NO: 26553 - DNA, 20 bp, human
gttgagaacgttatattcaa

SEQ ID NO: 26554 - DNA, 20 bp, human
gaagtgttctgttacggtga

SEQ ID NO: 26555 - DNA, 20 bp, human
gagggagatatgtcagcttc

SEQ ID NO: 26556 - DNA, 20 bp, human
gtccatcatggccaacagtg

SEQ ID NO: 26557 - DNA, 20 bp, human
ggacagtgtggaatctcccg

SEQ ID NO: 26558 - DNA, 20 bp, human
ggcttctcaggagaaacccc

SEQ ID NO: 26559 - DNA, 20 bp, human
ggcctggtctatgaatcggg

SEQ ID NO: 26560 - DNA, 20 bp, human
ggaagcctggtctatgaatc

SEQ ID NO: 26561 - DNA, 20 bp, human
gtcggtgcccagctcagtat

SEQ ID NO: 26562 - DNA, 20 bp, human
gttcatagaccaggcttctc

SEQ ID NO: 26563 - DNA, 20 bp, human
ggccacccgattcatagacc

SEQ ID NO: 26564 - DNA, 20 bp, human
gagacagagataatgaagtc

SEQ ID NO: 26565 - DNA, 20 bp, human
gcacgtactgatcttggaga

SEQ ID NO: 26566 - DNA, 20 bp, human
ggcctgagggtggatgtaag

SEQ ID NO: 26567 - DNA, 20 bp, human
gtgcgagaggagggaggtcc

SEQ ID NO: 26568 - DNA, 20 bp, human
gaggagggaggtcccggtcc

SEQ ID NO: 26569 - DNA, 20 bp, human
gtcgcagctctcaaagccca

SEQ ID NO: 26570 - DNA, 20 bp, human
gttcctcgaggaagccctag

SEQ ID NO: 26571 - DNA, 20 bp, human
gcaccccacagggcgcccgt

SEQ ID NO: 26572 - DNA, 20 bp, human
gtttgagagctgcgagagga

SEQ ID NO: 26573 - DNA, 20 bp, human
gtggccttgatgcccccaga

SEQ ID NO: 26574 - DNA, 20 bp, human
gggtgtgagtgagctgggtc

SEQ ID NO: 26575 - DNA, 20 bp, human
gccactaaggcacaccccac

SEQ ID NO: 26576 - DNA, 20 bp, human
gcacagcccaaacaaaccgg

SEQ ID NO: 26577 - DNA, 20 bp, human
gggctgtgggcggtgcgcag

SEQ ID NO: 26578 - DNA, 20 bp, human
gtccctcataagggagccag

SEQ ID NO: 26579 - DNA, 20 bp, human
gcggagagcccgggaaaagc

SEQ ID NO: 26580 - DNA, 20 bp, human
gcaggggacgcaggtaagta

SEQ ID NO: 26581 - DNA, 20 bp, human
gagagaacccaagagcgggc

SEQ ID NO: 26582 - DNA, 20 bp, human
gagctgatggccgctgacag

SEQ ID NO: 26583 - DNA, 20 bp, human
gcaacccacgagggttctaa

SEQ ID NO: 26584 - DNA, 20 bp, human
gcgcggagtcaggctcggag

SEQ ID NO: 26585 - DNA, 20 bp, human
ggcccacagcccaaacaaac

SEQ ID NO: 26586 - DNA, 20 bp, human
gggagcacatctcccggcgg

SEQ ID NO: 26587 - DNA, 20 bp, human
gggctgacggcccggagcga

SEQ ID NO: 26588 - DNA, 20 bp, human
ggacgcggctcctagcggat

SEQ ID NO: 26589 - DNA, 20 bp, human
ggtgcagacgcggctcctag

SEQ ID NO: 26590 - DNA, 20 bp, human
ggcggatgggtgctattgtg

SEQ ID NO: 26591 - DNA, 20 bp, human
ggatgggtgctattgtgagg

SEQ ID NO: 26592 - DNA, 20 bp, human
gggcggttgtagaaggtatg

SEQ ID NO: 26593 - DNA, 20 bp, human
gcgcggaagcagtgcagacg

SEQ ID NO: 26594 - DNA, 20 bp, human
gattgtgaggcggttgtaga

SEQ ID NO: 26595 - DNA, 20 bp, human
gggcgctggagcacatctcc

SEQ ID NO: 26596 - DNA, 20 bp, human
gaaaggactcacctgccata

SEQ ID NO: 26597 - DNA, 20 bp, human
gagaggctgttccctatggc

SEQ ID NO: 26598 - DNA, 20 bp, human
ggtgttagagatattgacgg

SEQ ID NO: 26599 - DNA, 20 bp, human
gctttccaacgctgtaaaaa

SEQ ID NO: 26600 - DNA, 20 bp, human
gactttcatttttgactctg

SEQ ID NO: 26601 - DNA, 20 bp, human
gctgtccttttttacagcgt

SEQ ID NO: 26602 - DNA, 20 bp, human
gcgaaaaaggtttgtgatct

SEQ ID NO: 26603 - DNA, 20 bp, human
gagatctgattctgcgaaaa

SEQ ID NO: 26604 - DNA, 20 bp, human
ggtttccgccctttgcaata

SEQ ID NO: 26605 - DNA, 20 bp, human
gtttctggctcaaagacatc

SEQ ID NO: 26606 - DNA, 20 bp, human
ggtcacaggtgacagaatct

SEQ ID NO: 26607 - DNA, 20 bp, human
gcaaaatgtactgaactgga

SEQ ID NO: 26608 - DNA, 20 bp, human
gttaaggtgttggaatccct

SEQ ID NO: 26609 - DNA, 20 bp, human
gggaacaaaatgtactgaac

SEQ ID NO: 26610 - DNA, 20 bp, human
gtggattccaccccacaaaa

SEQ ID NO: 26611 - DNA, 20 bp, human
gctatgtgtcccttactaca

SEQ ID NO: 26612 - DNA, 20 bp, human
gactggtgttttggataact

SEQ ID NO: 26613 - DNA, 20 bp, human
ggaagacactgcttaggcct

SEQ ID NO: 26614 - DNA, 20 bp, human
gtagttcacaccttgtagta

SEQ ID NO: 26615 - DNA, 20 bp, human
ggaagacaaagttcgggtca

SEQ ID NO: 26616 - DNA, 20 bp, human
ggtgctgtacaaagagacag

SEQ ID NO: 26617 - DNA, 20 bp, human
gagacagaggctgttagcta

SEQ ID NO: 26618 - DNA, 20 bp, human
ggactgtgtagagacactga

SEQ ID NO: 26619 - DNA, 20 bp, human
gccagctgctagtcagaaaa

SEQ ID NO: 26620 - DNA, 20 bp, human
gggctctcagatctgattgt

SEQ ID NO: 26621 - DNA, 20 bp, human
ggactagcagctgggtactc

SEQ ID NO: 26622 - DNA, 20 bp, human
ggagaaggttcatagtctgg

SEQ ID NO: 26623 - DNA, 20 bp, human
gggggagaaggttcatagtc

SEQ ID NO: 26624 - DNA, 20 bp, human
gggattaatttggaatcaag

SEQ ID NO: 26625 - DNA, 20 bp, human
gatagtctggaggattaatt

SEQ ID NO: 26626 - DNA, 20 bp, human
gacctgccgggtgccccctg

SEQ ID NO: 26627 - DNA, 20 bp, human
gactcgggaccgccaggagg

SEQ ID NO: 26628 - DNA, 20 bp, human
gggaacgccaggcccgcgtg

SEQ ID NO: 26629 - DNA, 20 bp, human
gtaggcagggggcgtcgact

SEQ ID NO: 26630 - DNA, 20 bp, human
gtgaagcgctcagggcgggt

SEQ ID NO: 26631 - DNA, 20 bp, human
ggctactcgggaccgccagg

SEQ ID NO: 26632 - DNA, 20 bp, human
gtaaaaggctgtccccacgc

SEQ ID NO: 26633 - DNA, 20 bp, human
gccgaaagcgctcatcgccc

SEQ ID NO: 26634 - DNA, 20 bp, human
gcaactggccccacgctcgg

SEQ ID NO: 26635 - DNA, 20 bp, human
gaaagcgctcatcgccccgg

SEQ ID NO: 26636 - DNA, 20 bp, human
ggcggtagggcggctgggac

SEQ ID NO: 26637 - DNA, 20 bp, human
gcagtctgcggggatcaccg

SEQ ID NO: 26638 - DNA, 20 bp, human
gtaccgttcccacggcggta

SEQ ID NO: 26639 - DNA, 20 bp, human
gcgttcccacggcggtaggg

SEQ ID NO: 26640 - DNA, 20 bp, human
ggacccttgctgcggagcga

SEQ ID NO: 26641 - DNA, 20 bp, human
gccagccgccctaccgccgt

SEQ ID NO: 26642 - DNA, 20 bp, human
ggctgcagttaccgttccca

SEQ ID NO: 26643 - DNA, 20 bp, human
gcccggctaggagggaaggg

SEQ ID NO: 26644 - DNA, 20 bp, human
gccgccggcaggcaaggggt

SEQ ID NO: 26645 - DNA, 20 bp, human
ggcacagcggctaacagcga

SEQ ID NO: 26646 - DNA, 20 bp, human
gccatcgtgagagtaaggta

SEQ ID NO: 26647 - DNA, 20 bp, human
gtgctcagatggtagtggat

SEQ ID NO: 26648 - DNA, 20 bp, human
gtgctaccatcgtgagagta

SEQ ID NO: 26649 - DNA, 20 bp, human
ggtggataggcctgtgacga

SEQ ID NO: 26650 - DNA, 20 bp, human
gttagatgctcagatggtag

SEQ ID NO: 26651 - DNA, 20 bp, human
gatggtagcaccttcgtcac

SEQ ID NO: 26652 - DNA, 20 bp, human
gccctctgaccttaacaaag

SEQ ID NO: 26653 - DNA, 20 bp, human
gggcaagtgtgtatgttggt

SEQ ID NO: 26654 - DNA, 20 bp, human
gcctcggcaaggctctcaga

SEQ ID NO: 26655 - DNA, 20 bp, human
gaactgcacggccctcggca

SEQ ID NO: 26656 - DNA, 20 bp, human
gtctgagctggtctgaaggc

SEQ ID NO: 26657 - DNA, 20 bp, human
gctgttggcggggtacaggc

SEQ ID NO: 26658 - DNA, 20 bp, human
gcccgcagcccgcagcctct

SEQ ID NO: 26659 - DNA, 20 bp, human
gtggcggggtacaggcaggc

SEQ ID NO: 26660 - DNA, 20 bp, human
gagagtcctcagcaagtgag

SEQ ID NO: 26661 - DNA, 20 bp, human
gtcagaccagctcagacaca

SEQ ID NO: 26662 - DNA, 20 bp, human
gctgcctgaggaataccagt

SEQ ID NO: 26663 - DNA, 20 bp, human
gtcttctgaagctgttggcg

SEQ ID NO: 26664 - DNA, 20 bp, human
gtcaagacatcagtagaagg

SEQ ID NO: 26665 - DNA, 20 bp, human
gggaggctgggtggagcaaa

SEQ ID NO: 26666 - DNA, 20 bp, human
gaggaccacagagggacgca

SEQ ID NO: 26667 - DNA, 20 bp, human
gaaaggaaccgggttgtctt

SEQ ID NO: 26668 - DNA, 20 bp, human
gatgccagggagacctcggt

SEQ ID NO: 26669 - DNA, 20 bp, human
ggagacctcggtgggcagaa

SEQ ID NO: 26670 - DNA, 20 bp, human
gcggtgggcagaaaggaacc

SEQ ID NO: 26671 - DNA, 20 bp, human
gggcgggtaagttgtcgtag

SEQ ID NO: 26672 - DNA, 20 bp, human
gagccctgaagctgcaccgg

SEQ ID NO: 26673 - DNA, 20 bp, human
gaaccgggttgtcttgggcc

SEQ ID NO: 26674 - DNA, 20 bp, human
gccctctcgaaggaccacag

SEQ ID NO: 26675 - DNA, 20 bp, human
ggtaggggcccggtccgtga

SEQ ID NO: 26676 - DNA, 20 bp, human
gggacccggccgtgcagcgc

SEQ ID NO: 26677 - DNA, 20 bp, human
gcatggacgaagcggatcgg

SEQ ID NO: 26678 - DNA, 20 bp, human
gggcggcctggagtcttagt

SEQ ID NO: 26679 - DNA, 20 bp, human
gctactcgccatggacgaag

SEQ ID NO: 26680 - DNA, 20 bp, human
gcgccatggacgaagcggat

SEQ ID NO: 26681 - DNA, 20 bp, human
ggcccggaagcggactgagg

SEQ ID NO: 26682 - DNA, 20 bp, human
gacgcaagagcgactcctgg

SEQ ID NO: 26683 - DNA, 20 bp, human
ggtccccacgcccctcgagg

SEQ ID NO: 26684 - DNA, 20 bp, human
gagtagccaactaagactcc

SEQ ID NO: 26685 - DNA, 20 bp, human
ggtggcttcaaacccctcag

SEQ ID NO: 26686 - DNA, 20 bp, human
ggaaccccccgaggatgaca

SEQ ID NO: 26687 - DNA, 20 bp, human
gctgagttaggggctcaagt

SEQ ID NO: 26688 - DNA, 20 bp, human
gctagggacacccaagtcag

SEQ ID NO: 26689 - DNA, 20 bp, human
gtgagtgctacagacaggat

SEQ ID NO: 26690 - DNA, 20 bp, human
ggtccagaagaggttagctg

SEQ ID NO: 26691 - DNA, 20 bp, human
gctgtctgtagcactcatgg

SEQ ID NO: 26692 - DNA, 20 bp, human
ggtcccagattctgagttag

SEQ ID NO: 26693 - DNA, 20 bp, human
ggaggtagtgggatctgggt

SEQ ID NO: 26694 - DNA, 20 bp, human
gctctaccatgaaccccccg

SEQ ID NO: 26695 - DNA, 20 bp, human
gagcatgtctagcccctctc

SEQ ID NO: 26696 - DNA, 20 bp, human
gcagccagctctggaatcgt

SEQ ID NO: 26697 - DNA, 20 bp, human
ggagctggctggacccaagg

SEQ ID NO: 26698 - DNA, 20 bp, human
gctcttgcagggcagaagag

SEQ ID NO: 26699 - DNA, 20 bp, human
gctggccaaaggcattccct

SEQ ID NO: 26700 - DNA, 20 bp, human
gtatcccaacccctggccaa

SEQ ID NO: 26701 - DNA, 20 bp, human
ggagccggtgtcttcagata

SEQ ID NO: 26702 - DNA, 20 bp, human
ggagcccacgattccagagc

SEQ ID NO: 26703 - DNA, 20 bp, human
ggcgcagacagcatgccctt

SEQ ID NO: 26704 - DNA, 20 bp, human
gcttgaggtaagtaaccaaa

SEQ ID NO: 26705 - DNA, 20 bp, human
gcaccggctcatggtagtag

SEQ ID NO: 26706 - DNA, 20 bp, human
gccctcggcacagagaacgt

SEQ ID NO: 26707 - DNA, 20 bp, human
gaaggaaccgggactaactg

SEQ ID NO: 26708 - DNA, 20 bp, human
gcgcgcaggagagtggaagg

SEQ ID NO: 26709 - DNA, 20 bp, human
ggactcttcagggtcgctga

SEQ ID NO: 26710 - DNA, 20 bp, human
gggctcgggtccccagcaga

SEQ ID NO: 26711 - DNA, 20 bp, human
gagcagcgcgctgtggagtc

SEQ ID NO: 26712 - DNA, 20 bp, human
gcgggctaaggagacggtga

SEQ ID NO: 26713 - DNA, 20 bp, human
ggccctttcgcgcaggagag

SEQ ID NO: 26714 - DNA, 20 bp, human
gagccggcctgtggccctcg

SEQ ID NO: 26715 - DNA, 20 bp, human
gcgcgtcttcggttccccga

SEQ ID NO: 26716 - DNA, 20 bp, human
ggcccaaggtgagtgatgtg

SEQ ID NO: 26717 - DNA, 20 bp, human
ggccccacatcactcacctt

SEQ ID NO: 26718 - DNA, 20 bp, human
gtccacatcaccgacatgaa

SEQ ID NO: 26719 - DNA, 20 bp, human
gctggacgcaaaatgatgga

SEQ ID NO: 26720 - DNA, 20 bp, human
gaggctgcaggcaagggtct

SEQ ID NO: 26721 - DNA, 20 bp, human
gccaaataggacagttagag

SEQ ID NO: 26722 - DNA, 20 bp, human
gacccatcttggatgcaaac

SEQ ID NO: 26723 - DNA, 20 bp, human
gatgaagggaacaggcatca

SEQ ID NO: 26724 - DNA, 20 bp, human
gggagctatctgacaacaca

SEQ ID NO: 26725 - DNA, 20 bp, human
gatgcctgttcccttcatgt

SEQ ID NO: 26726 - DNA, 20 bp, human
gagctccaagcggaaaccgc

SEQ ID NO: 26727 - DNA, 20 bp, human
gccgtcgcactcagagagct

SEQ ID NO: 26728 - DNA, 20 bp, human
gacgcagggcaggtagccgg

SEQ ID NO: 26729 - DNA, 20 bp, human
gaccaggccccggacacgca

SEQ ID NO: 26730 - DNA, 20 bp, human
gcaccggaccccgcagtcct

SEQ ID NO: 26731 - DNA, 20 bp, human
ggaggtctgcattcctagct

SEQ ID NO: 26732 - DNA, 20 bp, human
gagacaagtggcccaaaaga

SEQ ID NO: 26733 - DNA, 20 bp, human
gctgcattcctagctgggct

SEQ ID NO: 26734 - DNA, 20 bp, human
gtcgccagggtcgcgatagt

SEQ ID NO: 26735 - DNA, 20 bp, human
gtccctgcagcggactcccc

SEQ ID NO: 26736 - DNA, 20 bp, human
ggaaccccggcgcagacctg

SEQ ID NO: 26737 - DNA, 20 bp, human
gatcggggctaggggaaccc

SEQ ID NO: 26738 - DNA, 20 bp, human
gggagcgccactcacctcat

SEQ ID NO: 26739 - DNA, 20 bp, human
gtggcgttggccgggtagag

SEQ ID NO: 26740 - DNA, 20 bp, human
ggcctggcaacgcccaggga

SEQ ID NO: 26741 - DNA, 20 bp, human
gagcgcactggacccggccg

SEQ ID NO: 26742 - DNA, 20 bp, human
ggccagcctggcaacgccca

SEQ ID NO: 26743 - DNA, 20 bp, human
gttggccgggtagagtggag

SEQ ID NO: 26744 - DNA, 20 bp, human
gccaccccaggtctgcgccg

SEQ ID NO: 26745 - DNA, 20 bp, human
ggtccctccgcgggcaggaa

SEQ ID NO: 26746 - DNA, 20 bp, human
gcaagtgcaggtaagagact

SEQ ID NO: 26747 - DNA, 20 bp, human
gggagtaagcgacccccagg

SEQ ID NO: 26748 - DNA, 20 bp, human
gtcgcttactccaactgagg

SEQ ID NO: 26749 - DNA, 20 bp, human
gggtgactttccaagtccgg

SEQ ID NO: 26750 - DNA, 20 bp, human
gaccccgccaccccctcagt

SEQ ID NO: 26751 - DNA, 20 bp, human
gccagccagcctgcgatcgg

SEQ ID NO: 26752 - DNA, 20 bp, human
gacgcgctgtgggctcccgg

SEQ ID NO: 26753 - DNA, 20 bp, human
gaggtgccaggcgcgagcac

SEQ ID NO: 26754 - DNA, 20 bp, human
gcgggacagggggagagacg

SEQ ID NO: 26755 - DNA, 20 bp, human
gtgccgcttgcagcagggag

SEQ ID NO: 26756 - DNA, 20 bp, human
ggcaggaggcctcggctcgt

SEQ ID NO: 26757 - DNA, 20 bp, human
gggctgtcagccatagcgtg

SEQ ID NO: 26758 - DNA, 20 bp, human
gctgtgcagaacactgcagg

SEQ ID NO: 26759 - DNA, 20 bp, human
gtgtccgcgacaggctcggg

SEQ ID NO: 26760 - DNA, 20 bp, human
gcagatttgcctgctgaggg

SEQ ID NO: 26761 - DNA, 20 bp, human
gtgaagtcgccacggactcg

SEQ ID NO: 26762 - DNA, 20 bp, human
gggtggagacccacgagccg

SEQ ID NO: 26763 - DNA, 20 bp, human
gcacagcaaaccgcacgcta

SEQ ID NO: 26764 - DNA, 20 bp, human
ggcttggagggactgtaccg

SEQ ID NO: 26765 - DNA, 20 bp, human
gtagttgtggggtcccagca

SEQ ID NO: 26766 - DNA, 20 bp, human
gtctgtctgtagctgaagta

SEQ ID NO: 26767 - DNA, 20 bp, human
gtgagagggtagtccttgtg

SEQ ID NO: 26768 - DNA, 20 bp, human
gctcatcccagttggtaaac

SEQ ID NO: 26769 - DNA, 20 bp, human
gactaccctctcatcccagt

SEQ ID NO: 26770 - DNA, 20 bp, human
gtggtaaactggtcttaaac

SEQ ID NO: 26771 - DNA, 20 bp, human
gtaagaccagtttaccaact

SEQ ID NO: 26772 - DNA, 20 bp, human
gggcatgttgcttgggtcga

SEQ ID NO: 26773 - DNA, 20 bp, human
ggactggcctcaatgccagg

SEQ ID NO: 26774 - DNA, 20 bp, human
gggtggattgagatgttctg

SEQ ID NO: 26775 - DNA, 20 bp, human
gtcttgtcttcacatatgta

SEQ ID NO: 26776 - DNA, 20 bp, human
gctgcagcaccaggatacag

SEQ ID NO: 26777 - DNA, 20 bp, human
gtgaggatggctgcgatgga

SEQ ID NO: 26778 - DNA, 20 bp, human
gcagggctcagtgaccccat

SEQ ID NO: 26779 - DNA, 20 bp, human
ggacagccgtgcccagggta

SEQ ID NO: 26780 - DNA, 20 bp, human
gacgctggtcaggaagctgt

SEQ ID NO: 26781 - DNA, 20 bp, human
gtgaccccatcggcaaagtg

SEQ ID NO: 26782 - DNA, 20 bp, human
gtgcgatggacggcaaggac

SEQ ID NO: 26783 - DNA, 20 bp, human
gagcaccaggatacagaggc

SEQ ID NO: 26784 - DNA, 20 bp, human
gaggatgaggatggctgcga

SEQ ID NO: 26785 - DNA, 20 bp, human
gatggctgcgatggacggca

SEQ ID NO: 26786 - DNA, 20 bp, human
ggattgtctcaggcacaggt

SEQ ID NO: 26787 - DNA, 20 bp, human
gcgttgctccgcatggtcct

SEQ ID NO: 26788 - DNA, 20 bp, human
gcggggctggacaaagaatc

SEQ ID NO: 26789 - DNA, 20 bp, human
gtagcccctacccacagccc

SEQ ID NO: 26790 - DNA, 20 bp, human
ggcccgattgtctcaggcac

SEQ ID NO: 26791 - DNA, 20 bp, human
ggaggcggaagcgtgaaata

SEQ ID NO: 26792 - DNA, 20 bp, human
ggcgtgaaataaggactgag

SEQ ID NO: 26793 - DNA, 20 bp, human
gggcctaggcggcgagtggc

SEQ ID NO: 26794 - DNA, 20 bp, human
ggggcgagcgttgctccgca

SEQ ID NO: 26795 - DNA, 20 bp, human
gcaaaaacaccgcaagaaaa

SEQ ID NO: 26796 - DNA, 20 bp, human
gttagcgtctggattctgag

SEQ ID NO: 26797 - DNA, 20 bp, human
ggcagagaaggggccacgaa

SEQ ID NO: 26798 - DNA, 20 bp, human
gaagtctacagggcacataa

SEQ ID NO: 26799 - DNA, 20 bp, human
gctgttggatgctaaaagca

SEQ ID NO: 26800 - DNA, 20 bp, human
gctggtcattcaagtctaca

SEQ ID NO: 26801 - DNA, 20 bp, human
gtaagcagacgagtatctga

SEQ ID NO: 26802 - DNA, 20 bp, human
gtgactgttagataatctga

SEQ ID NO: 26803 - DNA, 20 bp, human
gtctcgagtggcgctggtga

SEQ ID NO: 26804 - DNA, 20 bp, human
gactagaaatgactctcgag

SEQ ID NO: 26805 - DNA, 20 bp, human
gcagttgacactacatcggt

SEQ ID NO: 26806 - DNA, 20 bp, human
gcacccctcgaggcctgtat

SEQ ID NO: 26807 - DNA, 20 bp, human
gagagactgagcaaacatga

SEQ ID NO: 26808 - DNA, 20 bp, human
gctctggcaatgccccccat

SEQ ID NO: 26809 - DNA, 20 bp, human
gccctcgaggcctgtatggg

SEQ ID NO: 26810 - DNA, 20 bp, human
gatataagggttcctatggg

SEQ ID NO: 26811 - DNA, 20 bp, human
gggataatgaaaaggcctgg

SEQ ID NO: 26812 - DNA, 20 bp, human
gaacatgagggataatgaaa

SEQ ID NO: 26813 - DNA, 20 bp, human
ggatagctctcgccccacag

SEQ ID NO: 26814 - DNA, 20 bp, human
gtgctcctctggccgaccgt

SEQ ID NO: 26815 - DNA, 20 bp, human
gggactcaggaggaccgtat

SEQ ID NO: 26816 - DNA, 20 bp, human
gctgctaagtaggtcagtag

SEQ ID NO: 26817 - DNA, 20 bp, human
ggctgattggctgttaccaa

SEQ ID NO: 26818 - DNA, 20 bp, human
gagaagaaagacccaaagtc

SEQ ID NO: 26819 - DNA, 20 bp, human
ggctgcagtgtatggagata

SEQ ID NO: 26820 - DNA, 20 bp, human
gctataaatgaaccaactgg

SEQ ID NO: 26821 - DNA, 20 bp, human
gacaaaggaatgataactgg

SEQ ID NO: 26822 - DNA, 20 bp, human
gttgggaattgccccattga

SEQ ID NO: 26823 - DNA, 20 bp, human
gaaacttggctcctgacttt

SEQ ID NO: 26824 - DNA, 20 bp, human
gttagcactctagtcacctt

SEQ ID NO: 26825 - DNA, 20 bp, human
gaagaagttgctgcagtgta

SEQ ID NO: 26826 - DNA, 20 bp, human
gactccccgtggcggttgag

SEQ ID NO: 26827 - DNA, 20 bp, human
ggtgcagcgactccccgtgg

SEQ ID NO: 26828 - DNA, 20 bp, human
gctgctccccaacctcactg

SEQ ID NO: 26829 - DNA, 20 bp, human
gattgtgcagcgactccccg

SEQ ID NO: 26830 - DNA, 20 bp, human
gtcaacatcagcatcgactt

SEQ ID NO: 26831 - DNA, 20 bp, human
gtaaaaggggagcctcagtg

SEQ ID NO: 26832 - DNA, 20 bp, human
gctgcccctcaaccgccacg

SEQ ID NO: 26833 - DNA, 20 bp, human
gaccagcggtcggagccaca

SEQ ID NO: 26834 - DNA, 20 bp, human
ggcttcagcctgcacgtact

SEQ ID NO: 26835 - DNA, 20 bp, human
ggcacaatccgagtacgtgc

SEQ ID NO: 26836 - DNA, 20 bp, human
gcaggagcggaagcagagtg

SEQ ID NO: 26837 - DNA, 20 bp, human
gagaccaagtggaggagtag

SEQ ID NO: 26838 - DNA, 20 bp, human
ggcatccccccgcccctgga

SEQ ID NO: 26839 - DNA, 20 bp, human
gcgatacccacgagggtcgg

SEQ ID NO: 26840 - DNA, 20 bp, human
gacggggaggaactaggaag

SEQ ID NO: 26841 - DNA, 20 bp, human
ggggcccggagcaatagcag

SEQ ID NO: 26842 - DNA, 20 bp, human
ggtggccagaaacattagta

SEQ ID NO: 26843 - DNA, 20 bp, human
ggtccataaagaccaagtgg

SEQ ID NO: 26844 - DNA, 20 bp, human
gagaggtgcgatacccacga

SEQ ID NO: 26845 - DNA, 20 bp, human
gcggccgagtgacagttgac

SEQ ID NO: 26846 - DNA, 20 bp, human
gggagccgtagctgtcggag

SEQ ID NO: 26847 - DNA, 20 bp, human
gctaaccgctccgacagcta

SEQ ID NO: 26848 - DNA, 20 bp, human
gtgagaagtcagcctggcgg

SEQ ID NO: 26849 - DNA, 20 bp, human
gtgcacggagccgtagctgt

SEQ ID NO: 26850 - DNA, 20 bp, human
gggctgggacagctctcctc

SEQ ID NO: 26851 - DNA, 20 bp, human
gtaagccaaggcgaccaaca

SEQ ID NO: 26852 - DNA, 20 bp, human
gggggtggggtgtgcgtaca

SEQ ID NO: 26853 - DNA, 20 bp, human
gacgtggtcaaggtaagcca

SEQ ID NO: 26854 - DNA, 20 bp, human
gggagggcggcaacggcggt

SEQ ID NO: 26855 - DNA, 20 bp, human
gtacacggcaatgctaaaga

SEQ ID NO: 26856 - DNA, 20 bp, human
gtggctggatgaaaactgtg

SEQ ID NO: 26857 - DNA, 20 bp, human
gctgtgctttaagggaactg

SEQ ID NO: 26858 - DNA, 20 bp, human
gccgagccggcgccccccca

SEQ ID NO: 26859 - DNA, 20 bp, human
gccccagacatgctggcccg

SEQ ID NO: 26860 - DNA, 20 bp, human
ggtgctccgaagtggagaga

SEQ ID NO: 26861 - DNA, 20 bp, human
gccagaggagtgctccgaag

SEQ ID NO: 26862 - DNA, 20 bp, human
gaggcagggccggaccgcgg

SEQ ID NO: 26863 - DNA, 20 bp, human
gggcaaatacgtagactcgg

SEQ ID NO: 26864 - DNA, 20 bp, human
ggccacgggccagcatgtct

SEQ ID NO: 26865 - DNA, 20 bp, human
gtcagcggtgccaacgccag

SEQ ID NO: 26866 - DNA, 20 bp, human
ggcgcaccaaggctgcgatg

SEQ ID NO: 26867 - DNA, 20 bp, human
gctgcagcggccgcgcacca

SEQ ID NO: 26868 - DNA, 20 bp, human
gcttctcttagggtcacggt

SEQ ID NO: 26869 - DNA, 20 bp, human
ggtgaccctaagagaagagg

SEQ ID NO: 26870 - DNA, 20 bp, human
gagggtcacggtgggcgcac

SEQ ID NO: 26871 - DNA, 20 bp, human
gagagaagaggcggacgccc

SEQ ID NO: 26872 - DNA, 20 bp, human
ggccgacccggtagcaatgg

SEQ ID NO: 26873 - DNA, 20 bp, human
ggcgtccgcctcttctctta

SEQ ID NO: 26874 - DNA, 20 bp, human
gacgcgggcggcctggtgac

SEQ ID NO: 26875 - DNA, 20 bp, human
ggagccgcaccgcgccagcc

SEQ ID NO: 26876 - DNA, 20 bp, human
gcagagctggggggatccac

SEQ ID NO: 26877 - DNA, 20 bp, human
gggaggagatccgagctgtg

SEQ ID NO: 26878 - DNA, 20 bp, human
gatgacctaagtgctaatca

SEQ ID NO: 26879 - DNA, 20 bp, human
gccatcatcgcagagctggg

SEQ ID NO: 26880 - DNA, 20 bp, human
gctggggctgaaaatacttg

SEQ ID NO: 26881 - DNA, 20 bp, human
gtggcagggacataagtctg

SEQ ID NO: 26882 - DNA, 20 bp, human
gcaggagcgtcacagtagta

SEQ ID NO: 26883 - DNA, 20 bp, human
gagcgtcacagtagtaagga

SEQ ID NO: 26884 - DNA, 20 bp, human
gacgaggacatagtcaaggt

SEQ ID NO: 26885 - DNA, 20 bp, human
gtcggcgggcggagagtgtc

SEQ ID NO: 26886 - DNA, 20 bp, human
gtggtgtctggttagctcgg

SEQ ID NO: 26887 - DNA, 20 bp, human
gcggcccggcctaagttccg

SEQ ID NO: 26888 - DNA, 20 bp, human
ggcggggcgcggcctaacgg

SEQ ID NO: 26889 - DNA, 20 bp, human
ggcgccgcccgaagagctcg

SEQ ID NO: 26890 - DNA, 20 bp, human
ggagccccgagctcttcggg

SEQ ID NO: 26891 - DNA, 20 bp, human
gcggtgtgagggaaattgtg

SEQ ID NO: 26892 - DNA, 20 bp, human
ggggcggcgcaggaagcgac

SEQ ID NO: 26893 - DNA, 20 bp, human
gggcggcgctcggcgatggt

SEQ ID NO: 26894 - DNA, 20 bp, human
gtggtggtgtctggttagct

SEQ ID NO: 26895 - DNA, 20 bp, human
ggcccgcggcctcggaactt

SEQ ID NO: 26896 - DNA, 20 bp, human
ggttggagccacaggcgcgg

SEQ ID NO: 26897 - DNA, 20 bp, human
gggggccccgtgagactctc

SEQ ID NO: 26898 - DNA, 20 bp, human
ggtcaggctctgctcacggg

SEQ ID NO: 26899 - DNA, 20 bp, human
gggcgttggagccacaggcg

SEQ ID NO: 26900 - DNA, 20 bp, human
gagccgcccctgagtcgtgg

SEQ ID NO: 26901 - DNA, 20 bp, human
gcgcgcggcgttggagccac

SEQ ID NO: 26902 - DNA, 20 bp, human
ggttggctccaccctgccgt

SEQ ID NO: 26903 - DNA, 20 bp, human
gggtccagccgccgcgcctg

SEQ ID NO: 26904 - DNA, 20 bp, human
gccccgcctccacgactcag

SEQ ID NO: 26905 - DNA, 20 bp, human
ggcagccgcgccgagcgcac

SEQ ID NO: 26906 - DNA, 20 bp, human
gcacccagttggtggccggg

SEQ ID NO: 26907 - DNA, 20 bp, human
ggctggggcgtcctggagtt

SEQ ID NO: 26908 - DNA, 20 bp, human
gggagggcctcggctttcca

SEQ ID NO: 26909 - DNA, 20 bp, human
gcaggccccgcgaagctcta

SEQ ID NO: 26910 - DNA, 20 bp, human
ggccctcccggccaccaact

SEQ ID NO: 26911 - DNA, 20 bp, human
gcggcactgtcaactaagct

SEQ ID NO: 26912 - DNA, 20 bp, human
ggggacagaggcccaactcc

SEQ ID NO: 26913 - DNA, 20 bp, human
ggagccacaggtggatcccg

SEQ ID NO: 26914 - DNA, 20 bp, human
gcccaggtaagaggctcgag

SEQ ID NO: 26915 - DNA, 20 bp, human
gcagcctcgggatccacctg

SEQ ID NO: 26916 - DNA, 20 bp, human
gtcagcgcggagccagccag

SEQ ID NO: 26917 - DNA, 20 bp, human
gctgcgcgggcggcaggcaa

SEQ ID NO: 26918 - DNA, 20 bp, human
gcggcaggcaacggctgagg

SEQ ID NO: 26919 - DNA, 20 bp, human
gcgccgataagggcaagcag

SEQ ID NO: 26920 - DNA, 20 bp, human
gcccagcgcagcgccgataa

SEQ ID NO: 26921 - DNA, 20 bp, human
gctccgcccgggcccactcg

SEQ ID NO: 26922 - DNA, 20 bp, human
ggggcggcaggcaacggctg

SEQ ID NO: 26923 - DNA, 20 bp, human
gggtccccgggagtcccggt

SEQ ID NO: 26924 - DNA, 20 bp, human
gcggcgagattgcccctccg

SEQ ID NO: 26925 - DNA, 20 bp, human
gctccgcgggcgcaccgacc

SEQ ID NO: 26926 - DNA, 20 bp, human
gcggctatccgggcggaggg

SEQ ID NO: 26927 - DNA, 20 bp, human
gtcggctcgactgcgagcga

SEQ ID NO: 26928 - DNA, 20 bp, human
gggagagaagcagggcgtga

SEQ ID NO: 26929 - DNA, 20 bp, human
gacggtggacaagaagatgg

SEQ ID NO: 26930 - DNA, 20 bp, human
gagcgttccccgactcccaa

SEQ ID NO: 26931 - DNA, 20 bp, human
gccgcggggaggggaacgag

SEQ ID NO: 26932 - DNA, 20 bp, human
gggcagggacgaggccggga

SEQ ID NO: 26933 - DNA, 20 bp, human
gtgtctggctaccccaaacg

SEQ ID NO: 26934 - DNA, 20 bp, human
ggagcggacggaggaagcgg

SEQ ID NO: 26935 - DNA, 20 bp, human
ggaagacgggcacagaaacc

SEQ ID NO: 26936 - DNA, 20 bp, human
gccgcagcagcactagcagg

SEQ ID NO: 26937 - DNA, 20 bp, human
gagggcgtccaggcagacgg

SEQ ID NO: 26938 - DNA, 20 bp, human
gacgccgcagcagcactagc

SEQ ID NO: 26939 - DNA, 20 bp, human
gcgccgtccagtttgaagtg

SEQ ID NO: 26940 - DNA, 20 bp, human
gtccccgagtcgggcgggag

SEQ ID NO: 26941 - DNA, 20 bp, human
gaactggacggcggcggcaa

SEQ ID NO: 26942 - DNA, 20 bp, human
gcccgggccggcaagaagtg

SEQ ID NO: 26943 - DNA, 20 bp, human
gcggcgccgaaaggcaagaa

SEQ ID NO: 26944 - DNA, 20 bp, human
gtgccccacttcaaactgga

SEQ ID NO: 26945 - DNA, 20 bp, human
gtcccctcccgcccgactcg

SEQ ID NO: 26946 - DNA, 20 bp, human
ggggccaccgccagagccat

SEQ ID NO: 26947 - DNA, 20 bp, human
ggtgccgggaaggaccggtg

SEQ ID NO: 26948 - DNA, 20 bp, human
gccgggcgggctccagactc

SEQ ID NO: 26949 - DNA, 20 bp, human
gaccggtgcggctgggatag

SEQ ID NO: 26950 - DNA, 20 bp, human
ggcccggaagagctcgtcgt

SEQ ID NO: 26951 - DNA, 20 bp, human
gcgcgaggctcccatggctc

SEQ ID NO: 26952 - DNA, 20 bp, human
ggctctggcggtggccccgt

SEQ ID NO: 26953 - DNA, 20 bp, human
gagcctcgcgtgtgccggga

SEQ ID NO: 26954 - DNA, 20 bp, human
gcggcctcgcccagagtgaa

SEQ ID NO: 26955 - DNA, 20 bp, human
gtcccactgtcgcccccacg

SEQ ID NO: 26956 - DNA, 20 bp, human
gaggtaccacaccagacggt

SEQ ID NO: 26957 - DNA, 20 bp, human
ggatcacactggtaaggagg

SEQ ID NO: 26958 - DNA, 20 bp, human
gcacactggtaaggaggcgg

SEQ ID NO: 26959 - DNA, 20 bp, human
gatcatggatcacactggta

SEQ ID NO: 26960 - DNA, 20 bp, human
ggccgaatcatggatcacac

SEQ ID NO: 26961 - DNA, 20 bp, human
gtggacgggcgagaatgggt

SEQ ID NO: 26962 - DNA, 20 bp, human
gggagtggacgggcgagaat

SEQ ID NO: 26963 - DNA, 20 bp, human
ggttgttgccggcacggagg

SEQ ID NO: 26964 - DNA, 20 bp, human
gctttacgctgggagtggac

SEQ ID NO: 26965 - DNA, 20 bp, human
gcacaggagttggatagtag

SEQ ID NO: 26966 - DNA, 20 bp, human
ggcccgcgggcagaatgaga

SEQ ID NO: 26967 - DNA, 20 bp, human
gtaattcagagcggcggcgg

SEQ ID NO: 26968 - DNA, 20 bp, human
gaccccacgtccgaccccac

SEQ ID NO: 26969 - DNA, 20 bp, human
gcaataattcagagcggcgg

SEQ ID NO: 26970 - DNA, 20 bp, human
gtgcccagggcagtgcccgt

SEQ ID NO: 26971 - DNA, 20 bp, human
gggtgtagtgtccagagcgg

SEQ ID NO: 26972 - DNA, 20 bp, human
ggcgcgctctccgcccgctc

SEQ ID NO: 26973 - DNA, 20 bp, human
gcatcaataattcagagcgg

SEQ ID NO: 26974 - DNA, 20 bp, human
ggtcccggagtgcgaggaag

SEQ ID NO: 26975 - DNA, 20 bp, human
gtgcccgtggggtcggacgt

SEQ ID NO: 26976 - DNA, 20 bp, human
gtcccgcagggctagaagag

SEQ ID NO: 26977 - DNA, 20 bp, human
gccaccagtccgaggtccag

SEQ ID NO: 26978 - DNA, 20 bp, human
gtacctggaacatccatgct

SEQ ID NO: 26979 - DNA, 20 bp, human
gaaggttccgagtcctaggg

SEQ ID NO: 26980 - DNA, 20 bp, human
gtcccagttggggaactgtc

SEQ ID NO: 26981 - DNA, 20 bp, human
gagagcaacttcgcggacag

SEQ ID NO: 26982 - DNA, 20 bp, human
ggggaaggttccgagtccta

SEQ ID NO: 26983 - DNA, 20 bp, human
ggttccgagtcctagggagg

SEQ ID NO: 26984 - DNA, 20 bp, human
gggatggctgggacgaagag

SEQ ID NO: 26985 - DNA, 20 bp, human
gtagagaaaatgaggcgagt

SEQ ID NO: 26986 - DNA, 20 bp, human
ggaaaacgccagcagagcca

SEQ ID NO: 26987 - DNA, 20 bp, human
gagtccactggaggtaggga

SEQ ID NO: 26988 - DNA, 20 bp, human
gtctgagtccactggaggta

SEQ ID NO: 26989 - DNA, 20 bp, human
gtatgtcacgcaggcctctc

SEQ ID NO: 26990 - DNA, 20 bp, human
gggagagaaggcgttcacct

SEQ ID NO: 26991 - DNA, 20 bp, human
gcacgcaggcctctccggag

SEQ ID NO: 26992 - DNA, 20 bp, human
gtctggtaaacagccccagg

SEQ ID NO: 26993 - DNA, 20 bp, human
gcccagggcggaggagagca

SEQ ID NO: 26994 - DNA, 20 bp, human
ggaggaagtcccggtaaaca

SEQ ID NO: 26995 - DNA, 20 bp, human
gctatcgagagtgggcgtct

SEQ ID NO: 26996 - DNA, 20 bp, human
gccgcgggctccgagaaaag

SEQ ID NO: 26997 - DNA, 20 bp, human
gccgcttggagggcactcgg

SEQ ID NO: 26998 - DNA, 20 bp, human
gggagagagctgctcagatg

SEQ ID NO: 26999 - DNA, 20 bp, human
gctggtgtcacccagaggta

SEQ ID NO: 27000 - DNA, 20 bp, human
gcggcagggacgagttacag

SEQ ID NO: 27001 - DNA, 20 bp, human
gctcccggccaggcgcggtc

SEQ ID NO: 27002 - DNA, 20 bp, human
gcccgaacctggggaccggc

SEQ ID NO: 27003 - DNA, 20 bp, human
gctggggcctggcgagctca

SEQ ID NO: 27004 - DNA, 20 bp, human
ggctcgatctgagtccgcag

SEQ ID NO: 27005 - DNA, 20 bp, human
ggcgcgctgccccgaacctg

SEQ ID NO: 27006 - DNA, 20 bp, human
gggccgggcgtgtaacccac

SEQ ID NO: 27007 - DNA, 20 bp, human
ggccagactcgagcagtctc

SEQ ID NO: 27008 - DNA, 20 bp, human
ggtcgtgggcgcgcacccgt

SEQ ID NO: 27009 - DNA, 20 bp, human
gcctgcgtggagaacagacc

SEQ ID NO: 27010 - DNA, 20 bp, human
gacgcgggcatcgccttcaa

SEQ ID NO: 27011 - DNA, 20 bp, human
gtggtgactggaggcaacaa

SEQ ID NO: 27012 - DNA, 20 bp, human
gtccagagactgctcgagtc

SEQ ID NO: 27013 - DNA, 20 bp, human
gacgtgctggtcaacaacgc

SEQ ID NO: 27014 - DNA, 20 bp, human
gggtccataacgcctcccta

SEQ ID NO: 27015 - DNA, 20 bp, human
ggccaggagccccagtgcat

SEQ ID NO: 27016 - DNA, 20 bp, human
gacactagctgggctcctcg

SEQ ID NO: 27017 - DNA, 20 bp, human
gccgggcttcggaccacctg

SEQ ID NO: 27018 - DNA, 20 bp, human
gggccgtcgccttcaagagt

SEQ ID NO: 27019 - DNA, 20 bp, human
gcaccctcggagcgctccag

SEQ ID NO: 27020 - DNA, 20 bp, human
gcctgcgcaaggagtacggg

SEQ ID NO: 27021 - DNA, 20 bp, human
gcagaacttagtctgcgcgg

SEQ ID NO: 27022 - DNA, 20 bp, human
ggccccctggagcgctccga

SEQ ID NO: 27023 - DNA, 20 bp, human
gctcggtcactcaagtggac

SEQ ID NO: 27024 - DNA, 20 bp, human
gtcactcaagtggacgggtg

SEQ ID NO: 27025 - DNA, 20 bp, human
ggtaggtgcagggcttgggt

SEQ ID NO: 27026 - DNA, 20 bp, human
gaaggggccaaagccgccgc

SEQ ID NO: 27027 - DNA, 20 bp, human
gggctgcaggaggtgtcgag

SEQ ID NO: 27028 - DNA, 20 bp, human
gtctggcctttagggctcta

SEQ ID NO: 27029 - DNA, 20 bp, human
gcgaggcatagggagatcgc

SEQ ID NO: 27030 - DNA, 20 bp, human
gaggcgctctcccgttccaa

SEQ ID NO: 27031 - DNA, 20 bp, human
ggcccggaaaggctaccgac

SEQ ID NO: 27032 - DNA, 20 bp, human
gcccagttaatggcccggaa

SEQ ID NO: 27033 - DNA, 20 bp, human
gccaagtgttcagccctcgg

SEQ ID NO: 27034 - DNA, 20 bp, human
gctaccgccgaggtcaccgg

SEQ ID NO: 27035 - DNA, 20 bp, human
gagtaaccctagagccctaa

SEQ ID NO: 27036 - DNA, 20 bp, human
gccacacggtccgccaaaaa

SEQ ID NO: 27037 - DNA, 20 bp, human
gaggggagcgagtctcggtg

SEQ ID NO: 27038 - DNA, 20 bp, human
gtgccccgactgcggcgagg

SEQ ID NO: 27039 - DNA, 20 bp, human
gtctcacctggacggataca

SEQ ID NO: 27040 - DNA, 20 bp, human
ggggccggatctcacctgga

SEQ ID NO: 27041 - DNA, 20 bp, human
gcagagaggggagcgagtct

SEQ ID NO: 27042 - DNA, 20 bp, human
gacgcggggtgggaatccgg

SEQ ID NO: 27043 - DNA, 20 bp, human
ggcggcctcgcggggaccca

SEQ ID NO: 27044 - DNA, 20 bp, human
gcccgcgaggccgccacccc

SEQ ID NO: 27045 - DNA, 20 bp, human
gaccgaaaggcggcgagaca

SEQ ID NO: 27046 - DNA, 20 bp, human
ggcaaatgtcttcgaggtcg

SEQ ID NO: 27047 - DNA, 20 bp, human
gaaagttagcctttgaagca

SEQ ID NO: 27048 - DNA, 20 bp, human
gatgtcttcgaggtcggggc

SEQ ID NO: 27049 - DNA, 20 bp, human
gtgggaatctaacgcagagg

SEQ ID NO: 27050 - DNA, 20 bp, human
gcgtcaaagccttgcttcaa

SEQ ID NO: 27051 - DNA, 20 bp, human
gcaaaatcccatgacaccag

SEQ ID NO: 27052 - DNA, 20 bp, human
gcacaaaatggcgtgacctc

SEQ ID NO: 27053 - DNA, 20 bp, human
gaaccatcccagtcacaaaa

SEQ ID NO: 27054 - DNA, 20 bp, human
gggatctgcggatgaggagg

SEQ ID NO: 27055 - DNA, 20 bp, human
ggttggatctgcggatgagg

SEQ ID NO: 27056 - DNA, 20 bp, human
ggtcggtgccagctgcgtga

SEQ ID NO: 27057 - DNA, 20 bp, human
gccacccgggccccgaagag

SEQ ID NO: 27058 - DNA, 20 bp, human
gacaggcttgaggcttggat

SEQ ID NO: 27059 - DNA, 20 bp, human
ggaagcaggacgctggaccc

SEQ ID NO: 27060 - DNA, 20 bp, human
ggggtgggccgagcacttgg

SEQ ID NO: 27061 - DNA, 20 bp, human
ggcaccgacgcctcagcgac

SEQ ID NO: 27062 - DNA, 20 bp, human
ggctgggcggctgcgggata

SEQ ID NO: 27063 - DNA, 20 bp, human
ggctgcgggatagggcggaa

SEQ ID NO: 27064 - DNA, 20 bp, human
gcggcgggagccctgcgtga

SEQ ID NO: 27065 - DNA, 20 bp, human
gcgaggcccatggtgccgtg

SEQ ID NO: 27066 - DNA, 20 bp, human
gggtccgggcgggtgactgg

SEQ ID NO: 27067 - DNA, 20 bp, human
gccgcgggcgtgtaaacaaa

SEQ ID NO: 27068 - DNA, 20 bp, human
gccgcccccctcagagccgg

SEQ ID NO: 27069 - DNA, 20 bp, human
gggcggtccgggcgggtgac

SEQ ID NO: 27070 - DNA, 20 bp, human
gcgcccagctctgcacccgc

SEQ ID NO: 27071 - DNA, 20 bp, human
gccccgcgccagaacctcct

SEQ ID NO: 27072 - DNA, 20 bp, human
ggtaaacaaagggcaacctc

SEQ ID NO: 27073 - DNA, 20 bp, human
gcagagccggaggagcccgc

SEQ ID NO: 27074 - DNA, 20 bp, human
ggcggcagccgaggaggttc

SEQ ID NO: 27075 - DNA, 20 bp, human
ggggctcctccggctctgag

SEQ ID NO: 27076 - DNA, 20 bp, human
gctccctcccccttcggatg

SEQ ID NO: 27077 - DNA, 20 bp, human
gcgcgggtctgcagcgtctc

SEQ ID NO: 27078 - DNA, 20 bp, human
gctcaagccacatccgaagg

SEQ ID NO: 27079 - DNA, 20 bp, human
gcttgagctgtaggcgcgga

SEQ ID NO: 27080 - DNA, 20 bp, human
gagctcggaggcggtgaagt

SEQ ID NO: 27081 - DNA, 20 bp, human
gtcggaggcggtgaagtcgg

SEQ ID NO: 27082 - DNA, 20 bp, human
ggagacttgggcctcccgga

SEQ ID NO: 27083 - DNA, 20 bp, human
ggactgctctgccctcgagg

SEQ ID NO: 27084 - DNA, 20 bp, human
gcagctccctaccccctcga

SEQ ID NO: 27085 - DNA, 20 bp, human
gcagcgccggtagttagtgg

SEQ ID NO: 27086 - DNA, 20 bp, human
gtggtcgcccaagtaagtcg

SEQ ID NO: 27087 - DNA, 20 bp, human
gagtatctggtgaaatggag

SEQ ID NO: 27088 - DNA, 20 bp, human
ggtgctgtctcttcccccca

SEQ ID NO: 27089 - DNA, 20 bp, human
gcctccgccgcgacttactt

SEQ ID NO: 27090 - DNA, 20 bp, human
gtcgcccaagtaagtcgcgg

SEQ ID NO: 27091 - DNA, 20 bp, human
ggaagcggatccgcaaggta

SEQ ID NO: 27092 - DNA, 20 bp, human
ggacaactgagcccgggccg

SEQ ID NO: 27093 - DNA, 20 bp, human
ggtctgagcgagcgcgagcc

SEQ ID NO: 27094 - DNA, 20 bp, human
gggagagcatcgagaagaag

SEQ ID NO: 27095 - DNA, 20 bp, human
ggatactccactctgccctg

SEQ ID NO: 27096 - DNA, 20 bp, human
ggcctcaccatacaggaaca

SEQ ID NO: 27097 - DNA, 20 bp, human
ggttggcgttgcgcagaagg

SEQ ID NO: 27098 - DNA, 20 bp, human
gccttgggccatcggaatgt

SEQ ID NO: 27099 - DNA, 20 bp, human
ggtgagacgctgctcagaag

SEQ ID NO: 27100 - DNA, 20 bp, human
gtaggttgggcttctccagg

SEQ ID NO: 27101 - DNA, 20 bp, human
gtggtgcggcctcaccatac

SEQ ID NO: 27102 - DNA, 20 bp, human
gccgcgcgcttcctgctcac

SEQ ID NO: 27103 - DNA, 20 bp, human
ggccctgttcctgtatggtg

SEQ ID NO: 27104 - DNA, 20 bp, human
gcgtctgccctgttcctgta

SEQ ID NO: 27105 - DNA, 20 bp, human
gcgcagggaaggatccgttt

SEQ ID NO: 27106 - DNA, 20 bp, human
gcgggcgcagggagtattat

SEQ ID NO: 27107 - DNA, 20 bp, human
gtcaggatgaagaccagaga

SEQ ID NO: 27108 - DNA, 20 bp, human
gcctgcgcccgcggccggtg

SEQ ID NO: 27109 - DNA, 20 bp, human
gtgagtgtcgcggggtccgg

SEQ ID NO: 27110 - DNA, 20 bp, human
gagggagtattatgggctgt

SEQ ID NO: 27111 - DNA, 20 bp, human
gctggtgaaatggaaggggt

SEQ ID NO: 27112 - DNA, 20 bp, human
gccgcgtgcctgtccctctc

SEQ ID NO: 27113 - DNA, 20 bp, human
gacagaggggagaaaaacgg

SEQ ID NO: 27114 - DNA, 20 bp, human
gatgcgtccctgaaaaacag

SEQ ID NO: 27115 - DNA, 20 bp, human
gggagaacatcctggactcg

SEQ ID NO: 27116 - DNA, 20 bp, human
gctgtcagccatcggcgagc

SEQ ID NO: 27117 - DNA, 20 bp, human
gttctactcgccctacacgg

SEQ ID NO: 27118 - DNA, 20 bp, human
gcgctccaggatgctagtgg

SEQ ID NO: 27119 - DNA, 20 bp, human
gtgtcgctccaggatgctag

SEQ ID NO: 27120 - DNA, 20 bp, human
ggacgggagggaccccactg

SEQ ID NO: 27121 - DNA, 20 bp, human
gcgcgtgcgcgcccggacga

SEQ ID NO: 27122 - DNA, 20 bp, human
ggctgcggcgcgcgatgctg

SEQ ID NO: 27123 - DNA, 20 bp, human
gtcggccgccactagcatcc

SEQ ID NO: 27124 - DNA, 20 bp, human
ggagattaggatcggacgta

SEQ ID NO: 27125 - DNA, 20 bp, human
gcgatcctaatctccagctc

SEQ ID NO: 27126 - DNA, 20 bp, human
gtgctcctggaagcggccaa

SEQ ID NO: 27127 - DNA, 20 bp, human
gggaggagaactgacgtcag

SEQ ID NO: 27128 - DNA, 20 bp, human
ggtcaacatggagctttcag

SEQ ID NO: 27129 - DNA, 20 bp, human
ggggaagcggcgagtcaaca

SEQ ID NO: 27130 - DNA, 20 bp, human
gcgtcagcgggagagtatta

SEQ ID NO: 27131 - DNA, 20 bp, human
ggactcgccgcttcccccct

SEQ ID NO: 27132 - DNA, 20 bp, human
gcgtatgcgccgcttcagga

SEQ ID NO: 27133 - DNA, 20 bp, human
gtgtgcagcattaggtgcag

SEQ ID NO: 27134 - DNA, 20 bp, human
ggtgcatcgctgcaagtcta

SEQ ID NO: 27135 - DNA, 20 bp, human
gacggaggccctaggcccgg

SEQ ID NO: 27136 - DNA, 20 bp, human
gggtgggtcaaggtaactct

SEQ ID NO: 27137 - DNA, 20 bp, human
gtgtcccccaaggagttcag

SEQ ID NO: 27138 - DNA, 20 bp, human
gcaaccgcggagacacacag

SEQ ID NO: 27139 - DNA, 20 bp, human
ggctacagagtccttgctgg

SEQ ID NO: 27140 - DNA, 20 bp, human
ggctccccgaacccccagca

SEQ ID NO: 27141 - DNA, 20 bp, human
gctacctctgaactccttgg

SEQ ID NO: 27142 - DNA, 20 bp, human
gcgcggagacacacagagga

SEQ ID NO: 27143 - DNA, 20 bp, human
gtgacgcgtcccagaagccg

SEQ ID NO: 27144 - DNA, 20 bp, human
ggccgtgcatctgcgtaaca

SEQ ID NO: 27145 - DNA, 20 bp, human
gacggaggccgggcgacccc

SEQ ID NO: 27146 - DNA, 20 bp, human
gagctgagtgggtcagagat

SEQ ID NO: 27147 - DNA, 20 bp, human
gcatagggctcaaagtatca

SEQ ID NO: 27148 - DNA, 20 bp, human
gttctcttctcactgcccat

SEQ ID NO: 27149 - DNA, 20 bp, human
gtgggctagacctatgcata

SEQ ID NO: 27150 - DNA, 20 bp, human
gctcacatataggtggacag

SEQ ID NO: 27151 - DNA, 20 bp, human
gtgagattgtatcttctcgg

SEQ ID NO: 27152 - DNA, 20 bp, human
gatcagcacttactgggcag

SEQ ID NO: 27153 - DNA, 20 bp, human
gcctgagggcacagtttgtt

SEQ ID NO: 27154 - DNA, 20 bp, human
ggtgtattatgaattaacga

SEQ ID NO: 27155 - DNA, 20 bp, human
gcttatccctcacatatagg

SEQ ID NO: 27156 - DNA, 20 bp, human
gcgaggcccgaggcggaagt

SEQ ID NO: 27157 - DNA, 20 bp, human
ggcccgaggcggaagtggga

SEQ ID NO: 27158 - DNA, 20 bp, human
gaggccagtaggccacactt

SEQ ID NO: 27159 - DNA, 20 bp, human
ggaagtgggacggccaagca

SEQ ID NO: 27160 - DNA, 20 bp, human
gtgttggagcctcacctggg

SEQ ID NO: 27161 - DNA, 20 bp, human
gccagtaggccacacttggg

SEQ ID NO: 27162 - DNA, 20 bp, human
ggagcccagtggccgcgctc

SEQ ID NO: 27163 - DNA, 20 bp, human
gagctgctccagtcgaggag

SEQ ID NO: 27164 - DNA, 20 bp, human
gtacctgtggggcggagatc

SEQ ID NO: 27165 - DNA, 20 bp, human
ggccgtcccacttccgcctc

SEQ ID NO: 27166 - DNA, 20 bp, human
gggcggtgccgggtgagaca

SEQ ID NO: 27167 - DNA, 20 bp, human
gcgacaggaagcgccagcag

SEQ ID NO: 27168 - DNA, 20 bp, human
ggccaggcctcacggaaggt

SEQ ID NO: 27169 - DNA, 20 bp, human
gtgggcaacggagtccgtag

SEQ ID NO: 27170 - DNA, 20 bp, human
gaccccggccttgtctcacc

SEQ ID NO: 27171 - DNA, 20 bp, human
gagcgaggccagacactcca

SEQ ID NO: 27172 - DNA, 20 bp, human
ggggccgcagcggtagcgac

SEQ ID NO: 27173 - DNA, 20 bp, human
gtctcacccggcaccgccct

SEQ ID NO: 27174 - DNA, 20 bp, human
ggtgaatccgagccaaaccc

SEQ ID NO: 27175 - DNA, 20 bp, human
gagcgcctcgggctgagtga

SEQ ID NO: 27176 - DNA, 20 bp, human
ggaggggaactcctgcggag

SEQ ID NO: 27177 - DNA, 20 bp, human
gggaactcctgcggagaggt

SEQ ID NO: 27178 - DNA, 20 bp, human
gcctaggaggggaactcctg

SEQ ID NO: 27179 - DNA, 20 bp, human
gaggtactgcctggccacgt

SEQ ID NO: 27180 - DNA, 20 bp, human
gggctgcagactgaccccac

SEQ ID NO: 27181 - DNA, 20 bp, human
ggccagcaggctcgggagaa

SEQ ID NO: 27182 - DNA, 20 bp, human
gacactcctcggggcaatct

SEQ ID NO: 27183 - DNA, 20 bp, human
gacctggaccctcccttgaa

SEQ ID NO: 27184 - DNA, 20 bp, human
gagttgtcctctgagaaggg

SEQ ID NO: 27185 - DNA, 20 bp, human
ggccagagagctagcccacg

SEQ ID NO: 27186 - DNA, 20 bp, human
ggttagccgggacccgactc

SEQ ID NO: 27187 - DNA, 20 bp, human
ggctcttgtgggactgggac

SEQ ID NO: 27188 - DNA, 20 bp, human
gacatcgtggcggctcccgg

SEQ ID NO: 27189 - DNA, 20 bp, human
gcgggacccgactcaggtga

SEQ ID NO: 27190 - DNA, 20 bp, human
gcccccggcccgggacatcg

SEQ ID NO: 27191 - DNA, 20 bp, human
gcgtgggtcttggggaatag

SEQ ID NO: 27192 - DNA, 20 bp, human
gcgcatgcgcctaaagctga

SEQ ID NO: 27193 - DNA, 20 bp, human
ggggcacctgaggagccgag

SEQ ID NO: 27194 - DNA, 20 bp, human
ggcccactgctccaactacg

SEQ ID NO: 27195 - DNA, 20 bp, human
gggagccatcgagtgtcgtg

SEQ ID NO: 27196 - DNA, 20 bp, human
gccagggcagcgacaccggg

SEQ ID NO: 27197 - DNA, 20 bp, human
ggccgcggcgaggccaccaa

SEQ ID NO: 27198 - DNA, 20 bp, human
gcctcgaccggctggtggga

SEQ ID NO: 27199 - DNA, 20 bp, human
gcagccggtcgaggaaacaa

SEQ ID NO: 27200 - DNA, 20 bp, human
gactgtgtgggccctctccc

SEQ ID NO: 27201 - DNA, 20 bp, human
gggccaccaagggaggactg

SEQ ID NO: 27202 - DNA, 20 bp, human
gagtggtcgcgcttccggag

SEQ ID NO: 27203 - DNA, 20 bp, human
gggacttgcagtccaaagag

SEQ ID NO: 27204 - DNA, 20 bp, human
gcggaagcgcgaccactggt

SEQ ID NO: 27205 - DNA, 20 bp, human
gccggggggacaaagacacc

SEQ ID NO: 27206 - DNA, 20 bp, human
gggaggcggcggcaccatca

SEQ ID NO: 27207 - DNA, 20 bp, human
ggcaccatcagggaagctcc

SEQ ID NO: 27208 - DNA, 20 bp, human
gagccagtgtggcacccggg

SEQ ID NO: 27209 - DNA, 20 bp, human
gtcggcgctgggaagaagcc

SEQ ID NO: 27210 - DNA, 20 bp, human
gccctgacgcgacccacgga

SEQ ID NO: 27211 - DNA, 20 bp, human
gaggagcaggacgcttggtc

SEQ ID NO: 27212 - DNA, 20 bp, human
ggcaggacgcttggtccgga

SEQ ID NO: 27213 - DNA, 20 bp, human
gcagctcctccccggctcgg

SEQ ID NO: 27214 - DNA, 20 bp, human
gaggagctcgccctccgctg

SEQ ID NO: 27215 - DNA, 20 bp, human
gaagccgggagcttccctga

SEQ ID NO: 27216 - DNA, 20 bp, human
ggttcccaagtacaccccgt

SEQ ID NO: 27217 - DNA, 20 bp, human
gagggactgctgcaacctac

SEQ ID NO: 27218 - DNA, 20 bp, human
ggggtgtacttgggaacgag

SEQ ID NO: 27219 - DNA, 20 bp, human
ggggtgaagcggcccaggtg

SEQ ID NO: 27220 - DNA, 20 bp, human
gttgggaacgaggggtgaag

SEQ ID NO: 27221 - DNA, 20 bp, human
gggaatttgcgaggacccag

SEQ ID NO: 27222 - DNA, 20 bp, human
gcaacctacggggtgtactt

SEQ ID NO: 27223 - DNA, 20 bp, human
gtgagggtgagtagctgtgt

SEQ ID NO: 27224 - DNA, 20 bp, human
gccggtactgttatcagcca

SEQ ID NO: 27225 - DNA, 20 bp, human
gcgggctcggcccccttaaa

SEQ ID NO: 27226 - DNA, 20 bp, human
gtcgggactcgagcctaggg

SEQ ID NO: 27227 - DNA, 20 bp, human
gccgcaccggataggtgagt

SEQ ID NO: 27228 - DNA, 20 bp, human
gcgaggttcccgcaccggat

SEQ ID NO: 27229 - DNA, 20 bp, human
gactcgagcctagggaggcg

SEQ ID NO: 27230 - DNA, 20 bp, human
gcagtcgggactcgagccta

SEQ ID NO: 27231 - DNA, 20 bp, human
gggaggcgaggttcccgcac

SEQ ID NO: 27232 - DNA, 20 bp, human
gcccgccccactcacctatc

SEQ ID NO: 27233 - DNA, 20 bp, human
ggcgggaacctcgcctccct

SEQ ID NO: 27234 - DNA, 20 bp, human
gcgggccctcaagcccagtc

SEQ ID NO: 27235 - DNA, 20 bp, human
gcttccgtgcggactgacta

SEQ ID NO: 27236 - DNA, 20 bp, human
ggagacctccggcgaaacgc

SEQ ID NO: 27237 - DNA, 20 bp, human
gggcgaaacgcgggagcgaa

SEQ ID NO: 27238 - DNA, 20 bp, human
gacctgcgttcgaagattgg

SEQ ID NO: 27239 - DNA, 20 bp, human
ggcgcgactacgctcataaa

SEQ ID NO: 27240 - DNA, 20 bp, human
gcgcaagcgcagacctcgag

SEQ ID NO: 27241 - DNA, 20 bp, human
gcgacacgctgggctcggca

SEQ ID NO: 27242 - DNA, 20 bp, human
gcccctagagcgccgcctca

SEQ ID NO: 27243 - DNA, 20 bp, human
ggtgcttccatccccggcga

SEQ ID NO: 27244 - DNA, 20 bp, human
gggctggaaactgcgacgag

SEQ ID NO: 27245 - DNA, 20 bp, human
gacggacgcagcttccaggt

SEQ ID NO: 27246 - DNA, 20 bp, human
gtggcgaatgcgggatggac

SEQ ID NO: 27247 - DNA, 20 bp, human
gcgaatgcgggatggacggg

SEQ ID NO: 27248 - DNA, 20 bp, human
gcgaccacgttgggtccccc

SEQ ID NO: 27249 - DNA, 20 bp, human
gccgctctaccccgccgcag

SEQ ID NO: 27250 - DNA, 20 bp, human
ggtcgccgcggctctgggca

SEQ ID NO: 27251 - DNA, 20 bp, human
gcctccccaccggagacctg

SEQ ID NO: 27252 - DNA, 20 bp, human
ggaatttgggactctcccgg

SEQ ID NO: 27253 - DNA, 20 bp, human
gagagcgggccgtaccccaa

SEQ ID NO: 27254 - DNA, 20 bp, human
ggaaccccaggtctccggtg

SEQ ID NO: 27255 - DNA, 20 bp, human
gcagggcgccgtgctctgat

SEQ ID NO: 27256 - DNA, 20 bp, human
gcctccacgcccaggagcgt

SEQ ID NO: 27257 - DNA, 20 bp, human
ggcgtgggaaccctgcttaa

SEQ ID NO: 27258 - DNA, 20 bp, human
gctgcttaagggctttacta

SEQ ID NO: 27259 - DNA, 20 bp, human
ggcagggttcccacgctcct

SEQ ID NO: 27260 - DNA, 20 bp, human
ggggggcaccgagagcgcaa

SEQ ID NO: 27261 - DNA, 20 bp, human
gaaacggtgctggttcactg

SEQ ID NO: 27262 - DNA, 20 bp, human
ggttatgctgagggtgaggt

SEQ ID NO: 27263 - DNA, 20 bp, human
gagggctttactagggaaaa

SEQ ID NO: 27264 - DNA, 20 bp, human
ggaggcgcgcattaagactg

SEQ ID NO: 27265 - DNA, 20 bp, human
ggcacttgcaggttgaatac

SEQ ID NO: 27266 - DNA, 20 bp, human
gctgataaaccagaacagga

SEQ ID NO: 27267 - DNA, 20 bp, human
ggaatctgaacgccaagaag

SEQ ID NO: 27268 - DNA, 20 bp, human
ggccaccctaccccaacgta

SEQ ID NO: 27269 - DNA, 20 bp, human
ggcagagagattctctacgt

SEQ ID NO: 27270 - DNA, 20 bp, human
gtcccctgataaaccagaac

SEQ ID NO: 27271 - DNA, 20 bp, human
gaccaaggccgggactgctg

SEQ ID NO: 27272 - DNA, 20 bp, human
gggtccgggaggctgagtaa

SEQ ID NO: 27273 - DNA, 20 bp, human
gactgctggggtgaaggtcc

SEQ ID NO: 27274 - DNA, 20 bp, human
gtctacgtgggttctagtcg

SEQ ID NO: 27275 - DNA, 20 bp, human
ggctgagtaaggggacggaa

SEQ ID NO: 27276 - DNA, 20 bp, human
gggtctgcgaaggaacacat

SEQ ID NO: 27277 - DNA, 20 bp, human
ggaacgagaccttgcgacag

SEQ ID NO: 27278 - DNA, 20 bp, human
gaaggagccgagagggagta

SEQ ID NO: 27279 - DNA, 20 bp, human
ggggccacaaggagccgaga

SEQ ID NO: 27280 - DNA, 20 bp, human
gtaatgcaaaatggtcgcta

SEQ ID NO: 27281 - DNA, 20 bp, human
gttggtagcttctatcctgg

SEQ ID NO: 27282 - DNA, 20 bp, human
gtccgggccgcggtctaggg

SEQ ID NO: 27283 - DNA, 20 bp, human
gcgagaccttgcgacagggg

SEQ ID NO: 27284 - DNA, 20 bp, human
gctgatgacgcgggtggaga

SEQ ID NO: 27285 - DNA, 20 bp, human
gctaaacctgatgacgcggg

SEQ ID NO: 27286 - DNA, 20 bp, human
gagggcgtcacgctgtggaa

SEQ ID NO: 27287 - DNA, 20 bp, human
gaaccctaggcggagcggaa

SEQ ID NO: 27288 - DNA, 20 bp, human
gcctggccgggaaccctagg

SEQ ID NO: 27289 - DNA, 20 bp, human
gtccgcgtggagatgatcaa

SEQ ID NO: 27290 - DNA, 20 bp, human
gccgggaaccctaggcggag

SEQ ID NO: 27291 - DNA, 20 bp, human
gaggcgagggcgtcacgctg

SEQ ID NO: 27292 - DNA, 20 bp, human
ggccctgcagaccaccgagg

SEQ ID NO: 27293 - DNA, 20 bp, human
gtgcgcgtgcaccacctcgg

SEQ ID NO: 27294 - DNA, 20 bp, human
gctttgcggtgcaagggtag

SEQ ID NO: 27295 - DNA, 20 bp, human
gggcaggcgggcgtaccagg

SEQ ID NO: 27296 - DNA, 20 bp, human
gactgccaggcctaaggaag

SEQ ID NO: 27297 - DNA, 20 bp, human
gaatccggctcggggaccga

SEQ ID NO: 27298 - DNA, 20 bp, human
gccggattccgcgagcgggt

SEQ ID NO: 27299 - DNA, 20 bp, human
gggggccccgaaggtagagg

SEQ ID NO: 27300 - DNA, 20 bp, human
gagggacacctagcctgaag

SEQ ID NO: 27301 - DNA, 20 bp, human
gcgggtgcccggggtccgag

SEQ ID NO: 27302 - DNA, 20 bp, human
ggcgctcacccacccgctcg

SEQ ID NO: 27303 - DNA, 20 bp, human
gcgctcgcggaatccggctc

SEQ ID NO: 27304 - DNA, 20 bp, human
gccaggcctaaggaagaggc

SEQ ID NO: 27305 - DNA, 20 bp, human
gagtggcccgcgatgagaga

SEQ ID NO: 27306 - DNA, 20 bp, human
gccggaggtcgggattggcg

SEQ ID NO: 27307 - DNA, 20 bp, human
ggcccgatccctccacccgt

SEQ ID NO: 27308 - DNA, 20 bp, human
ggggcggtgccgaagcggtc

SEQ ID NO: 27309 - DNA, 20 bp, human
gcacacccaggtaccagcta

SEQ ID NO: 27310 - DNA, 20 bp, human
gtccacccgtgggccggcaa

SEQ ID NO: 27311 - DNA, 20 bp, human
gggccaatgccggaccgctt

SEQ ID NO: 27312 - DNA, 20 bp, human
gacccgtgggccggcaatgg

SEQ ID NO: 27313 - DNA, 20 bp, human
gcccgccattgccggcccac

SEQ ID NO: 27314 - DNA, 20 bp, human
gctgggggcgctgtacaccg

SEQ ID NO: 27315 - DNA, 20 bp, human
ggtggctccagagccggggt

SEQ ID NO: 27316 - DNA, 20 bp, human
gtatggagacggcaatatgg

SEQ ID NO: 27317 - DNA, 20 bp, human
gcctgagaccctgggacctt

SEQ ID NO: 27318 - DNA, 20 bp, human
gcctgcgcgtcctgtatcta

SEQ ID NO: 27319 - DNA, 20 bp, human
gcagtcgttgtgaagagact

SEQ ID NO: 27320 - DNA, 20 bp, human
gatctatggagacggcaata

SEQ ID NO: 27321 - DNA, 20 bp, human
gcgccgctccctgagaccct

SEQ ID NO: 27322 - DNA, 20 bp, human
gggcgagatcaatcagacta

SEQ ID NO: 27323 - DNA, 20 bp, human
ggttctgagcgttagtccca

SEQ ID NO: 27324 - DNA, 20 bp, human
gttgccgtctccatagatac

SEQ ID NO: 27325 - DNA, 20 bp, human
gggtcgtcgtatagagtcga

SEQ ID NO: 27326 - DNA, 20 bp, human
gcctcacccgggccgagata

SEQ ID NO: 27327 - DNA, 20 bp, human
ggagccaccaggcgctgacg

SEQ ID NO: 27328 - DNA, 20 bp, human
ggctcctcgtcagcgcctgg

SEQ ID NO: 27329 - DNA, 20 bp, human
gcggcacccgctcttacctg

SEQ ID NO: 27330 - DNA, 20 bp, human
ggggagcagcagaataacct

SEQ ID NO: 27331 - DNA, 20 bp, human
gcccgggccgagatagggtg

SEQ ID NO: 27332 - DNA, 20 bp, human
ggccagagcgctgcggctgg

SEQ ID NO: 27333 - DNA, 20 bp, human
gtggtccccgcaccctatct

SEQ ID NO: 27334 - DNA, 20 bp, human
ggatgcgccgctgacgcctg

SEQ ID NO: 27335 - DNA, 20 bp, human
ggggcggtcccgacaggtgg

SEQ ID NO: 27336 - DNA, 20 bp, human
gccccaaccgtggcgacctg

SEQ ID NO: 27337 - DNA, 20 bp, human
gaatcccgcgaggcgcacca

SEQ ID NO: 27338 - DNA, 20 bp, human
gcccgcaggtcgccacggtt

SEQ ID NO: 27339 - DNA, 20 bp, human
ggtgcgcctcgcgggattag

SEQ ID NO: 27340 - DNA, 20 bp, human
ggctgtaaggatgaaaacag

SEQ ID NO: 27341 - DNA, 20 bp, human
gcctcgagaaggccccgggt

SEQ ID NO: 27342 - DNA, 20 bp, human
gattaggggccggtagaggt

SEQ ID NO: 27343 - DNA, 20 bp, human
ggccacggttgggggaaacg

SEQ ID NO: 27344 - DNA, 20 bp, human
gtggagaaagctgtagggtc

SEQ ID NO: 27345 - DNA, 20 bp, human
gacggttgggggaaacgcgg

SEQ ID NO: 27346 - DNA, 20 bp, human
ggcgacagaacagccccgga

SEQ ID NO: 27347 - DNA, 20 bp, human
gtctgtaacagaaccgtccg

SEQ ID NO: 27348 - DNA, 20 bp, human
ggggccgagcgggagatgtg

SEQ ID NO: 27349 - DNA, 20 bp, human
gtcacacaggcagcgaggaa

SEQ ID NO: 27350 - DNA, 20 bp, human
ggccagcctgtaagccacag

SEQ ID NO: 27351 - DNA, 20 bp, human
ggatgagcccgggtaagagt

SEQ ID NO: 27352 - DNA, 20 bp, human
ggactgggcgggacctgtgg

SEQ ID NO: 27353 - DNA, 20 bp, human
gtccgcaagcggccacccga

SEQ ID NO: 27354 - DNA, 20 bp, human
gcatctcccgctcggcccta

SEQ ID NO: 27355 - DNA, 20 bp, human
gtgcggcgagtgcagaaggg

SEQ ID NO: 27356 - DNA, 20 bp, human
gcgactccgaaaccacatgg

SEQ ID NO: 27357 - DNA, 20 bp, human
ggcgcctgccacgaatcccc

SEQ ID NO: 27358 - DNA, 20 bp, human
gtcggagtcgaggaagacct

SEQ ID NO: 27359 - DNA, 20 bp, human
gagtcgaggaagacctgggt

SEQ ID NO: 27360 - DNA, 20 bp, human
gattcgtggcaggcgcaccc

SEQ ID NO: 27361 - DNA, 20 bp, human
gagggcggggccgagatgta

SEQ ID NO: 27362 - DNA, 20 bp, human
gttatcacgcggctaggaag

SEQ ID NO: 27363 - DNA, 20 bp, human
gggagaaccgagagctgctc

SEQ ID NO: 27364 - DNA, 20 bp, human
gcctcgactccgaaaccaca

SEQ ID NO: 27365 - DNA, 20 bp, human
gcggccaagcccgcagcgca

SEQ ID NO: 27366 - DNA, 20 bp, human
ggccggcacccggagctcct

SEQ ID NO: 27367 - DNA, 20 bp, human
ggctcctgggcacacggcat

SEQ ID NO: 27368 - DNA, 20 bp, human
ggagctagaacggggtggta

SEQ ID NO: 27369 - DNA, 20 bp, human
ggcattggcaggggccgctt

SEQ ID NO: 27370 - DNA, 20 bp, human
gcccttcatgggagtcggag

SEQ ID NO: 27371 - DNA, 20 bp, human
ggggcacacggcattggcag

SEQ ID NO: 27372 - DNA, 20 bp, human
gccggtggtgagaagcccag

SEQ ID NO: 27373 - DNA, 20 bp, human
gtccagctccgacccttcat

SEQ ID NO: 27374 - DNA, 20 bp, human
gtcgcagccggagtgacgcg

SEQ ID NO: 27375 - DNA, 20 bp, human
ggcccgcacagctggataac

SEQ ID NO: 27376 - DNA, 20 bp, human
gacctgtgaggagagtgagt

SEQ ID NO: 27377 - DNA, 20 bp, human
ggcgctcaacacagcctcag

SEQ ID NO: 27378 - DNA, 20 bp, human
gtcgcagacagcgagcggag

SEQ ID NO: 27379 - DNA, 20 bp, human
gcggacaccagtacaggacg

SEQ ID NO: 27380 - DNA, 20 bp, human
gggattcataggaaggaagg

SEQ ID NO: 27381 - DNA, 20 bp, human
ggtcgaagccgggagttgcg

SEQ ID NO: 27382 - DNA, 20 bp, human
gggggcacggacaccagtac

SEQ ID NO: 27383 - DNA, 20 bp, human
gcttgcgtagtgaaccgctg

SEQ ID NO: 27384 - DNA, 20 bp, human
gtgagtgggaagaacttcga

SEQ ID NO: 27385 - DNA, 20 bp, human
gcgttaaattaaggattcat

SEQ ID NO: 27386 - DNA, 20 bp, human
gtcaggcccgtcggcaggta

SEQ ID NO: 27387 - DNA, 20 bp, human
gggagcaccaagaacaggtc

SEQ ID NO: 27388 - DNA, 20 bp, human
gctgggccctacctgccgac

SEQ ID NO: 27389 - DNA, 20 bp, human
ggcagggtcgggggagtcct

SEQ ID NO: 27390 - DNA, 20 bp, human
gacagggtggggctcctgta

SEQ ID NO: 27391 - DNA, 20 bp, human
gaacttggagcaccaagaac

SEQ ID NO: 27392 - DNA, 20 bp, human
gtccctgccaagcgtcccaa

SEQ ID NO: 27393 - DNA, 20 bp, human
gacaggtcaggcccgtcggc

SEQ ID NO: 27394 - DNA, 20 bp, human
gccccggcctgctgtagtgg

SEQ ID NO: 27395 - DNA, 20 bp, human
gcagaccacaacactgaact

SEQ ID NO: 27396 - DNA, 20 bp, human
ggcggcgcttgacctgcgag

SEQ ID NO: 27397 - DNA, 20 bp, human
gagatctggaggtgtgtcca

SEQ ID NO: 27398 - DNA, 20 bp, human
gcaaactgcggagggtgaca

SEQ ID NO: 27399 - DNA, 20 bp, human
gcgctgaaggacgagaaggg

SEQ ID NO: 27400 - DNA, 20 bp, human
gtggctgtcctgccaaactg

SEQ ID NO: 27401 - DNA, 20 bp, human
ggagggactccagaagttca

SEQ ID NO: 27402 - DNA, 20 bp, human
ggcctcgctgaaggacgaga

SEQ ID NO: 27403 - DNA, 20 bp, human
gaagaaggtggctccagatc

SEQ ID NO: 27404 - DNA, 20 bp, human
gcgcaggtcaagcgccgcca

SEQ ID NO: 27405 - DNA, 20 bp, human
ggacgaggatggagaagcct

SEQ ID NO: 27406 - DNA, 20 bp, human
ggtgagggcgcagactgtac

SEQ ID NO: 27407 - DNA, 20 bp, human
gtggcctgtgcggagcaagg

SEQ ID NO: 27408 - DNA, 20 bp, human
gggccaggtaacccgagtgg

SEQ ID NO: 27409 - DNA, 20 bp, human
gatcggccaggtaacccgag

SEQ ID NO: 27410 - DNA, 20 bp, human
gcagactgtactggcctgtg

SEQ ID NO: 27411 - DNA, 20 bp, human
ggagtggctggcctcgtcat

SEQ ID NO: 27412 - DNA, 20 bp, human
gctgtgcagctgctccagtg

SEQ ID NO: 27413 - DNA, 20 bp, human
gtactggcctgtgcggagca

SEQ ID NO: 27414 - DNA, 20 bp, human
gccgtgcactgcacatggag

SEQ ID NO: 27415 - DNA, 20 bp, human
gctgcacagtgcgaggaagt

SEQ ID NO: 27416 - DNA, 20 bp, human
gtgaggtggagggttctaga

SEQ ID NO: 27417 - DNA, 20 bp, human
gcatagccggcgagacgagg

SEQ ID NO: 27418 - DNA, 20 bp, human
gttctagaaggcgtgacgtg

SEQ ID NO: 27419 - DNA, 20 bp, human
gcgtgacgtggggtcgagag

SEQ ID NO: 27420 - DNA, 20 bp, human
gtccacctcaggccgctcgg

SEQ ID NO: 27421 - DNA, 20 bp, human
gggagggagtcaaaaagccc

SEQ ID NO: 27422 - DNA, 20 bp, human
gcgagccgccgctcagaggg

SEQ ID NO: 27423 - DNA, 20 bp, human
gatcccggcatgcccccgag

SEQ ID NO: 27424 - DNA, 20 bp, human
gcgctcggccggcccttcag

SEQ ID NO: 27425 - DNA, 20 bp, human
gctgggctgcgaagctcccg

SEQ ID NO: 27426 - DNA, 20 bp, human
gaggcaactacggctggtgt

SEQ ID NO: 27427 - DNA, 20 bp, human
gggcgttgcggcgaaaggaa

SEQ ID NO: 27428 - DNA, 20 bp, human
gcagctaggccatagaggaa

SEQ ID NO: 27429 - DNA, 20 bp, human
ggctagaggaagaggcgttg

SEQ ID NO: 27430 - DNA, 20 bp, human
gttgctcgtgtaggtatcta

SEQ ID NO: 27431 - DNA, 20 bp, human
gaagaccagctaggccatag

SEQ ID NO: 27432 - DNA, 20 bp, human
gagatggaggcaactacggc

SEQ ID NO: 27433 - DNA, 20 bp, human
ggaacggctgaaggccctac

SEQ ID NO: 27434 - DNA, 20 bp, human
ggctggtgtgggccggctag

SEQ ID NO: 27435 - DNA, 20 bp, human
gtcgcgcttgaggagagcaa

SEQ ID NO: 27436 - DNA, 20 bp, human
gcagggcaggtatggagcat

SEQ ID NO: 27437 - DNA, 20 bp, human
gtcacctcgcagggcaggta

SEQ ID NO: 27438 - DNA, 20 bp, human
ggcaggtatggagcataggc

SEQ ID NO: 27439 - DNA, 20 bp, human
gggctgcccactgtctgctc

SEQ ID NO: 27440 - DNA, 20 bp, human
ggtccgaggaaggaggacta

SEQ ID NO: 27441 - DNA, 20 bp, human
gggggcgaggggacccaatg

SEQ ID NO: 27442 - DNA, 20 bp, human
ggtatggagcataggctggc

SEQ ID NO: 27443 - DNA, 20 bp, human
ggtgcatgggcaggtaaagg

SEQ ID NO: 27444 - DNA, 20 bp, human
ggggcaggctctaggtgcat

SEQ ID NO: 27445 - DNA, 20 bp, human
gggaaaacaggagccttctc

SEQ ID NO: 27446 - DNA, 20 bp, human
gccagggtgcgagggggata

SEQ ID NO: 27447 - DNA, 20 bp, human
gccctggctccggctggtag

SEQ ID NO: 27448 - DNA, 20 bp, human
gggacagaggctactcctgg

SEQ ID NO: 27449 - DNA, 20 bp, human
ggctaccccacagcactctc

SEQ ID NO: 27450 - DNA, 20 bp, human
gagttgtctcgaccaggccc

SEQ ID NO: 27451 - DNA, 20 bp, human
gaggaaaggaagcagggata

SEQ ID NO: 27452 - DNA, 20 bp, human
gggtagagagctaggtctgt

SEQ ID NO: 27453 - DNA, 20 bp, human
gctccaagaaagaccagact

SEQ ID NO: 27454 - DNA, 20 bp, human
ggctgactgccactaccagc

SEQ ID NO: 27455 - DNA, 20 bp, human
ggacctagctctctaccgaa

SEQ ID NO: 27456 - DNA, 20 bp, human
gccctctaggctaggctgag

SEQ ID NO: 27457 - DNA, 20 bp, human
ggtcaggtcgtaaggggtca

SEQ ID NO: 27458 - DNA, 20 bp, human
gacagacccgagttagaggt

SEQ ID NO: 27459 - DNA, 20 bp, human
ggcggacagacccgagttag

SEQ ID NO: 27460 - DNA, 20 bp, human
ggctgaggccacggggtcag

SEQ ID NO: 27461 - DNA, 20 bp, human
gccgcccccacctctaactc

SEQ ID NO: 27462 - DNA, 20 bp, human
ggatgtagtcaggtcgtaag

SEQ ID NO: 27463 - DNA, 20 bp, human
gcagcctagcctagagggtg

SEQ ID NO: 27464 - DNA, 20 bp, human
ggacgagcagggcgcagtga

SEQ ID NO: 27465 - DNA, 20 bp, human
ggccacggggtcagaggtcg

SEQ ID NO: 27466 - DNA, 20 bp, human
gctcctttctgacgctgtgg

SEQ ID NO: 27467 - DNA, 20 bp, human
gggaagtttctctacccatg

SEQ ID NO: 27468 - DNA, 20 bp, human
ggtgcaagtaggtactggag

SEQ ID NO: 27469 - DNA, 20 bp, human
gtccaggtgcaagtaggtac

SEQ ID NO: 27470 - DNA, 20 bp, human
gaaccaccacagcgtcagaa

SEQ ID NO: 27471 - DNA, 20 bp, human
ggaaacttccgcaatgttct

SEQ ID NO: 27472 - DNA, 20 bp, human
gccgctcctttctgacgctg

SEQ ID NO: 27473 - DNA, 20 bp, human
gttggattccaggtgcaagt

SEQ ID NO: 27474 - DNA, 20 bp, human
gtgggagggcttttgtctcc

SEQ ID NO: 27475 - DNA, 20 bp, human
ggcttttgtctcccggagga

SEQ ID NO: 27476 - DNA, 20 bp, human
gggccccttgaggagggata

SEQ ID NO: 27477 - DNA, 20 bp, human
gatcaggcggggaatctgtg

SEQ ID NO: 27478 - DNA, 20 bp, human
gcggcgaggtaggtgaggtg

SEQ ID NO: 27479 - DNA, 20 bp, human
gcccagacccggaactgctg

SEQ ID NO: 27480 - DNA, 20 bp, human
ggtcgcgaggaggcagctag

SEQ ID NO: 27481 - DNA, 20 bp, human
ggatcccaggggaaacctga

SEQ ID NO: 27482 - DNA, 20 bp, human
gatcctgggacggtatcagg

SEQ ID NO: 27483 - DNA, 20 bp, human
gcagctggcacgagggaacc

SEQ ID NO: 27484 - DNA, 20 bp, human
gtccggaaagggtcgcgagg

SEQ ID NO: 27485 - DNA, 20 bp, human
gcgggttagcgggcaggagt

SEQ ID NO: 27486 - DNA, 20 bp, human
gaagaaggtaggagcgtctg

SEQ ID NO: 27487 - DNA, 20 bp, human
ggcctctgctccccgaaccc

SEQ ID NO: 27488 - DNA, 20 bp, human
gaggccccatgatgacgtca

SEQ ID NO: 27489 - DNA, 20 bp, human
gacgtcacggaggcgcgacc

SEQ ID NO: 27490 - DNA, 20 bp, human
gccccatgatgacgtcacgg

SEQ ID NO: 27491 - DNA, 20 bp, human
gacccgggttcggggagcag

SEQ ID NO: 27492 - DNA, 20 bp, human
ggaagcgaatcaagacccat

SEQ ID NO: 27493 - DNA, 20 bp, human
gcacggaggcgcgaccgggc

SEQ ID NO: 27494 - DNA, 20 bp, human
gtaagaccccacggatgtga

SEQ ID NO: 27495 - DNA, 20 bp, human
gctggccccggactgcccct

SEQ ID NO: 27496 - DNA, 20 bp, human
ggcagcggcccgggcacgta

SEQ ID NO: 27497 - DNA, 20 bp, human
gggagctggaggatgcctac

SEQ ID NO: 27498 - DNA, 20 bp, human
gctggaggatgcctactgga

SEQ ID NO: 27499 - DNA, 20 bp, human
gttgtcgtcgtccttccagt

SEQ ID NO: 27500 - DNA, 20 bp, human
ggcccgggcacgtagggcag

SEQ ID NO: 27501 - DNA, 20 bp, human
gttctgcttcttggcatcag

SEQ ID NO: 27502 - DNA, 20 bp, human
ggacagcgcctggtccctcc

SEQ ID NO: 27503 - DNA, 20 bp, human
gaccaagtcggcagcggccc

SEQ ID NO: 27504 - DNA, 20 bp, human
ggcctctgccctacgtgccc

SEQ ID NO: 27505 - DNA, 20 bp, human
ggacaaacacgtcatgagga

SEQ ID NO: 27506 - DNA, 20 bp, human
ggcgcacgcgcacggagagg

SEQ ID NO: 27507 - DNA, 20 bp, human
gcaggtgagcgagctgagtg

SEQ ID NO: 27508 - DNA, 20 bp, human
ggcggcgcacgcgcacggag

SEQ ID NO: 27509 - DNA, 20 bp, human
gcgagctgagtggggcgccg

SEQ ID NO: 27510 - DNA, 20 bp, human
gggagaggaggctacttgcc

SEQ ID NO: 27511 - DNA, 20 bp, human
gcccgccacggaccttgaga

SEQ ID NO: 27512 - DNA, 20 bp, human
gaggatccaaaccaggatac

SEQ ID NO: 27513 - DNA, 20 bp, human
ggaccccgggtaccctctca

SEQ ID NO: 27514 - DNA, 20 bp, human
ggaccttgagagggtacccg

SEQ ID NO: 27515 - DNA, 20 bp, human
gaccctctcaaggtccgtgg

SEQ ID NO: 27516 - DNA, 20 bp, human
ggcggctgtcagacgcggag

SEQ ID NO: 27517 - DNA, 20 bp, human
ggagctggagaaacgccggt

SEQ ID NO: 27518 - DNA, 20 bp, human
ggcgccgcggctgtcagacg

SEQ ID NO: 27519 - DNA, 20 bp, human
gagagacgcggcccaaagga

SEQ ID NO: 27520 - DNA, 20 bp, human
gtggagaaacgccggtgggt

SEQ ID NO: 27521 - DNA, 20 bp, human
gacgccggtgggtgggagtt

SEQ ID NO: 27522 - DNA, 20 bp, human
ggtgggtgggagttgggacg

SEQ ID NO: 27523 - DNA, 20 bp, human
ggatcgagctggagaaacgc

SEQ ID NO: 27524 - DNA, 20 bp, human
gggagagccgagcgtggctg

SEQ ID NO: 27525 - DNA, 20 bp, human
gacccggcttaggaacgggc

SEQ ID NO: 27526 - DNA, 20 bp, human
gtggcgttaagggaacgctg

SEQ ID NO: 27527 - DNA, 20 bp, human
gaacagggcccgctctacct

SEQ ID NO: 27528 - DNA, 20 bp, human
gggcccgctctacctcggtc

SEQ ID NO: 27529 - DNA, 20 bp, human
ggtcccgcgctccccgaccg

SEQ ID NO: 27530 - DNA, 20 bp, human
gtagagcgggccctgttccg

SEQ ID NO: 27531 - DNA, 20 bp, human
gccgcggacggtggcgttaa

SEQ ID NO: 27532 - DNA, 20 bp, human
gagcttctgaggcctcctcg

SEQ ID NO: 27533 - DNA, 20 bp, human
gctccccgaccgaggtagag

SEQ ID NO: 27534 - DNA, 20 bp, human
gttctgaggcctcctcgtgg

SEQ ID NO: 27535 - DNA, 20 bp, human
gattcatcaccaccacgagg

SEQ ID NO: 27536 - DNA, 20 bp, human
gagttactgtaccagaataa

SEQ ID NO: 27537 - DNA, 20 bp, human
gacccccaggactacctagg

SEQ ID NO: 27538 - DNA, 20 bp, human
gtacctgcagctgtgtgact

SEQ ID NO: 27539 - DNA, 20 bp, human
gggaaaggtctaaaacacag

SEQ ID NO: 27540 - DNA, 20 bp, human
ggccacctaggtagtcctgg

SEQ ID NO: 27541 - DNA, 20 bp, human
gtctctcagttggaatgaaa

SEQ ID NO: 27542 - DNA, 20 bp, human
gtgctgaaactcctttattc

SEQ ID NO: 27543 - DNA, 20 bp, human
gagttcaagcaatgtttctg

SEQ ID NO: 27544 - DNA, 20 bp, human
gtaggtggctgccattaaca

SEQ ID NO: 27545 - DNA, 20 bp, human
ggctaatacccctccccaac

SEQ ID NO: 27546 - DNA, 20 bp, human
gctctccccggcacttacag

SEQ ID NO: 27547 - DNA, 20 bp, human
ggcggtgcgagagggcccag

SEQ ID NO: 27548 - DNA, 20 bp, human
gagccgccgcggtcctagaa

SEQ ID NO: 27549 - DNA, 20 bp, human
ggagaccgctgtaagtgccg

SEQ ID NO: 27550 - DNA, 20 bp, human
ggcgtgtcggcgtccggagg

SEQ ID NO: 27551 - DNA, 20 bp, human
gagtgccggggagagcggaa

SEQ ID NO: 27552 - DNA, 20 bp, human
ggtctgcctgggttagaaga

SEQ ID NO: 27553 - DNA, 20 bp, human
ggaaggggaactgggagatg

SEQ ID NO: 27554 - DNA, 20 bp, human
gagcgcgtgtcggcgtccgg

SEQ ID NO: 27555 - DNA, 20 bp, human
gcttctcccttctaggaccg

SEQ ID NO: 27556 - DNA, 20 bp, human
gcgtcctgggggcgcggaga

SEQ ID NO: 27557 - DNA, 20 bp, human
ggggcgtgacgtcgggagga

SEQ ID NO: 27558 - DNA, 20 bp, human
gacggtcagggcgtgacgtc

SEQ ID NO: 27559 - DNA, 20 bp, human
ggcacttccgggcacggtca

SEQ ID NO: 27560 - DNA, 20 bp, human
ggctctcagcgcgcacttcc

SEQ ID NO: 27561 - DNA, 20 bp, human
gctgagagcgcggtgaacct

SEQ ID NO: 27562 - DNA, 20 bp, human
gcagcgcgcacttccgggca

SEQ ID NO: 27563 - DNA, 20 bp, human
gtgacgccgagttaaacgtt

SEQ ID NO: 27564 - DNA, 20 bp, human
ggcaggtaagtgccggcggg

SEQ ID NO: 27565 - DNA, 20 bp, human
gtcccgggcacttgggtcag

SEQ ID NO: 27566 - DNA, 20 bp, human
gcccagctcggcgaggaccc

SEQ ID NO: 27567 - DNA, 20 bp, human
gccctcactggagaatccag

SEQ ID NO: 27568 - DNA, 20 bp, human
gtgggagttaggatccgagg

SEQ ID NO: 27569 - DNA, 20 bp, human
gagggcgctcagtaccacgt

SEQ ID NO: 27570 - DNA, 20 bp, human
gagctggcttcaaccagcga

SEQ ID NO: 27571 - DNA, 20 bp, human
gaaggctgaacccgcttcca

SEQ ID NO: 27572 - DNA, 20 bp, human
gagctgggagttaggatccg

SEQ ID NO: 27573 - DNA, 20 bp, human
gtccagtgagggttactcca

SEQ ID NO: 27574 - DNA, 20 bp, human
gcctaactcccagctcggcg

SEQ ID NO: 27575 - DNA, 20 bp, human
gtgcgcatgcgcctcggagc

SEQ ID NO: 27576 - DNA, 20 bp, human
ggacactaggaagccatagt

SEQ ID NO: 27577 - DNA, 20 bp, human
gagaccttgcaaggaagctc

SEQ ID NO: 27578 - DNA, 20 bp, human
gtccacgtgaccacccacta

SEQ ID NO: 27579 - DNA, 20 bp, human
gctggaaagacggcaaaaag

SEQ ID NO: 27580 - DNA, 20 bp, human
gactaggaagccatagtggg

SEQ ID NO: 27581 - DNA, 20 bp, human
gacgtggaggagccgaccca

SEQ ID NO: 27582 - DNA, 20 bp, human
gcgagctgatagcctgggta

SEQ ID NO: 27583 - DNA, 20 bp, human
gaagacaggataccctgggt

SEQ ID NO: 27584 - DNA, 20 bp, human
gcggggatctaagttatggg

SEQ ID NO: 27585 - DNA, 20 bp, human
ggggcggggatctaagttat

SEQ ID NO: 27586 - DNA, 20 bp, human
gaactgaaagcgggagcaaa

SEQ ID NO: 27587 - DNA, 20 bp, human
gctaggctcgaaggtccaac

SEQ ID NO: 27588 - DNA, 20 bp, human
gtggccagtcggtgcaggaa

SEQ ID NO: 27589 - DNA, 20 bp, human
gcggcaggatcgggattgag

SEQ ID NO: 27590 - DNA, 20 bp, human
ggagctccgggtgacgcata

SEQ ID NO: 27591 - DNA, 20 bp, human
gtagctgctcgcacaggact

SEQ ID NO: 27592 - DNA, 20 bp, human
gtgacgcatacggcaggatc

SEQ ID NO: 27593 - DNA, 20 bp, human
ggagccttcggagctcccgg

SEQ ID NO: 27594 - DNA, 20 bp, human
gtgcgagcagctaggctcga

SEQ ID NO: 27595 - DNA, 20 bp, human
ggagccttctcaaggaacag

SEQ ID NO: 27596 - DNA, 20 bp, human
gtagagcaggctgtcctcgg

SEQ ID NO: 27597 - DNA, 20 bp, human
gggagggagcaagggacttg

SEQ ID NO: 27598 - DNA, 20 bp, human
gggctgtcctcggaggggtg

SEQ ID NO: 27599 - DNA, 20 bp, human
gtgtcctcggaggggtgagg

SEQ ID NO: 27600 - DNA, 20 bp, human
ggtgctagaagggatggtgg

SEQ ID NO: 27601 - DNA, 20 bp, human
gagctagagcaggctgtcct

SEQ ID NO: 27602 - DNA, 20 bp, human
gagtcccagaacaccatcag

SEQ ID NO: 27603 - DNA, 20 bp, human
ggatggctaacagctagagc

SEQ ID NO: 27604 - DNA, 20 bp, human
gctggaagagatatgagatg

SEQ ID NO: 27605 - DNA, 20 bp, human
gtgttctgggactgacacgt

SEQ ID NO: 27606 - DNA, 20 bp, human
gccgcgctcaggagtctccg

SEQ ID NO: 27607 - DNA, 20 bp, human
gggccaaggaccctcttagg

SEQ ID NO: 27608 - DNA, 20 bp, human
ggtagggtctgcagtcccga

SEQ ID NO: 27609 - DNA, 20 bp, human
gggtccagcgagagaatggg

SEQ ID NO: 27610 - DNA, 20 bp, human
gcggggctgcaggaggtgta

SEQ ID NO: 27611 - DNA, 20 bp, human
gcggctgcggcttctgctca

SEQ ID NO: 27612 - DNA, 20 bp, human
gcttaggaggagccctccgg

SEQ ID NO: 27613 - DNA, 20 bp, human
ggcttgatggggccaccgga

SEQ ID NO: 27614 - DNA, 20 bp, human
ggcggcgggagcggtcatgg

SEQ ID NO: 27615 - DNA, 20 bp, human
gaagcaccgtcggactgaag

SEQ ID NO: 27616 - DNA, 20 bp, human
gcgcggagcagcggtgtcca

SEQ ID NO: 27617 - DNA, 20 bp, human
gggagctggtcgcggagcag

SEQ ID NO: 27618 - DNA, 20 bp, human
gagatggcgggagctggtcg

SEQ ID NO: 27619 - DNA, 20 bp, human
gcacgggacgcgaggccgaa

SEQ ID NO: 27620 - DNA, 20 bp, human
gcctcccggcgtggagatgg

SEQ ID NO: 27621 - DNA, 20 bp, human
gactcggtaagagccgatgg

SEQ ID NO: 27622 - DNA, 20 bp, human
ggcttcgctagggagcctcc

SEQ ID NO: 27623 - DNA, 20 bp, human
ggagcctcccggcgtggaga

SEQ ID NO: 27624 - DNA, 20 bp, human
gggagcgaggggtccttcgg

SEQ ID NO: 27625 - DNA, 20 bp, human
gctccgcccgggacccccta

SEQ ID NO: 27626 - DNA, 20 bp, human
ggagggtcgtcaagccaccg

SEQ ID NO: 27627 - DNA, 20 bp, human
gcaaccgtaccagtctcccc

SEQ ID NO: 27628 - DNA, 20 bp, human
gctgtgtgctatggagccga

SEQ ID NO: 27629 - DNA, 20 bp, human
ggctgcccccgagtccgtag

SEQ ID NO: 27630 - DNA, 20 bp, human
gccggggcaggatttagtag

SEQ ID NO: 27631 - DNA, 20 bp, human
gaaagccgctacggactcgg

SEQ ID NO: 27632 - DNA, 20 bp, human
gagtatatctgagccgggag

SEQ ID NO: 27633 - DNA, 20 bp, human
gacgcggttcccggggagac

SEQ ID NO: 27634 - DNA, 20 bp, human
ggtacggttgctgtgtgcta

SEQ ID NO: 27635 - DNA, 20 bp, human
ggccgcgggtttgatgaacg

SEQ ID NO: 27636 - DNA, 20 bp, human
gtcagagaagcccagaccga

SEQ ID NO: 27637 - DNA, 20 bp, human
gaagccggcgctctagacta

SEQ ID NO: 27638 - DNA, 20 bp, human
gggcgagagatggtcaggtc

SEQ ID NO: 27639 - DNA, 20 bp, human
ggaggcggcgagagatggtc

SEQ ID NO: 27640 - DNA, 20 bp, human
gcgtgaggcttcacttccct

SEQ ID NO: 27641 - DNA, 20 bp, human
gtcaggtctggagctcgacc

SEQ ID NO: 27642 - DNA, 20 bp, human
ggtgttacgacgggaagatt

SEQ ID NO: 27643 - DNA, 20 bp, human
ggttaagtcactcgacgcag

SEQ ID NO: 27644 - DNA, 20 bp, human
gcaagccgggaagcttggag

SEQ ID NO: 27645 - DNA, 20 bp, human
ggaaacatctagagaccgag

SEQ ID NO: 27646 - DNA, 20 bp, human
gggtgtaggccagccgaagt

SEQ ID NO: 27647 - DNA, 20 bp, human
gtaggtaaaagttcatggtg

SEQ ID NO: 27648 - DNA, 20 bp, human
gcccgccctggagaatcggg

SEQ ID NO: 27649 - DNA, 20 bp, human
gtgaaggagcaaacccactt

SEQ ID NO: 27650 - DNA, 20 bp, human
gttcagctgggggagcccca

SEQ ID NO: 27651 - DNA, 20 bp, human
ggccccagggaacgtgtgag

SEQ ID NO: 27652 - DNA, 20 bp, human
gtctccagggcgggaagaat

SEQ ID NO: 27653 - DNA, 20 bp, human
gcggattaagggactagatg

SEQ ID NO: 27654 - DNA, 20 bp, human
gcttcccgccctggagaatc

SEQ ID NO: 27655 - DNA, 20 bp, human
gggcctaatgactgtcactg

SEQ ID NO: 27656 - DNA, 20 bp, human
gtaactgctgaaacttgtag

SEQ ID NO: 27657 - DNA, 20 bp, human
gtgctttctggctgactgaa

SEQ ID NO: 27658 - DNA, 20 bp, human
gtcagaaggccagggttact

SEQ ID NO: 27659 - DNA, 20 bp, human
gctgcccaaagtataaactc

SEQ ID NO: 27660 - DNA, 20 bp, human
gtggtcatttcagaaggcca

SEQ ID NO: 27661 - DNA, 20 bp, human
gctctcacgataaactcaat

SEQ ID NO: 27662 - DNA, 20 bp, human
gccacagccgcacagaaaaa

SEQ ID NO: 27663 - DNA, 20 bp, human
gcttagtgtcaccatactag

SEQ ID NO: 27664 - DNA, 20 bp, human
gtcgtagaaagcgcaacact

SEQ ID NO: 27665 - DNA, 20 bp, human
gagtttatcgtgagagagaa

SEQ ID NO: 27666 - DNA, 20 bp, human
gactcccggactggagaaaa

SEQ ID NO: 27667 - DNA, 20 bp, human
gagcacgagagagtccatga

SEQ ID NO: 27668 - DNA, 20 bp, human
gggagtcgcggggaccttca

SEQ ID NO: 27669 - DNA, 20 bp, human
ggtccccgcgactcccggac

SEQ ID NO: 27670 - DNA, 20 bp, human
gcgctgagggcgcaacccgg

SEQ ID NO: 27671 - DNA, 20 bp, human
gttctccagtccgggagtcg

SEQ ID NO: 27672 - DNA, 20 bp, human
gctgcagcgcgggagggatc

SEQ ID NO: 27673 - DNA, 20 bp, human
gtcgcacagccgactgtagg

SEQ ID NO: 27674 - DNA, 20 bp, human
ggagtcgcacagccgactgt

SEQ ID NO: 27675 - DNA, 20 bp, human
gtctcgtgctccgtaatggg

SEQ ID NO: 27676 - DNA, 20 bp, human
gccctagcgtcgggagccag

SEQ ID NO: 27677 - DNA, 20 bp, human
gtggagcacatcttagctcc

SEQ ID NO: 27678 - DNA, 20 bp, human
ggtggctgttggcttggcgg

SEQ ID NO: 27679 - DNA, 20 bp, human
gtcatgttggccgagctcgg

SEQ ID NO: 27680 - DNA, 20 bp, human
ggaggctttgcggtggctgt

SEQ ID NO: 27681 - DNA, 20 bp, human
ggaaggatgcgccgtcctgt

SEQ ID NO: 27682 - DNA, 20 bp, human
gggacggcgcatccttcgcc

SEQ ID NO: 27683 - DNA, 20 bp, human
gacttcatgttggccgagct

SEQ ID NO: 27684 - DNA, 20 bp, human
gtgaagttcttaaggatgga

SEQ ID NO: 27685 - DNA, 20 bp, human
ggaaaatggataaacacagt

SEQ ID NO: 27686 - DNA, 20 bp, human
ggctcttctgtgtccagcgg

SEQ ID NO: 27687 - DNA, 20 bp, human
gctgccctgtgtgcctctgg

SEQ ID NO: 27688 - DNA, 20 bp, human
gtgtgtccagcttagagaac

SEQ ID NO: 27689 - DNA, 20 bp, human
ggccaggctggaggactaga

SEQ ID NO: 27690 - DNA, 20 bp, human
gtgcctctgggggcaagtgt

SEQ ID NO: 27691 - DNA, 20 bp, human
gcacagagttgctcctccgc

SEQ ID NO: 27692 - DNA, 20 bp, human
gcagtggtagaaacgtgatg

SEQ ID NO: 27693 - DNA, 20 bp, human
gacctcgctgcggttggtag

SEQ ID NO: 27694 - DNA, 20 bp, human
gggtggtggggcaggttgct

SEQ ID NO: 27695 - DNA, 20 bp, human
gtccagcaggtggaaggttg

SEQ ID NO: 27696 - DNA, 20 bp, human
gctcctggctcccaacacta

SEQ ID NO: 27697 - DNA, 20 bp, human
ggaggaagacccctagtgtt

SEQ ID NO: 27698 - DNA, 20 bp, human
gaggccaagccacgcgggta

SEQ ID NO: 27699 - DNA, 20 bp, human
gcgggtaaggccaagccacg

SEQ ID NO: 27700 - DNA, 20 bp, human
gtggccttacccgcgtggct

SEQ ID NO: 27701 - DNA, 20 bp, human
gacccctagtgttgggagcc

SEQ ID NO: 27702 - DNA, 20 bp, human
gttgcggtggctgcttggcg

SEQ ID NO: 27703 - DNA, 20 bp, human
gcgggggaccagtggtcctt

SEQ ID NO: 27704 - DNA, 20 bp, human
gagtggtacttggactaccc

SEQ ID NO: 27705 - DNA, 20 bp, human
ggcggacatcgtgctggagc

SEQ ID NO: 27706 - DNA, 20 bp, human
gaaggacgcgacttcttgtt

SEQ ID NO: 27707 - DNA, 20 bp, human
gatggtcaccttggatacca

SEQ ID NO: 27708 - DNA, 20 bp, human
gccctggagatgcccgcact

SEQ ID NO: 27709 - DNA, 20 bp, human
gagcttcactaacctagtgc

SEQ ID NO: 27710 - DNA, 20 bp, human
gtggatcttgacatccacat

SEQ ID NO: 27711 - DNA, 20 bp, human
gagtactttacacggtaatt

SEQ ID NO: 27712 - DNA, 20 bp, human
gctttgaggcaaggcaagga

SEQ ID NO: 27713 - DNA, 20 bp, human
gaggtcacttagggtcagga

SEQ ID NO: 27714 - DNA, 20 bp, human
gaaccctttgaggcaaggca

SEQ ID NO: 27715 - DNA, 20 bp, human
gtttggtagactgtgcacca

SEQ ID NO: 27716 - DNA, 20 bp, human
gagtctgggaaagaagctaa

SEQ ID NO: 27717 - DNA, 20 bp, human
gccatcctgatgctctctgg

SEQ ID NO: 27718 - DNA, 20 bp, human
gcagtaggagagggacaatg

SEQ ID NO: 27719 - DNA, 20 bp, human
gtctctgggggcggcctcag

SEQ ID NO: 27720 - DNA, 20 bp, human
gaggctgctgtggagatcgc

SEQ ID NO: 27721 - DNA, 20 bp, human
gcaagggaaaggcgacagag

SEQ ID NO: 27722 - DNA, 20 bp, human
gctccatgactaaaaatcta

SEQ ID NO: 27723 - DNA, 20 bp, human
ggagatgtcttatctcacag

SEQ ID NO: 27724 - DNA, 20 bp, human
ggctgggtgcatgtcacgtg

SEQ ID NO: 27725 - DNA, 20 bp, human
gatcggcgctatgctaagtg

SEQ ID NO: 27726 - DNA, 20 bp, human
ggtccaccacttataaactg

SEQ ID NO: 27727 - DNA, 20 bp, human
ggttctgttggatacccaca

SEQ ID NO: 27728 - DNA, 20 bp, human
gcagcaaattacttaaatgg

SEQ ID NO: 27729 - DNA, 20 bp, human
gtaaatggtcctggttctgt

SEQ ID NO: 27730 - DNA, 20 bp, human
ggtcatactgctgtgcagta

SEQ ID NO: 27731 - DNA, 20 bp, human
gagaatcactttttccatgt

SEQ ID NO: 27732 - DNA, 20 bp, human
ggattattagaacttcataa

SEQ ID NO: 27733 - DNA, 20 bp, human
gtttgatctatgtgactgtt

SEQ ID NO: 27734 - DNA, 20 bp, human
gcaagactgttattggagca

SEQ ID NO: 27735 - DNA, 20 bp, human
gcataatggatcttggtata

SEQ ID NO: 27736 - DNA, 20 bp, human
gcagatggcgcggaagaaag

SEQ ID NO: 27737 - DNA, 20 bp, human
gtggaggaggaggccatgaa

SEQ ID NO: 27738 - DNA, 20 bp, human
ggccccgcgcggccccgaga

SEQ ID NO: 27739 - DNA, 20 bp, human
gggcttcagcctccaatcca

SEQ ID NO: 27740 - DNA, 20 bp, human
ggactgagagcgactggcag

SEQ ID NO: 27741 - DNA, 20 bp, human
gcagcgctggcggccgcgag

SEQ ID NO: 27742 - DNA, 20 bp, human
gcccagctcggcctctctgg

SEQ ID NO: 27743 - DNA, 20 bp, human
gacgcgacgtcgcgaggagg

SEQ ID NO: 27744 - DNA, 20 bp, human
gcgaccggactgagagcgac

SEQ ID NO: 27745 - DNA, 20 bp, human
ggcctgggactgaaacggga

SEQ ID NO: 27746 - DNA, 20 bp, human
gcgagctgcgggccgattcc

SEQ ID NO: 27747 - DNA, 20 bp, human
gagccgagagtcccaataat

SEQ ID NO: 27748 - DNA, 20 bp, human
gcagtctactcggagtacta

SEQ ID NO: 27749 - DNA, 20 bp, human
ggcagaagcctggcatgaag

SEQ ID NO: 27750 - DNA, 20 bp, human
gtccgagtagactgagtctg

SEQ ID NO: 27751 - DNA, 20 bp, human
gaggcctgctccggctgaga

SEQ ID NO: 27752 - DNA, 20 bp, human
ggagccacaggcccgtgaaa

SEQ ID NO: 27753 - DNA, 20 bp, human
gagtggcggtctacttgagg

SEQ ID NO: 27754 - DNA, 20 bp, human
ggccacagactcagtctact

SEQ ID NO: 27755 - DNA, 20 bp, human
ggatggcactggccaggaat

SEQ ID NO: 27756 - DNA, 20 bp, human
gtgcagtacggagcctcagg

SEQ ID NO: 27757 - DNA, 20 bp, human
gggcggacagatggactgta

SEQ ID NO: 27758 - DNA, 20 bp, human
gtgctgcagtacggagcctc

SEQ ID NO: 27759 - DNA, 20 bp, human
gtattctggtaagcaagcca

SEQ ID NO: 27760 - DNA, 20 bp, human
gcgtactgcagcaggcgagc

SEQ ID NO: 27761 - DNA, 20 bp, human
ggcaggcgagcgggtttccg

SEQ ID NO: 27762 - DNA, 20 bp, human
gactgcgccggggagcgggt

SEQ ID NO: 27763 - DNA, 20 bp, human
gacagatggactgtaaggtg

SEQ ID NO: 27764 - DNA, 20 bp, human
gggagcctcaggcggacaga

SEQ ID NO: 27765 - DNA, 20 bp, human
ggctcctaaatggctttcac

SEQ ID NO: 27766 - DNA, 20 bp, human
ggctgacggatccctgacag

SEQ ID NO: 27767 - DNA, 20 bp, human
gccgtcagctcggattccta

SEQ ID NO: 27768 - DNA, 20 bp, human
ggagtcagtcgcccctgtca

SEQ ID NO: 27769 - DNA, 20 bp, human
gtggggctgaaggcccctag

SEQ ID NO: 27770 - DNA, 20 bp, human
gaggggttagggggataact

SEQ ID NO: 27771 - DNA, 20 bp, human
gccagccacctccgaggcaa

SEQ ID NO: 27772 - DNA, 20 bp, human
gcacaccatgaagattggat

SEQ ID NO: 27773 - DNA, 20 bp, human
gagcgcaaccacctagcggt

SEQ ID NO: 27774 - DNA, 20 bp, human
ggcaaacccagccacctccg

SEQ ID NO: 27775 - DNA, 20 bp, human
gaaggcccctaggggttagg

SEQ ID NO: 27776 - DNA, 20 bp, human
gcagcggaaagggagactgt

SEQ ID NO: 27777 - DNA, 20 bp, human
gagggagactgtggggaact

SEQ ID NO: 27778 - DNA, 20 bp, human
gggacactaggatgacggag

SEQ ID NO: 27779 - DNA, 20 bp, human
ggggaactaggagcaacagc

SEQ ID NO: 27780 - DNA, 20 bp, human
gggcgaaggaccaactgtgt

SEQ ID NO: 27781 - DNA, 20 bp, human
gatgaagaaaggaatctcta

SEQ ID NO: 27782 - DNA, 20 bp, human
gtcgaaccgtcaatagaatt

SEQ ID NO: 27783 - DNA, 20 bp, human
ggaatctctatggagaaagc

SEQ ID NO: 27784 - DNA, 20 bp, human
gcctaaggacactaggatga

SEQ ID NO: 27785 - DNA, 20 bp, human
gctgagagtgaattcttgag

SEQ ID NO: 27786 - DNA, 20 bp, human
gtggcaggagaggatcctac

SEQ ID NO: 27787 - DNA, 20 bp, human
gaggagaggatcctacaggt

SEQ ID NO: 27788 - DNA, 20 bp, human
ggccccaacgctggcaggag

SEQ ID NO: 27789 - DNA, 20 bp, human
gcacgagtgggtcactccac

SEQ ID NO: 27790 - DNA, 20 bp, human
gccacggggagccccaacgc

SEQ ID NO: 27791 - DNA, 20 bp, human
gaactggggtgagtcatggt

SEQ ID NO: 27792 - DNA, 20 bp, human
gtctgccactccccacgagt

SEQ ID NO: 27793 - DNA, 20 bp, human
gctctttggaacctcagaca

SEQ ID NO: 27794 - DNA, 20 bp, human
gtctctggaggagctctgcg

SEQ ID NO: 27795 - DNA, 20 bp, human
gatcctctcctgccagcgtt

SEQ ID NO: 27796 - DNA, 20 bp, human
ggcgcgtcccggaggcggac

SEQ ID NO: 27797 - DNA, 20 bp, human
gggatcgtcgctgcccagtc

SEQ ID NO: 27798 - DNA, 20 bp, human
gcggcttactggtaagctcg

SEQ ID NO: 27799 - DNA, 20 bp, human
gtcgctgcccagtccggccg

SEQ ID NO: 27800 - DNA, 20 bp, human
gctgggcagcgacgatcccc

SEQ ID NO: 27801 - DNA, 20 bp, human
ggggctcgcgcgctctgaag

SEQ ID NO: 27802 - DNA, 20 bp, human
ggcagagggcgcaggcccaa

SEQ ID NO: 27803 - DNA, 20 bp, human
ggcgagctgctcgaagccgg

SEQ ID NO: 27804 - DNA, 20 bp, human
gccgccccgccccggcgtag

SEQ ID NO: 27805 - DNA, 20 bp, human
gactggtaagctcggggaag

SEQ ID NO: 27806 - DNA, 20 bp, human
gtgagaaggcagccagacga

SEQ ID NO: 27807 - DNA, 20 bp, human
ggctgacagtggaccctcag

SEQ ID NO: 27808 - DNA, 20 bp, human
ggtcagccaactctacaagg

SEQ ID NO: 27809 - DNA, 20 bp, human
gggcagcagctcgtccctca

SEQ ID NO: 27810 - DNA, 20 bp, human
gagacgcgttgagctctggg

SEQ ID NO: 27811 - DNA, 20 bp, human
gctctacaaggaggcatctt

SEQ ID NO: 27812 - DNA, 20 bp, human
ggaagtcccgtgagagctct

SEQ ID NO: 27813 - DNA, 20 bp, human
gttcccgtaagctccagtgg

SEQ ID NO: 27814 - DNA, 20 bp, human
gggtcacacaggatccagac

SEQ ID NO: 27815 - DNA, 20 bp, human
gggcccccactggagcttac

SEQ ID NO: 27816 - DNA, 20 bp, human
ggtgtcccgagactaggacg

SEQ ID NO: 27817 - DNA, 20 bp, human
gccaggtgcgccctgccccg

SEQ ID NO: 27818 - DNA, 20 bp, human
gggagccacgtcctagtctc

SEQ ID NO: 27819 - DNA, 20 bp, human
gcattctgggaacctcgccg

SEQ ID NO: 27820 - DNA, 20 bp, human
gtcctagtctcgggacacaa

SEQ ID NO: 27821 - DNA, 20 bp, human
ggacatccacgaacgacgaa

SEQ ID NO: 27822 - DNA, 20 bp, human
gttcgctaggatttcggtag

SEQ ID NO: 27823 - DNA, 20 bp, human
gtatctgaggggatgtggtc

SEQ ID NO: 27824 - DNA, 20 bp, human
gtccgttgtgtcccgagact

SEQ ID NO: 27825 - DNA, 20 bp, human
gtctctcccacaatatgggg

SEQ ID NO: 27826 - DNA, 20 bp, human
ggcaccgctcaccgacaccg

SEQ ID NO: 27827 - DNA, 20 bp, human
gccctccaagcccttcatag

SEQ ID NO: 27828 - DNA, 20 bp, human
ggcgggactacggaaggcag

SEQ ID NO: 27829 - DNA, 20 bp, human
gcggcctgagcgcccggcta

SEQ ID NO: 27830 - DNA, 20 bp, human
gagcgcccaggccaaccctc

SEQ ID NO: 27831 - DNA, 20 bp, human
gttgagggcgggactacgga

SEQ ID NO: 27832 - DNA, 20 bp, human
gcaggccgctgccttggcaa

SEQ ID NO: 27833 - DNA, 20 bp, human
ggacgccgttgccaaggcag

SEQ ID NO: 27834 - DNA, 20 bp, human
ggtggccgcaggcgcaccgg

SEQ ID NO: 27835 - DNA, 20 bp, human
ggtcgaagggagcgaggtac

SEQ ID NO: 27836 - DNA, 20 bp, human
gtgaggaccactaaagtgat

SEQ ID NO: 27837 - DNA, 20 bp, human
gaggaagtaagtagtaggta

SEQ ID NO: 27838 - DNA, 20 bp, human
ggatagcacgaagcatatta

SEQ ID NO: 27839 - DNA, 20 bp, human
gccactaaagtgatgggaag

SEQ ID NO: 27840 - DNA, 20 bp, human
gagatgaaaattcccagccc

SEQ ID NO: 27841 - DNA, 20 bp, human
gtggcatctcagtaatcaaa

SEQ ID NO: 27842 - DNA, 20 bp, human
gcttcgtgctatcgtttttt

SEQ ID NO: 27843 - DNA, 20 bp, human
gtttattgatgtaggtgtcc

SEQ ID NO: 27844 - DNA, 20 bp, human
gataaaaactgttaagctca

SEQ ID NO: 27845 - DNA, 20 bp, human
gaatgttagtcaagattgct

SEQ ID NO: 27846 - DNA, 20 bp, human
gcagcgtcacagctgaggac

SEQ ID NO: 27847 - DNA, 20 bp, human
gtaatacgatggtgtccccg

SEQ ID NO: 27848 - DNA, 20 bp, human
gtaatcacaacatcccagta

SEQ ID NO: 27849 - DNA, 20 bp, human
ggagagaggaggcactactg

SEQ ID NO: 27850 - DNA, 20 bp, human
gtgcctggtatagagtaatg

SEQ ID NO: 27851 - DNA, 20 bp, human
gaattctcccgggagggaca

SEQ ID NO: 27852 - DNA, 20 bp, human
gtggcttcgtggtccctgat

SEQ ID NO: 27853 - DNA, 20 bp, human
gctgatgggagagcatgaac

SEQ ID NO: 27854 - DNA, 20 bp, human
gaacttcagcgtcacagctg

SEQ ID NO: 27855 - DNA, 20 bp, human
gggacacggaagcagcaacc

SEQ ID NO: 27856 - DNA, 20 bp, human
gccgcgctggcgctgcactg

SEQ ID NO: 27857 - DNA, 20 bp, human
gctgtgtccgggaagaagag

SEQ ID NO: 27858 - DNA, 20 bp, human
gcgctggcgctgcactgcgg

SEQ ID NO: 27859 - DNA, 20 bp, human
ggtggccagagccgaacggg

SEQ ID NO: 27860 - DNA, 20 bp, human
gagcgactaggtcgggactg

SEQ ID NO: 27861 - DNA, 20 bp, human
ggcctcccgaggagagaagg

SEQ ID NO: 27862 - DNA, 20 bp, human
ggactaggtcgggactgggg

SEQ ID NO: 27863 - DNA, 20 bp, human
gcgcccgccagcgactaggt

SEQ ID NO: 27864 - DNA, 20 bp, human
gccggacacagggggcgaag

SEQ ID NO: 27865 - DNA, 20 bp, human
gcgcgcggcagccccccgtt

SEQ ID NO: 27866 - DNA, 20 bp, human
gacggacagcgaaggtccag

SEQ ID NO: 27867 - DNA, 20 bp, human
gggagcccacgagtgaaggt

SEQ ID NO: 27868 - DNA, 20 bp, human
gggaccttcgctgtccgtct

SEQ ID NO: 27869 - DNA, 20 bp, human
gagcgggagcccacgagtga

SEQ ID NO: 27870 - DNA, 20 bp, human
gagcgcctcgcggtccagga

SEQ ID NO: 27871 - DNA, 20 bp, human
gtggtccaggcaccaaccca

SEQ ID NO: 27872 - DNA, 20 bp, human
ggcacccagacggacagcga

SEQ ID NO: 27873 - DNA, 20 bp, human
gtcggcgggcacggtctcta

SEQ ID NO: 27874 - DNA, 20 bp, human
gaatgttaggcgcacccaga

SEQ ID NO: 27875 - DNA, 20 bp, human
ggtgcctggaccaccaggac

SEQ ID NO: 27876 - DNA, 20 bp, human
gaaaagaagcgggagaatct

SEQ ID NO: 27877 - DNA, 20 bp, human
gcgcgtccagtgatgactgg

SEQ ID NO: 27878 - DNA, 20 bp, human
ggggagaccccagagaaata

SEQ ID NO: 27879 - DNA, 20 bp, human
gtggccgcgggataagggat

SEQ ID NO: 27880 - DNA, 20 bp, human
gaggctgggctatagatagg

SEQ ID NO: 27881 - DNA, 20 bp, human
gcggcctggcatagaagtga

SEQ ID NO: 27882 - DNA, 20 bp, human
gagccaagcgtaggatgaga

SEQ ID NO: 27883 - DNA, 20 bp, human
gcaggagaaggcaactaacg

SEQ ID NO: 27884 - DNA, 20 bp, human
gaatctgggcgtcgctctag

SEQ ID NO: 27885 - DNA, 20 bp, human
ggcgcacatagcgacttggt

SEQ ID NO: 27886 - DNA, 20 bp, human
ggccctgaaatataaaacct

SEQ ID NO: 27887 - DNA, 20 bp, human
gttatgagttgggcataccg

SEQ ID NO: 27888 - DNA, 20 bp, human
ggataagataccagcagcac

SEQ ID NO: 27889 - DNA, 20 bp, human
gtgtcatatgtgaaagagac

SEQ ID NO: 27890 - DNA, 20 bp, human
gtccaggaggtaagaataaa

SEQ ID NO: 27891 - DNA, 20 bp, human
ggttgcacatggttatgagt

SEQ ID NO: 27892 - DNA, 20 bp, human
ggtgcagcagtgattgctct

SEQ ID NO: 27893 - DNA, 20 bp, human
gcataaccatgtgcaacatt

SEQ ID NO: 27894 - DNA, 20 bp, human
gaccgaggttttatatttca

SEQ ID NO: 27895 - DNA, 20 bp, human
gtacccttttcaggaagtgt

SEQ ID NO: 27896 - DNA, 20 bp, human
gaagccagtacggcacgagg

SEQ ID NO: 27897 - DNA, 20 bp, human
gcatatgattggatccttaa

SEQ ID NO: 27898 - DNA, 20 bp, human
gcgcgggaggtgcgaccggg

SEQ ID NO: 27899 - DNA, 20 bp, human
gggtgctgaggggaaagacg

SEQ ID NO: 27900 - DNA, 20 bp, human
gaccaaaggcttactcaaag

SEQ ID NO: 27901 - DNA, 20 bp, human
gggcgccgtgattaacccct

SEQ ID NO: 27902 - DNA, 20 bp, human
gaagggcagcacatcctacc

SEQ ID NO: 27903 - DNA, 20 bp, human
gctctggcctgacactatga

SEQ ID NO: 27904 - DNA, 20 bp, human
gagtaggcagctttccgggt

SEQ ID NO: 27905 - DNA, 20 bp, human
gaggcgcgggaggtgcgacc

SEQ ID NO: 27906 - DNA, 20 bp, human
gaagccagtacggcacgagg

SEQ ID NO: 27907 - DNA, 20 bp, human
gcgcgggaggtgcgaccggg

SEQ ID NO: 27908 - DNA, 20 bp, human
gcatatgattggatccttaa

SEQ ID NO: 27909 - DNA, 20 bp, human
gaggcgcgggaggtgcgacc

SEQ ID NO: 27910 - DNA, 20 bp, human
gaagggcagcacatcctacc

SEQ ID NO: 27911 - DNA, 20 bp, human
gaccaaaggcttactcaaag

SEQ ID NO: 27912 - DNA, 20 bp, human
gagtaggcagctttccgggt

SEQ ID NO: 27913 - DNA, 20 bp, human
gggtgctgaggggaaagacg

SEQ ID NO: 27914 - DNA, 20 bp, human
gtgccgtactggcttctggg

SEQ ID NO: 27915 - DNA, 20 bp, human
gggcgccgtgattaacccct

SEQ ID NO: 27916 - DNA, 20 bp, human
gtcccacagggcaggagcgc

SEQ ID NO: 27917 - DNA, 20 bp, human
ggcgtgccacaagaacccca

SEQ ID NO: 27918 - DNA, 20 bp, human
ggatagggtgtagtaggatg

SEQ ID NO: 27919 - DNA, 20 bp, human
gtgggtggctaacagagctg

SEQ ID NO: 27920 - DNA, 20 bp, human
gttgtgccacaagaacacca

SEQ ID NO: 27921 - DNA, 20 bp, human
gcctggggatagggtgtagt

SEQ ID NO: 27922 - DNA, 20 bp, human
gatgcagaagcgctgagtat

SEQ ID NO: 27923 - DNA, 20 bp, human
gcagaagggatcaagggcag

SEQ ID NO: 27924 - DNA, 20 bp, human
ggccatgggtggggattcaa

SEQ ID NO: 27925 - DNA, 20 bp, human
gcagaagcgctgagtatggg

SEQ ID NO: 27926 - DNA, 20 bp, human
gaccggccctgaggaagcgg

SEQ ID NO: 27927 - DNA, 20 bp, human
gcatgacgacccgagcccgg

SEQ ID NO: 27928 - DNA, 20 bp, human
ggcgcgctcggacccggaac

SEQ ID NO: 27929 - DNA, 20 bp, human
gagacacccgcgccacccgc

SEQ ID NO: 27930 - DNA, 20 bp, human
ggggatagacgacccaggag

SEQ ID NO: 27931 - DNA, 20 bp, human
gggtgacattcgaaagactg

SEQ ID NO: 27932 - DNA, 20 bp, human
gagcggcacccagcgcgata

SEQ ID NO: 27933 - DNA, 20 bp, human
ggatatggctggtgcagtcc

SEQ ID NO: 27934 - DNA, 20 bp, human
gcagcccggagtagagtcac

SEQ ID NO: 27935 - DNA, 20 bp, human
gcccaggccacagccctcgc

SEQ ID NO: 27936 - DNA, 20 bp, human
gggctgacctgtgaaagtct

SEQ ID NO: 27937 - DNA, 20 bp, human
gacctggaggaagatctccg

SEQ ID NO: 27938 - DNA, 20 bp, human
ggcctacgccaacagcccca

SEQ ID NO: 27939 - DNA, 20 bp, human
gcggatggggaccagagggg

SEQ ID NO: 27940 - DNA, 20 bp, human
ggtacagcctcagcgatctc

SEQ ID NO: 27941 - DNA, 20 bp, human
gtcacaggtcagcccaactc

SEQ ID NO: 27942 - DNA, 20 bp, human
gtgcacacccaagaccccag

SEQ ID NO: 27943 - DNA, 20 bp, human
ggggccgctccaagtctcac

SEQ ID NO: 27944 - DNA, 20 bp, human
gctctggctaggatgctcca

SEQ ID NO: 27945 - DNA, 20 bp, human
gcaccgtgcggttacctcag

SEQ ID NO: 27946 - DNA, 20 bp, human
gacggccaaaaccttcccta

SEQ ID NO: 27947 - DNA, 20 bp, human
gggacggaggcctgagtcag

SEQ ID NO: 27948 - DNA, 20 bp, human
gtgggctggcgacagagggt

SEQ ID NO: 27949 - DNA, 20 bp, human
gtacgtgccaacaaaaccca

SEQ ID NO: 27950 - DNA, 20 bp, human
gaaggcccgacctgaagcac

SEQ ID NO: 27951 - DNA, 20 bp, human
gagacaggtctatctgggaa

SEQ ID NO: 27952 - DNA, 20 bp, human
gcttgctgggctggcgacag

SEQ ID NO: 27953 - DNA, 20 bp, human
gtctccctcacgccctaaga

SEQ ID NO: 27954 - DNA, 20 bp, human
gagacccctcagacaccgtc

SEQ ID NO: 27955 - DNA, 20 bp, human
gagcactggctccagcctta

SEQ ID NO: 27956 - DNA, 20 bp, human
ggtacgagtaacaactccac

SEQ ID NO: 27957 - DNA, 20 bp, human
gaggcgaggatgccgaatga

SEQ ID NO: 27958 - DNA, 20 bp, human
gtccagatctaggagcatca

SEQ ID NO: 27959 - DNA, 20 bp, human
gctccaccggctggcgtccg

SEQ ID NO: 27960 - DNA, 20 bp, human
gcgtaccagcatctctgacg

SEQ ID NO: 27961 - DNA, 20 bp, human
gtccatgatgctcctagatc

SEQ ID NO: 27962 - DNA, 20 bp, human
gactgtggcgccaagcgccg

SEQ ID NO: 27963 - DNA, 20 bp, human
ggacgggcgaaggaaagtac

SEQ ID NO: 27964 - DNA, 20 bp, human
ggacacctcgtcagagatgc

SEQ ID NO: 27965 - DNA, 20 bp, human
ggagtaacaactccaccggc

SEQ ID NO: 27966 - DNA, 20 bp, human
gcgacggaggtaggcttacg

SEQ ID NO: 27967 - DNA, 20 bp, human
ggaccctttctacccgacac

SEQ ID NO: 27968 - DNA, 20 bp, human
gaggcttacgaggcctgtgt

SEQ ID NO: 27969 - DNA, 20 bp, human
gacgaggtgcaggtccttgt

SEQ ID NO: 27970 - DNA, 20 bp, human
gggcctgtgtcgggtagaaa

SEQ ID NO: 27971 - DNA, 20 bp, human
gagagggtcccggtccagga

SEQ ID NO: 27972 - DNA, 20 bp, human
gtggtcgtggcagagggtcc

SEQ ID NO: 27973 - DNA, 20 bp, human
gacacttccggttgcgacgg

SEQ ID NO: 27974 - DNA, 20 bp, human
gagggttcctcctgactgta

SEQ ID NO: 27975 - DNA, 20 bp, human
gtctgaacctggtgtcccgt

SEQ ID NO: 27976 - DNA, 20 bp, human
ggcccagccctggggtccag

SEQ ID NO: 27977 - DNA, 20 bp, human
ggcgctagggcaggagatct

SEQ ID NO: 27978 - DNA, 20 bp, human
gaggaggcgctcaagtagag

SEQ ID NO: 27979 - DNA, 20 bp, human
gtaatcaggtcgcaggcata

SEQ ID NO: 27980 - DNA, 20 bp, human
gggaagggacgtctcctcag

SEQ ID NO: 27981 - DNA, 20 bp, human
gggtgcataactccagggag

SEQ ID NO: 27982 - DNA, 20 bp, human
gggtaaggtgcataactcca

SEQ ID NO: 27983 - DNA, 20 bp, human
gagtcacctcagctgcgcta

SEQ ID NO: 27984 - DNA, 20 bp, human
ggactctcctcccggaacca

SEQ ID NO: 27985 - DNA, 20 bp, human
gaccgcgaccgaggagccca

SEQ ID NO: 27986 - DNA, 20 bp, human
gggctgggcaactacgacag

SEQ ID NO: 27987 - DNA, 20 bp, human
gtacgacagcggagcccctg

SEQ ID NO: 27988 - DNA, 20 bp, human
gcggcatcttggcttcccca

SEQ ID NO: 27989 - DNA, 20 bp, human
gccaccggggtcccccaata

SEQ ID NO: 27990 - DNA, 20 bp, human
ggcaactccaggcctgtaag

SEQ ID NO: 27991 - DNA, 20 bp, human
gccggggagagggtccgagt

SEQ ID NO: 27992 - DNA, 20 bp, human
gtctgccagactatggacat

SEQ ID NO: 27993 - DNA, 20 bp, human
gccagggagaggggactctc

SEQ ID NO: 27994 - DNA, 20 bp, human
gtgatcagagccactgaggt

SEQ ID NO: 27995 - DNA, 20 bp, human
gtcacaagccgggagagccg

SEQ ID NO: 27996 - DNA, 20 bp, human
ggaacccggcgactctggag

SEQ ID NO: 27997 - DNA, 20 bp, human
gcatcatgcgcgaggagaag

SEQ ID NO: 27998 - DNA, 20 bp, human
gccagtgcctgaagaagaga

SEQ ID NO: 27999 - DNA, 20 bp, human
gagaaggcaggagcggaacc

SEQ ID NO: 28000 - DNA, 20 bp, human
ggagcggaacccggcgactc

SEQ ID NO: 28001 - DNA, 20 bp, human
gcgcctcgtaggcctcatac

SEQ ID NO: 28002 - DNA, 20 bp, human
ggcgcgccgctccgcctcgt

SEQ ID NO: 28003 - DNA, 20 bp, human
gggcgactctggaggggacg

SEQ ID NO: 28004 - DNA, 20 bp, human
ggcaggcctctagcgagcgg

SEQ ID NO: 28005 - DNA, 20 bp, human
ggtggccaccggcctgtatg

SEQ ID NO: 28006 - DNA, 20 bp, human
gactggaggacggagaacag

SEQ ID NO: 28007 - DNA, 20 bp, human
ggcggcctggagcgctgatc

SEQ ID NO: 28008 - DNA, 20 bp, human
gagttcttcaccccttccag

SEQ ID NO: 28009 - DNA, 20 bp, human
gtacatgagccaccacaagg

SEQ ID NO: 28010 - DNA, 20 bp, human
ggactctaactccctcaggg

SEQ ID NO: 28011 - DNA, 20 bp, human
ggtcgactctaactccctca

SEQ ID NO: 28012 - DNA, 20 bp, human
ggacaagacgaagttcctct

SEQ ID NO: 28013 - DNA, 20 bp, human
ggctaagggctcgagccagg

SEQ ID NO: 28014 - DNA, 20 bp, human
gcgcggagccggtgagtcgg

SEQ ID NO: 28015 - DNA, 20 bp, human
gcaattccctggccaccctg

SEQ ID NO: 28016 - DNA, 20 bp, human
ggacaaatccaagaatccag

SEQ ID NO: 28017 - DNA, 20 bp, human
gttggtcctgctgtagtaat

SEQ ID NO: 28018 - DNA, 20 bp, human
gagttcttaaacttggtaag

SEQ ID NO: 28019 - DNA, 20 bp, human
gtggcgtggatcatcttatt

SEQ ID NO: 28020 - DNA, 20 bp, human
gaattctcagcctctccgcc

SEQ ID NO: 28021 - DNA, 20 bp, human
ggccaacacctcccctttac

SEQ ID NO: 28022 - DNA, 20 bp, human
gcaatattttgagggtagga

SEQ ID NO: 28023 - DNA, 20 bp, human
gatgctttgaattggcaatc

SEQ ID NO: 28024 - DNA, 20 bp, human
gtaaaacctattactacagc

SEQ ID NO: 28025 - DNA, 20 bp, human
gtccagcaatcttcaaactc

SEQ ID NO: 28026 - DNA, 20 bp, human
gcacatgccgtggagcctta

SEQ ID NO: 28027 - DNA, 20 bp, human
ggacaggcagtaggcgtcag

SEQ ID NO: 28028 - DNA, 20 bp, human
gggggcgccctaaggctcca

SEQ ID NO: 28029 - DNA, 20 bp, human
gctcctagggcaggccaatg

SEQ ID NO: 28030 - DNA, 20 bp, human
gagactcacagggttgactt

SEQ ID NO: 28031 - DNA, 20 bp, human
gctcaaggcacaggacagag

SEQ ID NO: 28032 - DNA, 20 bp, human
gaggccccagcagactcaca

SEQ ID NO: 28033 - DNA, 20 bp, human
gtcacagggttgacttggga

SEQ ID NO: 28034 - DNA, 20 bp, human
gctcgatgtcccagcaatac

SEQ ID NO: 28035 - DNA, 20 bp, human
gtaatcatttggtccaggac

SEQ ID NO: 28036 - DNA, 20 bp, human
ggcccagagtccctaccctt

SEQ ID NO: 28037 - DNA, 20 bp, human
gtcggagaaccagcgaaccc

SEQ ID NO: 28038 - DNA, 20 bp, human
gtctccagcgaggccttcag

SEQ ID NO: 28039 - DNA, 20 bp, human
gggcggggcagtgaccgggt

SEQ ID NO: 28040 - DNA, 20 bp, human
ggacggccctggtggtgaag

SEQ ID NO: 28041 - DNA, 20 bp, human
gcgcgtcccaacggctcccg

SEQ ID NO: 28042 - DNA, 20 bp, human
gcctggtggtgaagaggcga

SEQ ID NO: 28043 - DNA, 20 bp, human
ggtgcagctgggttaaagga

SEQ ID NO: 28044 - DNA, 20 bp, human
gccagaaggagcacggggaa

SEQ ID NO: 28045 - DNA, 20 bp, human
gggaagcctcggacacaact

SEQ ID NO: 28046 - DNA, 20 bp, human
ggctctggcagaagcaacgg

SEQ ID NO: 28047 - DNA, 20 bp, human
gcggtggcttcgagggatgg

SEQ ID NO: 28048 - DNA, 20 bp, human
ggaagcaacggtggcttcga

SEQ ID NO: 28049 - DNA, 20 bp, human
ggaggcgcgtcagccagggg

SEQ ID NO: 28050 - DNA, 20 bp, human
gccatgttcccaataaatgg

SEQ ID NO: 28051 - DNA, 20 bp, human
ggcggacacgcagtaaccac

SEQ ID NO: 28052 - DNA, 20 bp, human
gaggagtctgaggtaacgcg

SEQ ID NO: 28053 - DNA, 20 bp, human
ggcagtaaccacaggaccct

SEQ ID NO: 28054 - DNA, 20 bp, human
gtaatccactgcggcgttag

SEQ ID NO: 28055 - DNA, 20 bp, human
gctcacctctaacgccgcag

SEQ ID NO: 28056 - DNA, 20 bp, human
ggttagagaggcccggatgg

SEQ ID NO: 28057 - DNA, 20 bp, human
ggcctctgcgtcctccatcc

SEQ ID NO: 28058 - DNA, 20 bp, human
gacaggcaagagggatatag

SEQ ID NO: 28059 - DNA, 20 bp, human
gggtccaccgagtctggcac

SEQ ID NO: 28060 - DNA, 20 bp, human
ggtccgaggtccaccgagtc

SEQ ID NO: 28061 - DNA, 20 bp, human
gtggcactggtggggaagtc

SEQ ID NO: 28062 - DNA, 20 bp, human
gggtggacctcggactccag

SEQ ID NO: 28063 - DNA, 20 bp, human
gatgcggagatgttaatggt

SEQ ID NO: 28064 - DNA, 20 bp, human
gacgtctggtatagctggga

SEQ ID NO: 28065 - DNA, 20 bp, human
gtctcgtagttagagaggcc

SEQ ID NO: 28066 - DNA, 20 bp, human
gagagcggcgcactgactca

SEQ ID NO: 28067 - DNA, 20 bp, human
gcagcgagctcggggatcaa

SEQ ID NO: 28068 - DNA, 20 bp, human
gtgaacggtgagcaggtcgg

SEQ ID NO: 28069 - DNA, 20 bp, human
ggacaggacctgacagcacg

SEQ ID NO: 28070 - DNA, 20 bp, human
gggcgcactgactcaaggca

SEQ ID NO: 28071 - DNA, 20 bp, human
gcacgacccggggtcactcg

SEQ ID NO: 28072 - DNA, 20 bp, human
gctggtaccaggcaagggtc

SEQ ID NO: 28073 - DNA, 20 bp, human
ggagcaggtcgggggtacgg

SEQ ID NO: 28074 - DNA, 20 bp, human
ggctctccagcccgcttgaa

SEQ ID NO: 28075 - DNA, 20 bp, human
gaaagcccaggagcacgagc

SEQ ID NO: 28076 - DNA, 20 bp, human
gtcccggatgtgggcttcgg

SEQ ID NO: 28077 - DNA, 20 bp, human
gctccgacacggctccacca

SEQ ID NO: 28078 - DNA, 20 bp, human
ggaccgggtccgagaaagtg

SEQ ID NO: 28079 - DNA, 20 bp, human
gtccctgacaccgacatcag

SEQ ID NO: 28080 - DNA, 20 bp, human
gagagtgtcacgggtcgtgt

SEQ ID NO: 28081 - DNA, 20 bp, human
gcgcggtccacagagtgtca

SEQ ID NO: 28082 - DNA, 20 bp, human
gctggcgcagcgaatggatg

SEQ ID NO: 28083 - DNA, 20 bp, human
gggaccgcgagcacggagca

SEQ ID NO: 28084 - DNA, 20 bp, human
gggagccgtgtcggagtcgg

SEQ ID NO: 28085 - DNA, 20 bp, human
gcccggaaccctgtaatctg

SEQ ID NO: 28086 - DNA, 20 bp, human
gcggccccgcccaggacgag

SEQ ID NO: 28087 - DNA, 20 bp, human
ggccgcagtgggaaaaccct

SEQ ID NO: 28088 - DNA, 20 bp, human
ggcccaccgcccctcgtcct

SEQ ID NO: 28089 - DNA, 20 bp, human
gaggcttccgcccgcaggag

SEQ ID NO: 28090 - DNA, 20 bp, human
gcaccgcccctcgtcctggg

SEQ ID NO: 28091 - DNA, 20 bp, human
ggcacgcgcggccgctcctg

SEQ ID NO: 28092 - DNA, 20 bp, human
gcgcgcgtgcgcagagagga

SEQ ID NO: 28093 - DNA, 20 bp, human
gcagcgcggaaccgtcctaa

SEQ ID NO: 28094 - DNA, 20 bp, human
gcagcgctgggtccagtggt

SEQ ID NO: 28095 - DNA, 20 bp, human
gtgagacccagagggcgccc

SEQ ID NO: 28096 - DNA, 20 bp, human
gcgggccgcaggtcagagtg

SEQ ID NO: 28097 - DNA, 20 bp, human
gggagtgtccggaatggtgg

SEQ ID NO: 28098 - DNA, 20 bp, human
ggtccccggctcggacctac

SEQ ID NO: 28099 - DNA, 20 bp, human
gtcccagccgaggggaccag

SEQ ID NO: 28100 - DNA, 20 bp, human
gttacgggcactgctccaag

SEQ ID NO: 28101 - DNA, 20 bp, human
gccgcaggtcagagtgcggg

SEQ ID NO: 28102 - DNA, 20 bp, human
gggaaatcacccgagtcgtg

SEQ ID NO: 28103 - DNA, 20 bp, human
gttgcaggtggcgatgttac

SEQ ID NO: 28104 - DNA, 20 bp, human
ggagaccaggataggatctc

SEQ ID NO: 28105 - DNA, 20 bp, human
gtaggatctcgggagttacc

SEQ ID NO: 28106 - DNA, 20 bp, human
gggtgtgtggaggagcccac

SEQ ID NO: 28107 - DNA, 20 bp, human
ggctcaggataccagactcg

SEQ ID NO: 28108 - DNA, 20 bp, human
ggcccaatcccagggagtga

SEQ ID NO: 28109 - DNA, 20 bp, human
ggttgagcgctgctgctccg

SEQ ID NO: 28110 - DNA, 20 bp, human
gcccgtcactccctgggatt

SEQ ID NO: 28111 - DNA, 20 bp, human
ggagcgctgctgctccgcgg

SEQ ID NO: 28112 - DNA, 20 bp, human
ggatgtgctgggggaccgag

SEQ ID NO: 28113 - DNA, 20 bp, human
gagtagaacaccatgatccc

SEQ ID NO: 28114 - DNA, 20 bp, human
gagacgtcccgtcactccct

SEQ ID NO: 28115 - DNA, 20 bp, human
gcaggataccagactcgcgg

SEQ ID NO: 28116 - DNA, 20 bp, human
gggaggccagcccatctcag

SEQ ID NO: 28117 - DNA, 20 bp, human
gaggctgaagagagatccac

SEQ ID NO: 28118 - DNA, 20 bp, human
ggcctcgaacatgaacctgc

SEQ ID NO: 28119 - DNA, 20 bp, human
gccacaggccttctggtgat

SEQ ID NO: 28120 - DNA, 20 bp, human
gtgtgggctgacagctctat

SEQ ID NO: 28121 - DNA, 20 bp, human
ggacggtatggggtcccggg

SEQ ID NO: 28122 - DNA, 20 bp, human
gatgctctggaggagcacca

SEQ ID NO: 28123 - DNA, 20 bp, human
gcctgcctggaatccccctt

SEQ ID NO: 28124 - DNA, 20 bp, human
ggttaccaaagggggattcc

SEQ ID NO: 28125 - DNA, 20 bp, human
gttggtaacccatcaccaga

SEQ ID NO: 28126 - DNA, 20 bp, human
gagagccccggtcacatccc

SEQ ID NO: 28127 - DNA, 20 bp, human
gcgggtcccgggatgtgacc

SEQ ID NO: 28128 - DNA, 20 bp, human
gccgtaaacaaacggagctg

SEQ ID NO: 28129 - DNA, 20 bp, human
gcagcagtgaccagagtggt

SEQ ID NO: 28130 - DNA, 20 bp, human
gtaaacaaacggagctgcgg

SEQ ID NO: 28131 - DNA, 20 bp, human
ggtcactgctgggtactggg

SEQ ID NO: 28132 - DNA, 20 bp, human
gtggtgggaagggcctaaag

SEQ ID NO: 28133 - DNA, 20 bp, human
ggcttccgcttggggcatgg

SEQ ID NO: 28134 - DNA, 20 bp, human
ggcctccaagcagtaccact

SEQ ID NO: 28135 - DNA, 20 bp, human
gtgtcaagagggatgcccag

SEQ ID NO: 28136 - DNA, 20 bp, human
gtggtgttcccgggaggaga

SEQ ID NO: 28137 - DNA, 20 bp, human
gcacccgcagaccccgtcag

SEQ ID NO: 28138 - DNA, 20 bp, human
gcgccccccaagcctccggt

SEQ ID NO: 28139 - DNA, 20 bp, human
gcctggaatgagacccccag

SEQ ID NO: 28140 - DNA, 20 bp, human
ggtcaagctgctgcacggag

SEQ ID NO: 28141 - DNA, 20 bp, human
gcaggtcagtagccccctga

SEQ ID NO: 28142 - DNA, 20 bp, human
gtcgaattctgggactgggg

SEQ ID NO: 28143 - DNA, 20 bp, human
gtagctggctgccactgacg

SEQ ID NO: 28144 - DNA, 20 bp, human
gggcttgggaaatagatccc

SEQ ID NO: 28145 - DNA, 20 bp, human
gacccggtggtgttcccggg

SEQ ID NO: 28146 - DNA, 20 bp, human
gcacctcatctatacggtag

SEQ ID NO: 28147 - DNA, 20 bp, human
gacacttgaaggaccttcta

SEQ ID NO: 28148 - DNA, 20 bp, human
ggtgtctgctgctgggatcg

SEQ ID NO: 28149 - DNA, 20 bp, human
ggcagaaggggaattaggtt

SEQ ID NO: 28150 - DNA, 20 bp, human
gtcaggggtctgctccagaa

SEQ ID NO: 28151 - DNA, 20 bp, human
gttcaggcagaaggggaatt

SEQ ID NO: 28152 - DNA, 20 bp, human
gattgcttaggaactaaagg

SEQ ID NO: 28153 - DNA, 20 bp, human
ggcgggccaagttcaagagg

SEQ ID NO: 28154 - DNA, 20 bp, human
ggaggtgggtacagaaggga

SEQ ID NO: 28155 - DNA, 20 bp, human
ggtgagctctgagttctcag

SEQ ID NO: 28156 - DNA, 20 bp, human
gccctgggcgctcggctgct

SEQ ID NO: 28157 - DNA, 20 bp, human
ggcagctggcaggcgcgcgc

SEQ ID NO: 28158 - DNA, 20 bp, human
gagccccgtggcggagacag

SEQ ID NO: 28159 - DNA, 20 bp, human
gctgccagctgccctccgag

SEQ ID NO: 28160 - DNA, 20 bp, human
gggcatgccgagccccgtgg

SEQ ID NO: 28161 - DNA, 20 bp, human
gtagtcctggaccacggtgt

SEQ ID NO: 28162 - DNA, 20 bp, human
gtgctgtgcgaccaggcgtg

SEQ ID NO: 28163 - DNA, 20 bp, human
gtcaggggcctccactcgga

SEQ ID NO: 28164 - DNA, 20 bp, human
gggttgagcctggagccggc

SEQ ID NO: 28165 - DNA, 20 bp, human
gcacgagaagtagcccaggc

SEQ ID NO: 28166 - DNA, 20 bp, human
gcactacgaagtccacggag

SEQ ID NO: 28167 - DNA, 20 bp, human
gatgacgcccaggtctccgt

SEQ ID NO: 28168 - DNA, 20 bp, human
gtgctagctgcaggtgccta

SEQ ID NO: 28169 - DNA, 20 bp, human
gtcgggcgttgtctgtccag

SEQ ID NO: 28170 - DNA, 20 bp, human
gcaggccactacgaagtcca

SEQ ID NO: 28171 - DNA, 20 bp, human
gcaggtgcctacggagacct

SEQ ID NO: 28172 - DNA, 20 bp, human
gttcgcgggcctacacgtag

SEQ ID NO: 28173 - DNA, 20 bp, human
gcatcctcagcgaggtaggt

SEQ ID NO: 28174 - DNA, 20 bp, human
gagaaaggccgggccaggag

SEQ ID NO: 28175 - DNA, 20 bp, human
gagggtgccgcgagcgtccc

SEQ ID NO: 28176 - DNA, 20 bp, human
gctggcagttggtctctcag

SEQ ID NO: 28177 - DNA, 20 bp, human
ggcccaaaggtatgaagtag

SEQ ID NO: 28178 - DNA, 20 bp, human
gagagagcctcaggagaact

SEQ ID NO: 28179 - DNA, 20 bp, human
gctctctggggtcccagaaa

SEQ ID NO: 28180 - DNA, 20 bp, human
gtcaggccccctgaatgcca

SEQ ID NO: 28181 - DNA, 20 bp, human
ggggtcccagaaagggactc

SEQ ID NO: 28182 - DNA, 20 bp, human
gagcagggatgcagagaccc

SEQ ID NO: 28183 - DNA, 20 bp, human
gtcagtggccatggcattca

SEQ ID NO: 28184 - DNA, 20 bp, human
gaaaggtatgaagtaggggt

SEQ ID NO: 28185 - DNA, 20 bp, human
gttctctgctgacagtctca

SEQ ID NO: 28186 - DNA, 20 bp, human
gctaggacggtggagagatg

SEQ ID NO: 28187 - DNA, 20 bp, human
gactcttggcacacctagga

SEQ ID NO: 28188 - DNA, 20 bp, human
gcttggcacacctaggacgg

SEQ ID NO: 28189 - DNA, 20 bp, human
ggaggtcaatgtggtctcag

SEQ ID NO: 28190 - DNA, 20 bp, human
gattgactcttggcacacct

SEQ ID NO: 28191 - DNA, 20 bp, human
gcaatgaggcaattgactct

SEQ ID NO: 28192 - DNA, 20 bp, human
gacgcccaggccagctgtct

SEQ ID NO: 28193 - DNA, 20 bp, human
gcccccacatccaggcccca

SEQ ID NO: 28194 - DNA, 20 bp, human
gggcgtcttggagtccttat

SEQ ID NO: 28195 - DNA, 20 bp, human
gtgggtagtagacagtatgg

SEQ ID NO: 28196 - DNA, 20 bp, human
gtcagcagagaaaccggcgt

SEQ ID NO: 28197 - DNA, 20 bp, human
ggcgccccgccgcccacatc

SEQ ID NO: 28198 - DNA, 20 bp, human
gtggcccgccaagttcaaac

SEQ ID NO: 28199 - DNA, 20 bp, human
ggagaaaccggcgtaggaag

SEQ ID NO: 28200 - DNA, 20 bp, human
ggaacttggcgggccagatg

SEQ ID NO: 28201 - DNA, 20 bp, human
gggtgcgccaggtaaacccg

SEQ ID NO: 28202 - DNA, 20 bp, human
gggcaggaggatgttagaag

SEQ ID NO: 28203 - DNA, 20 bp, human
ggggtacttaagagggtcta

SEQ ID NO: 28204 - DNA, 20 bp, human
ggagaggaatggagttacag

SEQ ID NO: 28205 - DNA, 20 bp, human
gggaaagcgcgtccccgccg

SEQ ID NO: 28206 - DNA, 20 bp, human
gtcagaagaggacctggggg

SEQ ID NO: 28207 - DNA, 20 bp, human
gccacctcgaagccacgtca

SEQ ID NO: 28208 - DNA, 20 bp, human
gctggcacgcgcccgacctg

SEQ ID NO: 28209 - DNA, 20 bp, human
ggccgcgcgtgccgttgcag

SEQ ID NO: 28210 - DNA, 20 bp, human
gacctggggctgccctgacg

SEQ ID NO: 28211 - DNA, 20 bp, human
gcgtcccgctgcctctgcaa

SEQ ID NO: 28212 - DNA, 20 bp, human
gctgccctgacgtggcttcg

SEQ ID NO: 28213 - DNA, 20 bp, human
gccgctctggctcttgaagg

SEQ ID NO: 28214 - DNA, 20 bp, human
gcagagcggccatcgccata

SEQ ID NO: 28215 - DNA, 20 bp, human
gcatcgccatagggaaagaa

SEQ ID NO: 28216 - DNA, 20 bp, human
ggaggcttcggagcgagccg

SEQ ID NO: 28217 - DNA, 20 bp, human
ggagcgagccggggcagtcg

SEQ ID NO: 28218 - DNA, 20 bp, human
ggctgagaactgcagcgcgg

SEQ ID NO: 28219 - DNA, 20 bp, human
gcgaggtgcacagggatggt

SEQ ID NO: 28220 - DNA, 20 bp, human
gcggggcagtcggggtcggt

SEQ ID NO: 28221 - DNA, 20 bp, human
gcccaggctcacccaatagg

SEQ ID NO: 28222 - DNA, 20 bp, human
gagcaggaatgcggcaggaa

SEQ ID NO: 28223 - DNA, 20 bp, human
gaactgcagcgcggaggctt

SEQ ID NO: 28224 - DNA, 20 bp, human
gctcgcggtccggggagagg

SEQ ID NO: 28225 - DNA, 20 bp, human
gggtgtccaaagtcacagtc

SEQ ID NO: 28226 - DNA, 20 bp, human
gggccaccggcaggactcag

SEQ ID NO: 28227 - DNA, 20 bp, human
ggacggtccctgagatgacc

SEQ ID NO: 28228 - DNA, 20 bp, human
gtccgggatcagctaccaga

SEQ ID NO: 28229 - DNA, 20 bp, human
gaccgtctggtagctgatcc

SEQ ID NO: 28230 - DNA, 20 bp, human
gccggttcccggtcatctca

SEQ ID NO: 28231 - DNA, 20 bp, human
ggagatagcgctcctggaga

SEQ ID NO: 28232 - DNA, 20 bp, human
gccctcggcgcgaggcgaca

SEQ ID NO: 28233 - DNA, 20 bp, human
gaggatagagccgagactgg

SEQ ID NO: 28234 - DNA, 20 bp, human
ggtggaagcgcgtcaagggt

SEQ ID NO: 28235 - DNA, 20 bp, human
gccagacacagctgaggggt

SEQ ID NO: 28236 - DNA, 20 bp, human
gggacgcgggaaggttgcta

SEQ ID NO: 28237 - DNA, 20 bp, human
ggctcacccgctgtacaaga

SEQ ID NO: 28238 - DNA, 20 bp, human
ggatccgccttcttgtacag

SEQ ID NO: 28239 - DNA, 20 bp, human
gaggtgcctgggcttgacgc

SEQ ID NO: 28240 - DNA, 20 bp, human
gcagcacccgcgtcaagccc

SEQ ID NO: 28241 - DNA, 20 bp, human
ggctcccccggcaattgccg

SEQ ID NO: 28242 - DNA, 20 bp, human
gaaataggcagagagggtaa

SEQ ID NO: 28243 - DNA, 20 bp, human
gaaggttgctagggctcccc

SEQ ID NO: 28244 - DNA, 20 bp, human
gaggcacctgcacagtgccg

SEQ ID NO: 28245 - DNA, 20 bp, human
gagcagagagagcctgttgg

SEQ ID NO: 28246 - DNA, 20 bp, human
ggacgctgtcaacatccggc

SEQ ID NO: 28247 - DNA, 20 bp, human
ggcctagcaacgggaaatgg

SEQ ID NO: 28248 - DNA, 20 bp, human
gggccccggagcaaggtcag

SEQ ID NO: 28249 - DNA, 20 bp, human
ggccggtaagccgggccgag

SEQ ID NO: 28250 - DNA, 20 bp, human
ggggaaatggcggaaccggg

SEQ ID NO: 28251 - DNA, 20 bp, human
ggcagtcctcctaagagtag

SEQ ID NO: 28252 - DNA, 20 bp, human
ggtcgcctagcaacgggaaa

SEQ ID NO: 28253 - DNA, 20 bp, human
gtgacagcgtcgcctagcaa

SEQ ID NO: 28254 - DNA, 20 bp, human
gggtgaggggctgaacgcag

SEQ ID NO: 28255 - DNA, 20 bp, human
gggccacctggagcggtgaa

SEQ ID NO: 28256 - DNA, 20 bp, human
gcgtggaccgggatcctcag

SEQ ID NO: 28257 - DNA, 20 bp, human
gcggtccacgcggaggagtg

SEQ ID NO: 28258 - DNA, 20 bp, human
gaggatcccggtccacgcgg

SEQ ID NO: 28259 - DNA, 20 bp, human
gtatcccgggagaggtccga

SEQ ID NO: 28260 - DNA, 20 bp, human
gggccatacgtcagcacgtg

SEQ ID NO: 28261 - DNA, 20 bp, human
gcatacgtcagcacgtgggg

SEQ ID NO: 28262 - DNA, 20 bp, human
gaccgggatcctcaggggtg

SEQ ID NO: 28263 - DNA, 20 bp, human
gccgccctcggacctctccc

SEQ ID NO: 28264 - DNA, 20 bp, human
ggccgcacccctgaggatcc

SEQ ID NO: 28265 - DNA, 20 bp, human
ggggtggcgccgcacccctg

SEQ ID NO: 28266 - DNA, 20 bp, human
gaggtggctggagacaggtt

SEQ ID NO: 28267 - DNA, 20 bp, human
gggctcaggacgatgtgctg

SEQ ID NO: 28268 - DNA, 20 bp, human
gacagaaggtggctggagac

SEQ ID NO: 28269 - DNA, 20 bp, human
gtttgagactccacagaagg

SEQ ID NO: 28270 - DNA, 20 bp, human
gacgtgccggccacagaacc

SEQ ID NO: 28271 - DNA, 20 bp, human
gagactccacagaaggtggc

SEQ ID NO: 28272 - DNA, 20 bp, human
gtacagggtcccacagatga

SEQ ID NO: 28273 - DNA, 20 bp, human
gtactgcagccggaagtact

SEQ ID NO: 28274 - DNA, 20 bp, human
ggagtttgagactccacaga

SEQ ID NO: 28275 - DNA, 20 bp, human
gtcactgccaccatgagtct

SEQ ID NO: 28276 - DNA, 20 bp, human
gcaagcttaggagaccctgg

SEQ ID NO: 28277 - DNA, 20 bp, human
gggttctgtggagcgtggtg

SEQ ID NO: 28278 - DNA, 20 bp, human
gggcaaccagagcctgctgg

SEQ ID NO: 28279 - DNA, 20 bp, human
gcacgctccacagaaccccc

SEQ ID NO: 28280 - DNA, 20 bp, human
gaaggagggcgggaatgcgt

SEQ ID NO: 28281 - DNA, 20 bp, human
gcccacccctagctgacatc

SEQ ID NO: 28282 - DNA, 20 bp, human
gtcagccggatgtcagctag

SEQ ID NO: 28283 - DNA, 20 bp, human
ggaggatcagagagaaaccg

SEQ ID NO: 28284 - DNA, 20 bp, human
ggctggtggaaagaaagctg

SEQ ID NO: 28285 - DNA, 20 bp, human
gctacgtgagtgggacgtag

SEQ ID NO: 28286 - DNA, 20 bp, human
gcccctggcgaaggcgatgg

SEQ ID NO: 28287 - DNA, 20 bp, human
gatggcggcgcccagcgaag

SEQ ID NO: 28288 - DNA, 20 bp, human
gactgcggtaggcgccctag

SEQ ID NO: 28289 - DNA, 20 bp, human
gtagcccctggcgaaggcga

SEQ ID NO: 28290 - DNA, 20 bp, human
gttgctccccaaccaggtgt

SEQ ID NO: 28291 - DNA, 20 bp, human
gctatcgcggccacttcgct

SEQ ID NO: 28292 - DNA, 20 bp, human
gagggtcctgcaagccccta

SEQ ID NO: 28293 - DNA, 20 bp, human
gccttcgccaggggctatcg

SEQ ID NO: 28294 - DNA, 20 bp, human
gaagtggccgcgatagcccc

SEQ ID NO: 28295 - DNA, 20 bp, human
gcgcggcccgtcaggcactg

SEQ ID NO: 28296 - DNA, 20 bp, human
gggttctggctgcgtcctag

SEQ ID NO: 28297 - DNA, 20 bp, human
gtcgcattctacgtaacgga

SEQ ID NO: 28298 - DNA, 20 bp, human
gtgcgtcctagaggcatccg

SEQ ID NO: 28299 - DNA, 20 bp, human
ggcgcggcgtgactgagcta

SEQ ID NO: 28300 - DNA, 20 bp, human
ggcggaggctacgtgaagag

SEQ ID NO: 28301 - DNA, 20 bp, human
gggctacgtgaagagaggcg

SEQ ID NO: 28302 - DNA, 20 bp, human
gcgtgactgagctacggttc

SEQ ID NO: 28303 - DNA, 20 bp, human
ggccgcctccgcgatcgcag

SEQ ID NO: 28304 - DNA, 20 bp, human
gtactgccccggatgcctct

SEQ ID NO: 28305 - DNA, 20 bp, human
gtcttgggtggggagaaact

SEQ ID NO: 28306 - DNA, 20 bp, human
gcgaggttctctcaggtcag

SEQ ID NO: 28307 - DNA, 20 bp, human
gggagcccggaaatggaccg

SEQ ID NO: 28308 - DNA, 20 bp, human
ggtccagtacggagggagag

SEQ ID NO: 28309 - DNA, 20 bp, human
gggaccggggccgtccagta

SEQ ID NO: 28310 - DNA, 20 bp, human
gagggccgcgggagccgaaa

SEQ ID NO: 28311 - DNA, 20 bp, human
gcccagcccgaggttctctc

SEQ ID NO: 28312 - DNA, 20 bp, human
gacggccccggtccatttcc

SEQ ID NO: 28313 - DNA, 20 bp, human
gtccgggcaaggccaacgca

SEQ ID NO: 28314 - DNA, 20 bp, human
gcggggccgtccagtacgga

SEQ ID NO: 28315 - DNA, 20 bp, human
gcgcaggccggagaacggag

SEQ ID NO: 28316 - DNA, 20 bp, human
ggggagattaggcggggaga

SEQ ID NO: 28317 - DNA, 20 bp, human
gtgcgcgggaagagcactgc

SEQ ID NO: 28318 - DNA, 20 bp, human
gagggtagaatcggaaccgt

SEQ ID NO: 28319 - DNA, 20 bp, human
ggcactgcaggtagacagca

SEQ ID NO: 28320 - DNA, 20 bp, human
gtgtcctgccagggtagaat

SEQ ID NO: 28321 - DNA, 20 bp, human
gagaatcggaaccgtaggag

SEQ ID NO: 28322 - DNA, 20 bp, human
gtcgggccacgccaggtacg

SEQ ID NO: 28323 - DNA, 20 bp, human
gcgcgcacggccacaggcct

SEQ ID NO: 28324 - DNA, 20 bp, human
gaggtcagaggtcaactgag

SEQ ID NO: 28325 - DNA, 20 bp, human
gggaggggtacttaaccgga

SEQ ID NO: 28326 - DNA, 20 bp, human
gaagttgagacgtgattacc

SEQ ID NO: 28327 - DNA, 20 bp, human
gccaccgcccgctgaggaga

SEQ ID NO: 28328 - DNA, 20 bp, human
ggaacaggctctagactcac

SEQ ID NO: 28329 - DNA, 20 bp, human
ggggtgtccgaagatgacag

SEQ ID NO: 28330 - DNA, 20 bp, human
gtgggggctgaataagaggt

SEQ ID NO: 28331 - DNA, 20 bp, human
gccgaggccgtgacagggtg

SEQ ID NO: 28332 - DNA, 20 bp, human
gcatccatctcctcagcggg

SEQ ID NO: 28333 - DNA, 20 bp, human
gccccacaggcctgtcacaa

SEQ ID NO: 28334 - DNA, 20 bp, human
gatcttgggggctgaataag

SEQ ID NO: 28335 - DNA, 20 bp, human
gccggaggcgggcacttggg

SEQ ID NO: 28336 - DNA, 20 bp, human
gtttcacagagctctctggt

SEQ ID NO: 28337 - DNA, 20 bp, human
gattatttcacagagctctc

SEQ ID NO: 28338 - DNA, 20 bp, human
gtctaagatgttatcaggaa

SEQ ID NO: 28339 - DNA, 20 bp, human
gctaacagtgtctattgctg

SEQ ID NO: 28340 - DNA, 20 bp, human
gtgttggaaaacagaatcac

SEQ ID NO: 28341 - DNA, 20 bp, human
gcatggtgaaacaagaggca

SEQ ID NO: 28342 - DNA, 20 bp, human
gttaccacaaatgtaagatt

SEQ ID NO: 28343 - DNA, 20 bp, human
ggaaataatagtcaactgca

SEQ ID NO: 28344 - DNA, 20 bp, human
gcatatgataccaaaagtcc

SEQ ID NO: 28345 - DNA, 20 bp, human
ggggatatccagttgaatct

SEQ ID NO: 28346 - DNA, 20 bp, human
gggtcgctgtggcaacgcgg

SEQ ID NO: 28347 - DNA, 20 bp, human
gcccggtcgctgtggcaacg

SEQ ID NO: 28348 - DNA, 20 bp, human
gcggacgcggccgactgacc

SEQ ID NO: 28349 - DNA, 20 bp, human
gccacagcgaccgggtcagt

SEQ ID NO: 28350 - DNA, 20 bp, human
gcaccgagcgcagccggacg

SEQ ID NO: 28351 - DNA, 20 bp, human
ggcgctgctggcgggcgtta

SEQ ID NO: 28352 - DNA, 20 bp, human
ggcctccgcgaggggatccc

SEQ ID NO: 28353 - DNA, 20 bp, human
ggttccgccgccggcaagga

SEQ ID NO: 28354 - DNA, 20 bp, human
gcagccccgggagaattccc

SEQ ID NO: 28355 - DNA, 20 bp, human
gacaggaagagtggtcggag

SEQ ID NO: 28356 - DNA, 20 bp, human
gtcgccgagttccaggtgat

SEQ ID NO: 28357 - DNA, 20 bp, human
ggccaatcaccgcggagcaa

SEQ ID NO: 28358 - DNA, 20 bp, human
gagccattggaggtcatggg

SEQ ID NO: 28359 - DNA, 20 bp, human
gtgaggaaaaccccatcacc

SEQ ID NO: 28360 - DNA, 20 bp, human
gagcgaggctgctctgtagg

SEQ ID NO: 28361 - DNA, 20 bp, human
gctgctctgtaggaggaggg

SEQ ID NO: 28362 - DNA, 20 bp, human
gaggctgctctgtaggagga

SEQ ID NO: 28363 - DNA, 20 bp, human
gggcacatgcctgccacatg

SEQ ID NO: 28364 - DNA, 20 bp, human
gaaccccatcacctggaact

SEQ ID NO: 28365 - DNA, 20 bp, human
ggccatattggacaaacacg

SEQ ID NO: 28366 - DNA, 20 bp, human
gggtgaggcggtccgcgaag

SEQ ID NO: 28367 - DNA, 20 bp, human
gcagccagcactgtctccgg

SEQ ID NO: 28368 - DNA, 20 bp, human
gtcagagacgcgccccctag

SEQ ID NO: 28369 - DNA, 20 bp, human
ggcgcagccagcactgtctc

SEQ ID NO: 28370 - DNA, 20 bp, human
gcacgcgcctcaataccacc

SEQ ID NO: 28371 - DNA, 20 bp, human
gaagtcagcgtcggagacgg

SEQ ID NO: 28372 - DNA, 20 bp, human
gtagtcggctgcaatggcgc

SEQ ID NO: 28373 - DNA, 20 bp, human
gttgccaccggagacagtgc

SEQ ID NO: 28374 - DNA, 20 bp, human
gcctcggagggtgagcgtca

SEQ ID NO: 28375 - DNA, 20 bp, human
ggagctggtcgacttgccac

SEQ ID NO: 28376 - DNA, 20 bp, human
gcagcgagagcgacacggac

SEQ ID NO: 28377 - DNA, 20 bp, human
gcttgggcagtattgcactg

SEQ ID NO: 28378 - DNA, 20 bp, human
gggccgggctgcgaatgagt

SEQ ID NO: 28379 - DNA, 20 bp, human
gccagggcgcagactcggag

SEQ ID NO: 28380 - DNA, 20 bp, human
gaatctggggaagacttggg

SEQ ID NO: 28381 - DNA, 20 bp, human
ggcggcggcgagagaaagag

SEQ ID NO: 28382 - DNA, 20 bp, human
ggcactcacgatggtcacgc

SEQ ID NO: 28383 - DNA, 20 bp, human
ggcggcggtgggaagtcggg

SEQ ID NO: 28384 - DNA, 20 bp, human
ggtgggcgccgggcgagcac

SEQ ID NO: 28385 - DNA, 20 bp, human
gtggcaccagggcgcagact

SEQ ID NO: 28386 - DNA, 20 bp, human
gcgagagcggccgagaacta

SEQ ID NO: 28387 - DNA, 20 bp, human
ggagcggccgagaactaagg

SEQ ID NO: 28388 - DNA, 20 bp, human
gctaaggcggccccaacgag

SEQ ID NO: 28389 - DNA, 20 bp, human
ggatcgccatcctccgagag

SEQ ID NO: 28390 - DNA, 20 bp, human
gatcgcactgcggggaaagt

SEQ ID NO: 28391 - DNA, 20 bp, human
gggataaggaagtccgggta

SEQ ID NO: 28392 - DNA, 20 bp, human
ggtgagaggggtcccatgga

SEQ ID NO: 28393 - DNA, 20 bp, human
gagcctgtgcccccaagaca

SEQ ID NO: 28394 - DNA, 20 bp, human
gaagtgtgagaggggtccca

SEQ ID NO: 28395 - DNA, 20 bp, human
gggcacaggctaaaacctga

SEQ ID NO: 28396 - DNA, 20 bp, human
gggagggttgctagtggaga

SEQ ID NO: 28397 - DNA, 20 bp, human
gtcgcgaggagggttgctag

SEQ ID NO: 28398 - DNA, 20 bp, human
ggttgaaccgctcgcgagga

SEQ ID NO: 28399 - DNA, 20 bp, human
gtgatttgggtgaaagtcgt

SEQ ID NO: 28400 - DNA, 20 bp, human
gcgcgcaaccgccactcccg

SEQ ID NO: 28401 - DNA, 20 bp, human
gggagaaggtgagaggccgc

SEQ ID NO: 28402 - DNA, 20 bp, human
gccacctaagacctccacca

SEQ ID NO: 28403 - DNA, 20 bp, human
ggcgagaacgccggatcctg

SEQ ID NO: 28404 - DNA, 20 bp, human
gaaacgccacaggcataata

SEQ ID NO: 28405 - DNA, 20 bp, human
gggagggtgccctttaacaa

SEQ ID NO: 28406 - DNA, 20 bp, human
gggctgcggcccggaaaccc

SEQ ID NO: 28407 - DNA, 20 bp, human
ggaaactgggggctcccaag

SEQ ID NO: 28408 - DNA, 20 bp, human
gaggctgccggagggttcat

SEQ ID NO: 28409 - DNA, 20 bp, human
gccacaccgggcttctccgg

SEQ ID NO: 28410 - DNA, 20 bp, human
gctggaaggcctgaaagaac

SEQ ID NO: 28411 - DNA, 20 bp, human
ggaaacacctatgaaccctc

SEQ ID NO: 28412 - DNA, 20 bp, human
gcttccagcgccggagcctc

SEQ ID NO: 28413 - DNA, 20 bp, human
gccgcgggaacggtgcacat

SEQ ID NO: 28414 - DNA, 20 bp, human
gacctggcgcccggcaagga

SEQ ID NO: 28415 - DNA, 20 bp, human
gttgcccacgcccgaggctc

SEQ ID NO: 28416 - DNA, 20 bp, human
ggcgcagcaagcagtcctcc

SEQ ID NO: 28417 - DNA, 20 bp, human
ggggcggcgaaacttaccag

SEQ ID NO: 28418 - DNA, 20 bp, human
ggcagtcctcccggcaccgt

SEQ ID NO: 28419 - DNA, 20 bp, human
ggctccggccgcttgtccga

SEQ ID NO: 28420 - DNA, 20 bp, human
ggcgcagttgcagcagccgt

SEQ ID NO: 28421 - DNA, 20 bp, human
ggctgcaactgcgcttccga

SEQ ID NO: 28422 - DNA, 20 bp, human
gggcccggactgcttgtccg

SEQ ID NO: 28423 - DNA, 20 bp, human
gtagggcagcgagatatgaa

SEQ ID NO: 28424 - DNA, 20 bp, human
gcggcgaaacttaccagtgg

SEQ ID NO: 28425 - DNA, 20 bp, human
gcgcttccgacggtgccggg

SEQ ID NO: 28426 - DNA, 20 bp, human
ggagcccccggggaagatga

SEQ ID NO: 28427 - DNA, 20 bp, human
ggatcaccgacagcagctcg

SEQ ID NO: 28428 - DNA, 20 bp, human
ggtgatccgacagaaggaga

SEQ ID NO: 28429 - DNA, 20 bp, human
gcgacagaaggagaaggatc

SEQ ID NO: 28430 - DNA, 20 bp, human
gagggtgagcaacgaagtgg

SEQ ID NO: 28431 - DNA, 20 bp, human
gggctccggggagctagaac

SEQ ID NO: 28432 - DNA, 20 bp, human
ggaccccggggaacaccctc

SEQ ID NO: 28433 - DNA, 20 bp, human
gcgcgcgcgccaggctgcag

SEQ ID NO: 28434 - DNA, 20 bp, human
gggcctgagggtgttccccg

SEQ ID NO: 28435 - DNA, 20 bp, human
ggagctagaactggcgttag

SEQ ID NO: 28436 - DNA, 20 bp, human
gcctgcgggaagagctgcag

SEQ ID NO: 28437 - DNA, 20 bp, human
gcgggcgcaggaagaccctg

SEQ ID NO: 28438 - DNA, 20 bp, human
ggcctcgtcccggtctgaga

SEQ ID NO: 28439 - DNA, 20 bp, human
gcgcagcagctcccgagaca

SEQ ID NO: 28440 - DNA, 20 bp, human
ggcagagctgcagtccctgc

SEQ ID NO: 28441 - DNA, 20 bp, human
gcgcgccatccgccagaagg

SEQ ID NO: 28442 - DNA, 20 bp, human
gacagctccagggccctagg

SEQ ID NO: 28443 - DNA, 20 bp, human
gggagcgagactccctgtct

SEQ ID NO: 28444 - DNA, 20 bp, human
gctagggcctcagggagccg

SEQ ID NO: 28445 - DNA, 20 bp, human
gctgcgtgagcgccaccttc

SEQ ID NO: 28446 - DNA, 20 bp, human
gctcgaacaggagagatccc

SEQ ID NO: 28447 - DNA, 20 bp, human
gagatccccggctatcagtg

SEQ ID NO: 28448 - DNA, 20 bp, human
ggagatctcagccctcgaac

SEQ ID NO: 28449 - DNA, 20 bp, human
ggactagacgcgtcttacag

SEQ ID NO: 28450 - DNA, 20 bp, human
gtcagcctcactgatagccg

SEQ ID NO: 28451 - DNA, 20 bp, human
gtgggtctcaggatttccgg

SEQ ID NO: 28452 - DNA, 20 bp, human
gttgtgggcggttgtgggac

SEQ ID NO: 28453 - DNA, 20 bp, human
gttctctgcgaagcacggag

SEQ ID NO: 28454 - DNA, 20 bp, human
gcctggttgtgggcggttgt

SEQ ID NO: 28455 - DNA, 20 bp, human
gcgcgggccgaggcagaccg

SEQ ID NO: 28456 - DNA, 20 bp, human
gcatctgcctggtcttgtgt

SEQ ID NO: 28457 - DNA, 20 bp, human
ggggcctcatcactgatcat

SEQ ID NO: 28458 - DNA, 20 bp, human
ggaggcccaggggaaacaag

SEQ ID NO: 28459 - DNA, 20 bp, human
ggatcagtgatgaggcccag

SEQ ID NO: 28460 - DNA, 20 bp, human
ggattgctggtagaagtgaa

SEQ ID NO: 28461 - DNA, 20 bp, human
gaagtgaaagggcactaata

SEQ ID NO: 28462 - DNA, 20 bp, human
ggatgccacagaggatcgaa

SEQ ID NO: 28463 - DNA, 20 bp, human
gttcaagagggtgggattgc

SEQ ID NO: 28464 - DNA, 20 bp, human
gcttgtgtaggcattttcat

SEQ ID NO: 28465 - DNA, 20 bp, human
ggcagcctttcgatcctctg

SEQ ID NO: 28466 - DNA, 20 bp, human
gggcaaccgacgtacacaag

SEQ ID NO: 28467 - DNA, 20 bp, human
ggttctgtggagagagtgcg

SEQ ID NO: 28468 - DNA, 20 bp, human
gcaacctgcgccgccgagag

SEQ ID NO: 28469 - DNA, 20 bp, human
ggttctcgggtagaagatcg

SEQ ID NO: 28470 - DNA, 20 bp, human
gtggcgtagcgcttgctgag

SEQ ID NO: 28471 - DNA, 20 bp, human
ggaggtcaggccatgaactt

SEQ ID NO: 28472 - DNA, 20 bp, human
gaaggggcttgagcgttctg

SEQ ID NO: 28473 - DNA, 20 bp, human
ggggaccgaaaggggatcac

SEQ ID NO: 28474 - DNA, 20 bp, human
gtggtcgtcagcggagaggg

SEQ ID NO: 28475 - DNA, 20 bp, human
gcaagactccaaaaacaagg

SEQ ID NO: 28476 - DNA, 20 bp, human
gcgctcgcccgagaggtctg

SEQ ID NO: 28477 - DNA, 20 bp, human
gcgcggcgcagcgcaggtaa

SEQ ID NO: 28478 - DNA, 20 bp, human
ggggcgggaggtgacatacg

SEQ ID NO: 28479 - DNA, 20 bp, human
gcccgagaggtctgaggcga

SEQ ID NO: 28480 - DNA, 20 bp, human
ggggtcctcgagcgggacag

SEQ ID NO: 28481 - DNA, 20 bp, human
gcagcgcaggtaatggctcc

SEQ ID NO: 28482 - DNA, 20 bp, human
gggctgcgcgggtcctcgag

SEQ ID NO: 28483 - DNA, 20 bp, human
gcgcgaccaacgaggcagtt

SEQ ID NO: 28484 - DNA, 20 bp, human
gagctgcgccctaagttaga

SEQ ID NO: 28485 - DNA, 20 bp, human
gcaggggaaccccaaaaggg

SEQ ID NO: 28486 - DNA, 20 bp, human
gtgtgcgccggactaagtag

SEQ ID NO: 28487 - DNA, 20 bp, human
gccaaggtccgatcgcccag

SEQ ID NO: 28488 - DNA, 20 bp, human
gaggtccgatcgcccagggg

SEQ ID NO: 28489 - DNA, 20 bp, human
ggctgggcgccccacaaggt

SEQ ID NO: 28490 - DNA, 20 bp, human
gcgctggagttcctaggtca

SEQ ID NO: 28491 - DNA, 20 bp, human
gggtggcggctgcactcgca

SEQ ID NO: 28492 - DNA, 20 bp, human
ggggccagggtcggctgcca

SEQ ID NO: 28493 - DNA, 20 bp, human
ggaggaacccctacttagtc

SEQ ID NO: 28494 - DNA, 20 bp, human
ggcagccgaccctggcccca

SEQ ID NO: 28495 - DNA, 20 bp, human
gcgcggggacccctgacaaa

SEQ ID NO: 28496 - DNA, 20 bp, human
gccaactccggggcccccag

SEQ ID NO: 28497 - DNA, 20 bp, human
ggccccagaccgaaagcaga

SEQ ID NO: 28498 - DNA, 20 bp, human
gcccagaggagcctgcgatc

SEQ ID NO: 28499 - DNA, 20 bp, human
gcacgacatctccccacccg

SEQ ID NO: 28500 - DNA, 20 bp, human
gggagcccccggaggaggat

SEQ ID NO: 28501 - DNA, 20 bp, human
gcggggcgccgagtcctctg

SEQ ID NO: 28502 - DNA, 20 bp, human
ggccgaccagagagagcccg

SEQ ID NO: 28503 - DNA, 20 bp, human
gttcagtttcagggtctcgc

SEQ ID NO: 28504 - DNA, 20 bp, human
ggattcccgctgcctcgggt

SEQ ID NO: 28505 - DNA, 20 bp, human
ggccagctcagagacgaggg

SEQ ID NO: 28506 - DNA, 20 bp, human
gtgtacaaaatagaggagag

SEQ ID NO: 28507 - DNA, 20 bp, human
gagcagcacaaccgccacgg

SEQ ID NO: 28508 - DNA, 20 bp, human
gatgcaggatgtaggatcga

SEQ ID NO: 28509 - DNA, 20 bp, human
gggcggcagcaaagaccgcc

SEQ ID NO: 28510 - DNA, 20 bp, human
gtcgtggtggcggaaaggga

SEQ ID NO: 28511 - DNA, 20 bp, human
gggactctcccgaaaccctc

SEQ ID NO: 28512 - DNA, 20 bp, human
gtggcaggggacgtagggaa

SEQ ID NO: 28513 - DNA, 20 bp, human
gggtctttgctgccgcccgg

SEQ ID NO: 28514 - DNA, 20 bp, human
gaaatagaggagagcggcag

SEQ ID NO: 28515 - DNA, 20 bp, human
gggggttggcaggggacgta

SEQ ID NO: 28516 - DNA, 20 bp, human
ggtttctagtgggacaggaa

SEQ ID NO: 28517 - DNA, 20 bp, human
gtaagtcctgtagccctcag

SEQ ID NO: 28518 - DNA, 20 bp, human
gttcctgaacacctatcctg

SEQ ID NO: 28519 - DNA, 20 bp, human
gctgtgagtcaggactgaaa

SEQ ID NO: 28520 - DNA, 20 bp, human
gggatggagatggccaagaa

SEQ ID NO: 28521 - DNA, 20 bp, human
gaagatgaggtgtttctagt

SEQ ID NO: 28522 - DNA, 20 bp, human
gcttaggagagatggcctgg

SEQ ID NO: 28523 - DNA, 20 bp, human
ggagcttaggagagatggcc

SEQ ID NO: 28524 - DNA, 20 bp, human
gaaatagtagctggatgaat

SEQ ID NO: 28525 - DNA, 20 bp, human
ggcactcagatacctcctcc

SEQ ID NO: 28526 - DNA, 20 bp, human
ggcccgcggctccaacctac

SEQ ID NO: 28527 - DNA, 20 bp, human
gggccatgttggagcagcgg

SEQ ID NO: 28528 - DNA, 20 bp, human
gcatgttggagcagcggagg

SEQ ID NO: 28529 - DNA, 20 bp, human
ggcgtcttgggtccccgcgg

SEQ ID NO: 28530 - DNA, 20 bp, human
gcgccacacaggcagaccgg

SEQ ID NO: 28531 - DNA, 20 bp, human
gacgtgtgaagggaagtcgg

SEQ ID NO: 28532 - DNA, 20 bp, human
ggagaagttgacggaagata

SEQ ID NO: 28533 - DNA, 20 bp, human
gcgtgagagaggcgccacac

SEQ ID NO: 28534 - DNA, 20 bp, human
gccgggaccgcacagcccca

SEQ ID NO: 28535 - DNA, 20 bp, human
gctcgcgggccgcccctccg

SEQ ID NO: 28536 - DNA, 20 bp, human
gcgccgccgcggagccaacg

SEQ ID NO: 28537 - DNA, 20 bp, human
ggactttagggcagaagacg

SEQ ID NO: 28538 - DNA, 20 bp, human
gtgcgcagcaaggacgtcta

SEQ ID NO: 28539 - DNA, 20 bp, human
ggagccaacgcggactggga

SEQ ID NO: 28540 - DNA, 20 bp, human
gggacggcggcggcagtagt

SEQ ID NO: 28541 - DNA, 20 bp, human
ggtccgcgttggctccgcgg

SEQ ID NO: 28542 - DNA, 20 bp, human
gccgccgtcccagtccgcgt

SEQ ID NO: 28543 - DNA, 20 bp, human
ggcccggggcggcgacttta

SEQ ID NO: 28544 - DNA, 20 bp, human
gggggtcgggtaccagggcc

SEQ ID NO: 28545 - DNA, 20 bp, human
gccagtccgcgttggctccg

SEQ ID NO: 28546 - DNA, 20 bp, human
ggcgcttcgctgaggtaagt

SEQ ID NO: 28547 - DNA, 20 bp, human
gaagggccaacaggagctag

SEQ ID NO: 28548 - DNA, 20 bp, human
gctagaggcgcgcttcgctg

SEQ ID NO: 28549 - DNA, 20 bp, human
gaccctgcatgaaaagatta

SEQ ID NO: 28550 - DNA, 20 bp, human
gcagtcacaagcgtgtagtt

SEQ ID NO: 28551 - DNA, 20 bp, human
gccagatggatgcctcagtg

SEQ ID NO: 28552 - DNA, 20 bp, human
ggcgtgtagttgggctgttt

SEQ ID NO: 28553 - DNA, 20 bp, human
ggctcagagttagcaacatt

SEQ ID NO: 28554 - DNA, 20 bp, human
ggactgcgggtgagtcatga

SEQ ID NO: 28555 - DNA, 20 bp, human
gttacgcagctggaggtgca

SEQ ID NO: 28556 - DNA, 20 bp, human
gggcgacggaaggcgcgagg

SEQ ID NO: 28557 - DNA, 20 bp, human
gacggaaggcgcgaggcggt

SEQ ID NO: 28558 - DNA, 20 bp, human
ggaaggcgcgaggcggttgg

SEQ ID NO: 28559 - DNA, 20 bp, human
ggaactgcaggcttttctcc

SEQ ID NO: 28560 - DNA, 20 bp, human
gggcgcgaggcggttggcgg

SEQ ID NO: 28561 - DNA, 20 bp, human
gcgaggcggttggcgggggc

SEQ ID NO: 28562 - DNA, 20 bp, human
ggtgacggggcgccaggcta

SEQ ID NO: 28563 - DNA, 20 bp, human
gggactggacgcccacagag

SEQ ID NO: 28564 - DNA, 20 bp, human
ggcacacgcctgggctcagg

SEQ ID NO: 28565 - DNA, 20 bp, human
gccccgtcaccatggaaacc

SEQ ID NO: 28566 - DNA, 20 bp, human
gacggagggcgccaggcgtt

SEQ ID NO: 28567 - DNA, 20 bp, human
gccgggcgacggagggcgcc

SEQ ID NO: 28568 - DNA, 20 bp, human
gcccgcccccgccaaacgcc

SEQ ID NO: 28569 - DNA, 20 bp, human
ggaactgtaggctcttctcc

SEQ ID NO: 28570 - DNA, 20 bp, human
ggtgacggggcgccaggcta

SEQ ID NO: 28571 - DNA, 20 bp, human
gccccgtcaccatggaaacc

SEQ ID NO: 28572 - DNA, 20 bp, human
gatggaaaccgggcgacgga

SEQ ID NO: 28573 - DNA, 20 bp, human
gacggggcgccaggctaggg

SEQ ID NO: 28574 - DNA, 20 bp, human
gggactggacgcccacagag

SEQ ID NO: 28575 - DNA, 20 bp, human
gatctgaagcgggaaaacaa

SEQ ID NO: 28576 - DNA, 20 bp, human
gacactaagactccgagtca

SEQ ID NO: 28577 - DNA, 20 bp, human
ggtgcaaagggagagacctc

SEQ ID NO: 28578 - DNA, 20 bp, human
gtcagttgcgttccctgact

SEQ ID NO: 28579 - DNA, 20 bp, human
gtttcgggtttggggtgaag

SEQ ID NO: 28580 - DNA, 20 bp, human
gacaccggaacgcatctcca

SEQ ID NO: 28581 - DNA, 20 bp, human
ggggttaggtaagaagcctt

SEQ ID NO: 28582 - DNA, 20 bp, human
gcagtgaggcggtcgagaat

SEQ ID NO: 28583 - DNA, 20 bp, human
gtgagagctagaccagcgtg

SEQ ID NO: 28584 - DNA, 20 bp, human
gggagagacctcaggagtgc

SEQ ID NO: 28585 - DNA, 20 bp, human
ggtgctggagcgttgggacc

SEQ ID NO: 28586 - DNA, 20 bp, human
ggctataaacgcagcagggt

SEQ ID NO: 28587 - DNA, 20 bp, human
gcacaggcgtcgtgcagctg

SEQ ID NO: 28588 - DNA, 20 bp, human
gggcgtcgtgcagctgcgga

SEQ ID NO: 28589 - DNA, 20 bp, human
gttacgaagcacgggcggtg

SEQ ID NO: 28590 - DNA, 20 bp, human
gaagcacgggcggtgaggcg

SEQ ID NO: 28591 - DNA, 20 bp, human
gggcggggcgaggcgcaacg

SEQ ID NO: 28592 - DNA, 20 bp, human
gggcgaggcgcaacgaggcg

SEQ ID NO: 28593 - DNA, 20 bp, human
gtgcacgacgcctgtgtgtc

SEQ ID NO: 28594 - DNA, 20 bp, human
gctccccgaccccttaccaa

SEQ ID NO: 28595 - DNA, 20 bp, human
gtgcgtggagtcgttggact

SEQ ID NO: 28596 - DNA, 20 bp, human
ggcgcagacgtccccatcag

SEQ ID NO: 28597 - DNA, 20 bp, human
gacctctggcctgagaagag

SEQ ID NO: 28598 - DNA, 20 bp, human
gaagctggtggcccacactg

SEQ ID NO: 28599 - DNA, 20 bp, human
gacgcacttagcagtgccag

SEQ ID NO: 28600 - DNA, 20 bp, human
gcggagaactcggaaacgac

SEQ ID NO: 28601 - DNA, 20 bp, human
gctgcgtgctccataggcta

SEQ ID NO: 28602 - DNA, 20 bp, human
gtgtgctacgagccaaggac

SEQ ID NO: 28603 - DNA, 20 bp, human
gtccataggctagggaaccc

SEQ ID NO: 28604 - DNA, 20 bp, human
gacgagcacgcggaacggag

SEQ ID NO: 28605 - DNA, 20 bp, human
gtccacgcccggcttcccca

SEQ ID NO: 28606 - DNA, 20 bp, human
gttgcgagccctggtcagag

SEQ ID NO: 28607 - DNA, 20 bp, human
ggggctcgcaagtcctgcgt

SEQ ID NO: 28608 - DNA, 20 bp, human
ggagcttaggtggcccctcc

SEQ ID NO: 28609 - DNA, 20 bp, human
gggtcagagaggagcctgga

SEQ ID NO: 28610 - DNA, 20 bp, human
gtccttgtgcagagcttagg

SEQ ID NO: 28611 - DNA, 20 bp, human
gggtgctgatggctcacgag

SEQ ID NO: 28612 - DNA, 20 bp, human
ggcccgctcacctacagagt

SEQ ID NO: 28613 - DNA, 20 bp, human
ggtcccagaaaacgcactgt

SEQ ID NO: 28614 - DNA, 20 bp, human
gagcgggccgcaggctgaat

SEQ ID NO: 28615 - DNA, 20 bp, human
gaattccttgtgcagagctt

SEQ ID NO: 28616 - DNA, 20 bp, human
gttgcaggcgaagagattgg

SEQ ID NO: 28617 - DNA, 20 bp, human
gccagcccgggcctccagta

SEQ ID NO: 28618 - DNA, 20 bp, human
gggcaggctgcggcgcgtca

SEQ ID NO: 28619 - DNA, 20 bp, human
gttgttgcaggcgaagagat

SEQ ID NO: 28620 - DNA, 20 bp, human
gtctgcaccgtggagcgcgc

SEQ ID NO: 28621 - DNA, 20 bp, human
gagtctcacctccctagcca

SEQ ID NO: 28622 - DNA, 20 bp, human
ggagctctaagcgcgcgggc

SEQ ID NO: 28623 - DNA, 20 bp, human
gcgcttagagctctgcaccg

SEQ ID NO: 28624 - DNA, 20 bp, human
gtgcagagctctaagcgcgc

SEQ ID NO: 28625 - DNA, 20 bp, human
ggtccctccctcaagactaa

SEQ ID NO: 28626 - DNA, 20 bp, human
gctgtgtcagcacaagggac

SEQ ID NO: 28627 - DNA, 20 bp, human
gcagcagccactggaaatca

SEQ ID NO: 28628 - DNA, 20 bp, human
ggttcagagtggactcagtg

SEQ ID NO: 28629 - DNA, 20 bp, human
gtgaacgtgctaaaatggga

SEQ ID NO: 28630 - DNA, 20 bp, human
gacgtcctgtgtcagcacaa

SEQ ID NO: 28631 - DNA, 20 bp, human
gactctgaacgtgctaaaat

SEQ ID NO: 28632 - DNA, 20 bp, human
gacacagacacacgagaccg

SEQ ID NO: 28633 - DNA, 20 bp, human
gcttctggacaagtaggatg

SEQ ID NO: 28634 - DNA, 20 bp, human
gcgccaggactggactttaa

SEQ ID NO: 28635 - DNA, 20 bp, human
ggtcccttaaagtccagtcc

SEQ ID NO: 28636 - DNA, 20 bp, human
ggactccgtcgcggtgaggg

SEQ ID NO: 28637 - DNA, 20 bp, human
gctgctgggccacttcctca

SEQ ID NO: 28638 - DNA, 20 bp, human
gaaggagtgctagtgcctag

SEQ ID NO: 28639 - DNA, 20 bp, human
gaactgcaggctcataggca

SEQ ID NO: 28640 - DNA, 20 bp, human
gcaaggttacatctaggctg

SEQ ID NO: 28641 - DNA, 20 bp, human
ggcaagactccgtcgcggtg

SEQ ID NO: 28642 - DNA, 20 bp, human
gtacatctaggctgaggtcc

SEQ ID NO: 28643 - DNA, 20 bp, human
gtcatcagagcaatcaccct

SEQ ID NO: 28644 - DNA, 20 bp, human
gtttgttggtggatttagag

SEQ ID NO: 28645 - DNA, 20 bp, human
ggctgatctgctgatctcat

SEQ ID NO: 28646 - DNA, 20 bp, human
gagcgcgagcgagtcccagc

SEQ ID NO: 28647 - DNA, 20 bp, human
ggaggtggaggcgctttgaa

SEQ ID NO: 28648 - DNA, 20 bp, human
gtgtcctgagctggttgccg

SEQ ID NO: 28649 - DNA, 20 bp, human
gtccccaaggcggaaataac

SEQ ID NO: 28650 - DNA, 20 bp, human
gggcagagtgacggactagt

SEQ ID NO: 28651 - DNA, 20 bp, human
ggctaggaaaccggaccctc

SEQ ID NO: 28652 - DNA, 20 bp, human
gccgtcactctgcctccagg

SEQ ID NO: 28653 - DNA, 20 bp, human
gggtgcttggaactgatgta

SEQ ID NO: 28654 - DNA, 20 bp, human
gttgaaaggtgagagcgcga

SEQ ID NO: 28655 - DNA, 20 bp, human
ggatgacgcgcgcaggacga

SEQ ID NO: 28656 - DNA, 20 bp, human
gcgttaggagctgctgggaa

SEQ ID NO: 28657 - DNA, 20 bp, human
gcagcaactaggacagatgg

SEQ ID NO: 28658 - DNA, 20 bp, human
ggctcctaacggcccaagaa

SEQ ID NO: 28659 - DNA, 20 bp, human
gggacagcaactaggacaga

SEQ ID NO: 28660 - DNA, 20 bp, human
ggcgcttcgtggacaagacc

SEQ ID NO: 28661 - DNA, 20 bp, human
gaggctgtggaggggatgtc

SEQ ID NO: 28662 - DNA, 20 bp, human
gttcgtggacaagaccagga

SEQ ID NO: 28663 - DNA, 20 bp, human
gccccaggctgatctcgaag

SEQ ID NO: 28664 - DNA, 20 bp, human
gtaccgcaaggcggagagat

SEQ ID NO: 28665 - DNA, 20 bp, human
ggtcagactggaaggagtcg

SEQ ID NO: 28666 - DNA, 20 bp, human
ggcgtaggatcggccgctgg

SEQ ID NO: 28667 - DNA, 20 bp, human
gccgccggatggcgtaggat

SEQ ID NO: 28668 - DNA, 20 bp, human
gaccacagaagaaggtctgg

SEQ ID NO: 28669 - DNA, 20 bp, human
ggtggtgataccgggtaccc

SEQ ID NO: 28670 - DNA, 20 bp, human
gcctgacggtgctgtacggg

SEQ ID NO: 28671 - DNA, 20 bp, human
gcagcaccgtcaggtttcca

SEQ ID NO: 28672 - DNA, 20 bp, human
ggcgaccacagaagaaggtc

SEQ ID NO: 28673 - DNA, 20 bp, human
gtgcgccggcgccatagccc

SEQ ID NO: 28674 - DNA, 20 bp, human
ggcgccatagcccgggtacc

SEQ ID NO: 28675 - DNA, 20 bp, human
gcggaggcaaggctagagat

SEQ ID NO: 28676 - DNA, 20 bp, human
ggtgcgctccggcgagtcag

SEQ ID NO: 28677 - DNA, 20 bp, human
gagtcagcggcaccgcccag

SEQ ID NO: 28678 - DNA, 20 bp, human
ggcgcagcgaaggcggcagg

SEQ ID NO: 28679 - DNA, 20 bp, human
gcgacagtctcggcttaggg

SEQ ID NO: 28680 - DNA, 20 bp, human
gtgcagggcagagagtgcgg

SEQ ID NO: 28681 - DNA, 20 bp, human
ggactcgccggagcgcacag

SEQ ID NO: 28682 - DNA, 20 bp, human
gacttgcgcggagttgggac

SEQ ID NO: 28683 - DNA, 20 bp, human
gcgcgcaagtccatggtgag

SEQ ID NO: 28684 - DNA, 20 bp, human
gcgcgcggggatggcgaggt

SEQ ID NO: 28685 - DNA, 20 bp, human
gtgcagagcggagtcgagaa

SEQ ID NO: 28686 - DNA, 20 bp, human
gccgtgcgcgaggacctggg

SEQ ID NO: 28687 - DNA, 20 bp, human
gggtcccgaagagctgccac

SEQ ID NO: 28688 - DNA, 20 bp, human
gtaggctgcagcagctaccc

SEQ ID NO: 28689 - DNA, 20 bp, human
ggcggcgcgccgcacgccag

SEQ ID NO: 28690 - DNA, 20 bp, human
gggccactgcctgccgcgtg

SEQ ID NO: 28691 - DNA, 20 bp, human
gcggcccaggagccccacgt

SEQ ID NO: 28692 - DNA, 20 bp, human
ggcgctggcgctccgagtcc

SEQ ID NO: 28693 - DNA, 20 bp, human
ggtcgggcccggcgccactc

SEQ ID NO: 28694 - DNA, 20 bp, human
gtggcgccgggcccgacgtg

SEQ ID NO: 28695 - DNA, 20 bp, human
gtgcagcagctacccgggct

SEQ ID NO: 28696 - DNA, 20 bp, human
ggcgccgagggcgagaaggt

SEQ ID NO: 28697 - DNA, 20 bp, human
gcctcaaggacgtgaaccag

SEQ ID NO: 28698 - DNA, 20 bp, human
ggatgcgcgacgtgaaccgg

SEQ ID NO: 28699 - DNA, 20 bp, human
gcctcggggttgacgagcgg

SEQ ID NO: 28700 - DNA, 20 bp, human
gcgacgacgaccggcagaag

SEQ ID NO: 28701 - DNA, 20 bp, human
gagcacctgctggagatccg

SEQ ID NO: 28702 - DNA, 20 bp, human
gccgaggcgcgcgggctccc

SEQ ID NO: 28703 - DNA, 20 bp, human
ggcctcatgctggagcacgg

SEQ ID NO: 28704 - DNA, 20 bp, human
ggcggtgccgggcgctctca

SEQ ID NO: 28705 - DNA, 20 bp, human
gcggctgcaggacgacaacc

SEQ ID NO: 28706 - DNA, 20 bp, human
gagccatggatacaccgtta

SEQ ID NO: 28707 - DNA, 20 bp, human
gactgaggtgaggctctcgg

SEQ ID NO: 28708 - DNA, 20 bp, human
gtcggagttggcccagaata

SEQ ID NO: 28709 - DNA, 20 bp, human
gtaaggcgcagccgacggct

SEQ ID NO: 28710 - DNA, 20 bp, human
gcaggggtgtggaaacttac

SEQ ID NO: 28711 - DNA, 20 bp, human
gtctcaggaccagggagtac

SEQ ID NO: 28712 - DNA, 20 bp, human
gggagtactggcctcggagt

SEQ ID NO: 28713 - DNA, 20 bp, human
gaccgttaaggcgcagccga

SEQ ID NO: 28714 - DNA, 20 bp, human
gcgccttaacggtgtatcca

SEQ ID NO: 28715 - DNA, 20 bp, human
gcgtctcgtccgcgaaactg

SEQ ID NO: 28716 - DNA, 20 bp, human
ggctcaggctcgggcttcgg

SEQ ID NO: 28717 - DNA, 20 bp, human
ggcggccgccggctctatga

SEQ ID NO: 28718 - DNA, 20 bp, human
gcctctggcgaagctgacgg

SEQ ID NO: 28719 - DNA, 20 bp, human
ggaaagccgaggggttacta

SEQ ID NO: 28720 - DNA, 20 bp, human
gttctgttcctggacggtgg

SEQ ID NO: 28721 - DNA, 20 bp, human
gaccatgtcgactcccaggg

SEQ ID NO: 28722 - DNA, 20 bp, human
ggtccaggaacagaaagccg

SEQ ID NO: 28723 - DNA, 20 bp, human
gggctccatcatagagccgg

SEQ ID NO: 28724 - DNA, 20 bp, human
ggctttctgttcctggacgg

SEQ ID NO: 28725 - DNA, 20 bp, human
gggtaaaaccgctggagctc

SEQ ID NO: 28726 - DNA, 20 bp, human
gtactccggcttctccatag

SEQ ID NO: 28727 - DNA, 20 bp, human
gcatagagggcggagaaggc

SEQ ID NO: 28728 - DNA, 20 bp, human
gtctccatagagggcggaga

SEQ ID NO: 28729 - DNA, 20 bp, human
gggttctgaggccgttactc

SEQ ID NO: 28730 - DNA, 20 bp, human
gggcggagaaggctggagcg

SEQ ID NO: 28731 - DNA, 20 bp, human
gccgccctctatggagaagc

SEQ ID NO: 28732 - DNA, 20 bp, human
gcctgcctgttggtactgag

SEQ ID NO: 28733 - DNA, 20 bp, human
ggcagcccctcagtaccaac

SEQ ID NO: 28734 - DNA, 20 bp, human
gtggaggcgaggcttgaggg

SEQ ID NO: 28735 - DNA, 20 bp, human
gccgttgggattgattcatt

SEQ ID NO: 28736 - DNA, 20 bp, human
gcggggtgcccgtctcactg

SEQ ID NO: 28737 - DNA, 20 bp, human
gccgacccgggcatggaggg

SEQ ID NO: 28738 - DNA, 20 bp, human
ggagacgggcaccccgaccc

SEQ ID NO: 28739 - DNA, 20 bp, human
ggagcagggccccatcgctg

SEQ ID NO: 28740 - DNA, 20 bp, human
gtcactggggcaggtcggag

SEQ ID NO: 28741 - DNA, 20 bp, human
gctggtcggctgacccctct

SEQ ID NO: 28742 - DNA, 20 bp, human
gtcaggaagtctctgagcct

SEQ ID NO: 28743 - DNA, 20 bp, human
gaggcagaaccaggccggag

SEQ ID NO: 28744 - DNA, 20 bp, human
gtcttctccaaccaaagggg

SEQ ID NO: 28745 - DNA, 20 bp, human
ggccagtcccagcgcctgtg

SEQ ID NO: 28746 - DNA, 20 bp, human
gcgccgaagccgcggaacgt

SEQ ID NO: 28747 - DNA, 20 bp, human
gcgcgccggacgcacaacgg

SEQ ID NO: 28748 - DNA, 20 bp, human
gcgcccgggagacaaaggcg

SEQ ID NO: 28749 - DNA, 20 bp, human
gcccgcgccgcggcacaaaa

SEQ ID NO: 28750 - DNA, 20 bp, human
gccgcgcccgctgctcgctg

SEQ ID NO: 28751 - DNA, 20 bp, human
gacggctccgcagcgagcag

SEQ ID NO: 28752 - DNA, 20 bp, human
gagccggtgcaccaacaaag

SEQ ID NO: 28753 - DNA, 20 bp, human
gtcccgcgccggacgcacaa

SEQ ID NO: 28754 - DNA, 20 bp, human
gcagagcccgctggtgacct

SEQ ID NO: 28755 - DNA, 20 bp, human
gggacgccgcagacccgaca

SEQ ID NO: 28756 - DNA, 20 bp, human
gtaggcgctctcatccacta

SEQ ID NO: 28757 - DNA, 20 bp, human
ggagtacagtcggaaactag

SEQ ID NO: 28758 - DNA, 20 bp, human
ggactgtagtcagcccttag

SEQ ID NO: 28759 - DNA, 20 bp, human
gggcccagggtgagtacagt

SEQ ID NO: 28760 - DNA, 20 bp, human
gggggcggggtgtccatcct

SEQ ID NO: 28761 - DNA, 20 bp, human
gaacctccggggactgtcag

SEQ ID NO: 28762 - DNA, 20 bp, human
ggaagcggagcatcaactcg

SEQ ID NO: 28763 - DNA, 20 bp, human
gcggagcatcaactcgtggt

SEQ ID NO: 28764 - DNA, 20 bp, human
gctcctctgacagtccccgg

SEQ ID NO: 28765 - DNA, 20 bp, human
gacgctgcagggtgttgcta

SEQ ID NO: 28766 - DNA, 20 bp, human
gcgccgggcggaagctctgt

SEQ ID NO: 28767 - DNA, 20 bp, human
gacctgtcccggagaccccg

SEQ ID NO: 28768 - DNA, 20 bp, human
gtccgcgactccggctccgt

SEQ ID NO: 28769 - DNA, 20 bp, human
gtctggacccacttccagta

SEQ ID NO: 28770 - DNA, 20 bp, human
gctgcggtcgcagaggccga

SEQ ID NO: 28771 - DNA, 20 bp, human
gctccgggacaggtgacctg

SEQ ID NO: 28772 - DNA, 20 bp, human
ggacccagaggctgacgcaa

SEQ ID NO: 28773 - DNA, 20 bp, human
gcgggcggaagctctgtggg

SEQ ID NO: 28774 - DNA, 20 bp, human
ggggcggggccacaatgtag

SEQ ID NO: 28775 - DNA, 20 bp, human
gtcgcagaggccgacggagc

SEQ ID NO: 28776 - DNA, 20 bp, human
gctcccaccggaaaactctg

SEQ ID NO: 28777 - DNA, 20 bp, human
ggggcgagctgggcaagtcg

SEQ ID NO: 28778 - DNA, 20 bp, human
gccaaggcagaggagatcgt

SEQ ID NO: 28779 - DNA, 20 bp, human
gctcgtcaggagccaacgta

SEQ ID NO: 28780 - DNA, 20 bp, human
gcaccaaaaaacggaaacaa

SEQ ID NO: 28781 - DNA, 20 bp, human
gcgagcaggcgcgaccccac

SEQ ID NO: 28782 - DNA, 20 bp, human
gcagcacaaggcgtgaatcc

SEQ ID NO: 28783 - DNA, 20 bp, human
ggagaaagagccgccaagcc

SEQ ID NO: 28784 - DNA, 20 bp, human
gcattacgcgcttgggtcgg

SEQ ID NO: 28785 - DNA, 20 bp, human
gtcgagcgaacgggaagaga

SEQ ID NO: 28786 - DNA, 20 bp, human
gggccgcggtctcccctcaa

SEQ ID NO: 28787 - DNA, 20 bp, human
ggaccgcggcccagccacac

SEQ ID NO: 28788 - DNA, 20 bp, human
gcggcccagccacacaggtt

SEQ ID NO: 28789 - DNA, 20 bp, human
gtcgaagccgggtggtgcgt

SEQ ID NO: 28790 - DNA, 20 bp, human
gggcccttgaggggagaccg

SEQ ID NO: 28791 - DNA, 20 bp, human
ggaacggagccagctcccgg

SEQ ID NO: 28792 - DNA, 20 bp, human
gtgcagataccggtacccac

SEQ ID NO: 28793 - DNA, 20 bp, human
gggcggaaatcaacttccgg

SEQ ID NO: 28794 - DNA, 20 bp, human
gcggcgagcgcaggaacgag

SEQ ID NO: 28795 - DNA, 20 bp, human
gagaggtgttcgaagccggg

SEQ ID NO: 28796 - DNA, 20 bp, human
gaccgcggctagcgctgggg

SEQ ID NO: 28797 - DNA, 20 bp, human
gctcccaagccccggaggtg

SEQ ID NO: 28798 - DNA, 20 bp, human
gaggcctggccgcgctgacc

SEQ ID NO: 28799 - DNA, 20 bp, human
gccgctcccagggtgcaccg

SEQ ID NO: 28800 - DNA, 20 bp, human
ggggaggaccgagcctaaga

SEQ ID NO: 28801 - DNA, 20 bp, human
gccccgggcgaaggcaactc

SEQ ID NO: 28802 - DNA, 20 bp, human
ggccgccgagggaggtcagt

SEQ ID NO: 28803 - DNA, 20 bp, human
gcctggccgcgctgacccgg

SEQ ID NO: 28804 - DNA, 20 bp, human
gtgcaccgcggctagcgctg

SEQ ID NO: 28805 - DNA, 20 bp, human
gaaggcaactcgggagacgg

SEQ ID NO: 28806 - DNA, 20 bp, human
gcgcggagctgctaccgggg

SEQ ID NO: 28807 - DNA, 20 bp, human
gaagcccgccaagcgtccgg

SEQ ID NO: 28808 - DNA, 20 bp, human
gcccggacagggagaaaggt

SEQ ID NO: 28809 - DNA, 20 bp, human
gatccgaccgggctgtcgta

SEQ ID NO: 28810 - DNA, 20 bp, human
gccgtcccggacagggagaa

SEQ ID NO: 28811 - DNA, 20 bp, human
gaccggggtggagtacaaag

SEQ ID NO: 28812 - DNA, 20 bp, human
ggaggaagctgtccctgccg

SEQ ID NO: 28813 - DNA, 20 bp, human
gctgcgtcagagcaggtgtc

SEQ ID NO: 28814 - DNA, 20 bp, human
ggacagcccggtcggatcat

SEQ ID NO: 28815 - DNA, 20 bp, human
gggagcaggtacccctgcat

SEQ ID NO: 28816 - DNA, 20 bp, human
gtgcttgcgaggtgatcaga

SEQ ID NO: 28817 - DNA, 20 bp, human
ggatcagaaggcaaagatgt

SEQ ID NO: 28818 - DNA, 20 bp, human
gtggttacagtccccaagtg

SEQ ID NO: 28819 - DNA, 20 bp, human
gtcaagaagagggcaaaaca

SEQ ID NO: 28820 - DNA, 20 bp, human
gggagtctagggaggagtct

SEQ ID NO: 28821 - DNA, 20 bp, human
ggagaagccccgccccactt

SEQ ID NO: 28822 - DNA, 20 bp, human
gcccccgacggaaggcgatg

SEQ ID NO: 28823 - DNA, 20 bp, human
gcccagcctaaccatttctc

SEQ ID NO: 28824 - DNA, 20 bp, human
gagccacgcccctcaagaag

SEQ ID NO: 28825 - DNA, 20 bp, human
gttacagtccccaagtgggg

SEQ ID NO: 28826 - DNA, 20 bp, human
ggccgggcccgaggaactag

SEQ ID NO: 28827 - DNA, 20 bp, human
gcggccagcgcagcggaccc

SEQ ID NO: 28828 - DNA, 20 bp, human
ggtcagctctgagcacacta

SEQ ID NO: 28829 - DNA, 20 bp, human
gcccgaggaactagaggcgg

SEQ ID NO: 28830 - DNA, 20 bp, human
gccgctgaccaggatcgatg

SEQ ID NO: 28831 - DNA, 20 bp, human
gcccggaggccgagacagag

SEQ ID NO: 28832 - DNA, 20 bp, human
ggcaggccgaggccccgaaa

SEQ ID NO: 28833 - DNA, 20 bp, human
ggacgctgttaggtttcccg

SEQ ID NO: 28834 - DNA, 20 bp, human
gccgctgcgctggccgagcc

SEQ ID NO: 28835 - DNA, 20 bp, human
gagcacactaaggaccccgg

SEQ ID NO: 28836 - DNA, 20 bp, human
gccggacccggaacattctc

SEQ ID NO: 28837 - DNA, 20 bp, human
gcggcgaaggaacccgataa

SEQ ID NO: 28838 - DNA, 20 bp, human
ggtcagcccgcgacaaggga

SEQ ID NO: 28839 - DNA, 20 bp, human
gggaccggtaaagctgaggg

SEQ ID NO: 28840 - DNA, 20 bp, human
gcaatgcaggaattaggccg

SEQ ID NO: 28841 - DNA, 20 bp, human
gacaagggagggaataatct

SEQ ID NO: 28842 - DNA, 20 bp, human
ggaaggtcagcccgcgacaa

SEQ ID NO: 28843 - DNA, 20 bp, human
ggcagcggtgcacccggacc

SEQ ID NO: 28844 - DNA, 20 bp, human
gtcgtctagagagcaaggga

SEQ ID NO: 28845 - DNA, 20 bp, human
gggattcgtctagagagcaa

SEQ ID NO: 28846 - DNA, 20 bp, human
ggtgtcgagggtctgagtca

SEQ ID NO: 28847 - DNA, 20 bp, human
gcgtcctggcaggactgtgg

SEQ ID NO: 28848 - DNA, 20 bp, human
gcggcgacagtgaagcacct

SEQ ID NO: 28849 - DNA, 20 bp, human
gcaccgccgcccaggttcag

SEQ ID NO: 28850 - DNA, 20 bp, human
gtggttcagggagctccgag

SEQ ID NO: 28851 - DNA, 20 bp, human
gcacctgggcgagacaaccc

SEQ ID NO: 28852 - DNA, 20 bp, human
ggagctccgagaggtccaga

SEQ ID NO: 28853 - DNA, 20 bp, human
ggcgccacgtgtctacccct

SEQ ID NO: 28854 - DNA, 20 bp, human
gagtcccacccagcacacct

SEQ ID NO: 28855 - DNA, 20 bp, human
gggcaggactgtggtggcga

SEQ ID NO: 28856 - DNA, 20 bp, human
gagggacgttcgggaagagt

SEQ ID NO: 28857 - DNA, 20 bp, human
gtcgagtcctaacacatagt

SEQ ID NO: 28858 - DNA, 20 bp, human
gttaggactcgagaaagagg

SEQ ID NO: 28859 - DNA, 20 bp, human
ggtggccaaagcgcagtagg

SEQ ID NO: 28860 - DNA, 20 bp, human
ggggctctcgcggttggtaa

SEQ ID NO: 28861 - DNA, 20 bp, human
gtatctaggggagcagtggt

SEQ ID NO: 28862 - DNA, 20 bp, human
ggcgcagtagggggctctcg

SEQ ID NO: 28863 - DNA, 20 bp, human
gcagcaggcatggaagctaa

SEQ ID NO: 28864 - DNA, 20 bp, human
gcgggtatctaggggagcag

SEQ ID NO: 28865 - DNA, 20 bp, human
gacgttcgggaagagtcggt

SEQ ID NO: 28866 - DNA, 20 bp, human
gacagatcagcagcaggtac

SEQ ID NO: 28867 - DNA, 20 bp, human
ggtcgttacagtgaactcga

SEQ ID NO: 28868 - DNA, 20 bp, human
gacggcagatggacttaata

SEQ ID NO: 28869 - DNA, 20 bp, human
ggcctgtgggatcagattga

SEQ ID NO: 28870 - DNA, 20 bp, human
ggtgatctccgagcaaaatg

SEQ ID NO: 28871 - DNA, 20 bp, human
gtacctgagcccggtcacag

SEQ ID NO: 28872 - DNA, 20 bp, human
ggtggaggagctgcttcgtg

SEQ ID NO: 28873 - DNA, 20 bp, human
gaagaggtagcgcaagcagt

SEQ ID NO: 28874 - DNA, 20 bp, human
ggcagaacctgaacagacag

SEQ ID NO: 28875 - DNA, 20 bp, human
gatctccgagcaaaatgtgg

SEQ ID NO: 28876 - DNA, 20 bp, human
gcgctggtcctccctgaact

SEQ ID NO: 28877 - DNA, 20 bp, human
gttcagggaggaccagcggg

SEQ ID NO: 28878 - DNA, 20 bp, human
gtcccccgctgacgaaccga

SEQ ID NO: 28879 - DNA, 20 bp, human
ggcgtcctaatccaaaaggt

SEQ ID NO: 28880 - DNA, 20 bp, human
gagctgcgtcctaatccaaa

SEQ ID NO: 28881 - DNA, 20 bp, human
ggtttccaaccggagcagcc

SEQ ID NO: 28882 - DNA, 20 bp, human
gggctctgggtctaaaagtg

SEQ ID NO: 28883 - DNA, 20 bp, human
gctggcttggcgtttccaac

SEQ ID NO: 28884 - DNA, 20 bp, human
gaaccgagggacctaccttt

SEQ ID NO: 28885 - DNA, 20 bp, human
gatccaaaaggtaggtccct

SEQ ID NO: 28886 - DNA, 20 bp, human
gtccagagggaattccagag

SEQ ID NO: 28887 - DNA, 20 bp, human
gcggacgggtgactgactag

SEQ ID NO: 28888 - DNA, 20 bp, human
ggcccactccaccctcacac

SEQ ID NO: 28889 - DNA, 20 bp, human
ggaattccctctggaatgga

SEQ ID NO: 28890 - DNA, 20 bp, human
gagtaaccgcgtgcagggaa

SEQ ID NO: 28891 - DNA, 20 bp, human
gctgtggcaacgccagtgtg

SEQ ID NO: 28892 - DNA, 20 bp, human
gtccgctctggaattccctc

SEQ ID NO: 28893 - DNA, 20 bp, human
gctgcacgcggttactctcc

SEQ ID NO: 28894 - DNA, 20 bp, human
gggaattccagagcggaata

SEQ ID NO: 28895 - DNA, 20 bp, human
gtactctcccggctccggag

SEQ ID NO: 28896 - DNA, 20 bp, human
gttgtgggagaaatcagcaa

SEQ ID NO: 28897 - DNA, 20 bp, human
gcgagcccgagttcacaggg

SEQ ID NO: 28898 - DNA, 20 bp, human
gacaaatgctggagtgagtg

SEQ ID NO: 28899 - DNA, 20 bp, human
gaccaagtcattgtgagaca

SEQ ID NO: 28900 - DNA, 20 bp, human
gctcaagtcgcctttaggaa

SEQ ID NO: 28901 - DNA, 20 bp, human
ggggagtgatttccaggtgt

SEQ ID NO: 28902 - DNA, 20 bp, human
gccagctctccagcacttgg

SEQ ID NO: 28903 - DNA, 20 bp, human
gggagaaatcagcaaaggca

SEQ ID NO: 28904 - DNA, 20 bp, human
gcagatgcaacctgccgtgg

SEQ ID NO: 28905 - DNA, 20 bp, human
gaacctgccgtggaggagca

SEQ ID NO: 28906 - DNA, 20 bp, human
gcgccgggtcgagctgagta

SEQ ID NO: 28907 - DNA, 20 bp, human
gcgggtcgagctgagtaagg

SEQ ID NO: 28908 - DNA, 20 bp, human
gacccggcgggctcccaacg

SEQ ID NO: 28909 - DNA, 20 bp, human
ggctgagggagtactatgag

SEQ ID NO: 28910 - DNA, 20 bp, human
gcggagccgggacacgaggt

SEQ ID NO: 28911 - DNA, 20 bp, human
ggtcgagctgagtaaggcgg

SEQ ID NO: 28912 - DNA, 20 bp, human
gatgtgaaggagttccgacc

SEQ ID NO: 28913 - DNA, 20 bp, human
gcagtcacctggcgggacag

SEQ ID NO: 28914 - DNA, 20 bp, human
ggaatcgcagcgtgagcagg

SEQ ID NO: 28915 - DNA, 20 bp, human
ggagcaggtggagccgcgtt

SEQ ID NO: 28916 - DNA, 20 bp, human
ggctagcagcaagcacacca

SEQ ID NO: 28917 - DNA, 20 bp, human
gtgggaggcctaaggtccag

SEQ ID NO: 28918 - DNA, 20 bp, human
ggcattgcaggacggcacag

SEQ ID NO: 28919 - DNA, 20 bp, human
gaacgtggtcagccactctg

SEQ ID NO: 28920 - DNA, 20 bp, human
gtgacagcttcagtacaagg

SEQ ID NO: 28921 - DNA, 20 bp, human
gccaaggaagggaacctgtg

SEQ ID NO: 28922 - DNA, 20 bp, human
gaggttactcgggtaaagct

SEQ ID NO: 28923 - DNA, 20 bp, human
gggtctggcttgggccttcc

SEQ ID NO: 28924 - DNA, 20 bp, human
gggtaaagctgggaggccta

SEQ ID NO: 28925 - DNA, 20 bp, human
gttactcgggtaaagctggg

SEQ ID NO: 28926 - DNA, 20 bp, human
ggctgcggagaccttcatgt

SEQ ID NO: 28927 - DNA, 20 bp, human
ggtgtgagctttggcgtgag

SEQ ID NO: 28928 - DNA, 20 bp, human
gtgagctttggcgtgagagg

SEQ ID NO: 28929 - DNA, 20 bp, human
ggctttggcgtgagaggtgg

SEQ ID NO: 28930 - DNA, 20 bp, human
gtggcccagcgagcccctgg

SEQ ID NO: 28931 - DNA, 20 bp, human
ggtcttactgtgggcatggt

SEQ ID NO: 28932 - DNA, 20 bp, human
gggtctccgcagcacttctg

SEQ ID NO: 28933 - DNA, 20 bp, human
ggaggtggtggtttctgggt

SEQ ID NO: 28934 - DNA, 20 bp, human
gaatggctctgtcttactgt

SEQ ID NO: 28935 - DNA, 20 bp, human
gccttcagcctccaacatga

SEQ ID NO: 28936 - DNA, 20 bp, human
gcatgttgaaggttaagagt

SEQ ID NO: 28937 - DNA, 20 bp, human
gaaagagagggagagtcgaa

SEQ ID NO: 28938 - DNA, 20 bp, human
gcgaagggaggtgacttacc

SEQ ID NO: 28939 - DNA, 20 bp, human
ggagagggagagtcgaaggg

SEQ ID NO: 28940 - DNA, 20 bp, human
gactccctataaaaggccgg

SEQ ID NO: 28941 - DNA, 20 bp, human
ggttccgccggccttttata

SEQ ID NO: 28942 - DNA, 20 bp, human
gtatagggagtggagaagct

SEQ ID NO: 28943 - DNA, 20 bp, human
ggcagagactttcatgttga

SEQ ID NO: 28944 - DNA, 20 bp, human
ggctcctctggctgttccgc

SEQ ID NO: 28945 - DNA, 20 bp, human
gaaaaaagtggaggagcact

SEQ ID NO: 28946 - DNA, 20 bp, human
gttcagaggctcctgcggtg

SEQ ID NO: 28947 - DNA, 20 bp, human
gcaggagcagggactcagaa

SEQ ID NO: 28948 - DNA, 20 bp, human
ggaccaatgagacttgactt

SEQ ID NO: 28949 - DNA, 20 bp, human
gcacagcatgaagatctccg

SEQ ID NO: 28950 - DNA, 20 bp, human
gccctagggcgatggtgatg

SEQ ID NO: 28951 - DNA, 20 bp, human
gagcctctgaagctcccacc

SEQ ID NO: 28952 - DNA, 20 bp, human
gctcccaagtcaagtctcat

SEQ ID NO: 28953 - DNA, 20 bp, human
gctgcaggctctaggttgga

SEQ ID NO: 28954 - DNA, 20 bp, human
gtggagactagagggcattt

SEQ ID NO: 28955 - DNA, 20 bp, human
gatgctgtgggaagctgttg

SEQ ID NO: 28956 - DNA, 20 bp, human
gagagtgcaacagaaagtag

SEQ ID NO: 28957 - DNA, 20 bp, human
gaagcctgagataggagtgg

SEQ ID NO: 28958 - DNA, 20 bp, human
gaggctgctgcagactgata

SEQ ID NO: 28959 - DNA, 20 bp, human
ggaattatcccaatagctac

SEQ ID NO: 28960 - DNA, 20 bp, human
ggataattcgggaaatccac

SEQ ID NO: 28961 - DNA, 20 bp, human
gagtcccccactcctatctc

SEQ ID NO: 28962 - DNA, 20 bp, human
ggactcttggattcaggatt

SEQ ID NO: 28963 - DNA, 20 bp, human
gggaactacaggaatagaac

SEQ ID NO: 28964 - DNA, 20 bp, human
gactgctaacacctcctggt

SEQ ID NO: 28965 - DNA, 20 bp, human
gaatcctctaagcctgagat

SEQ ID NO: 28966 - DNA, 20 bp, human
gaagcctgagataggagtgg

SEQ ID NO: 28967 - DNA, 20 bp, human
gagagtgcaacagaaagtag

SEQ ID NO: 28968 - DNA, 20 bp, human
ggggcagagctggtatcccg

SEQ ID NO: 28969 - DNA, 20 bp, human
gaggctgctgcagactgata

SEQ ID NO: 28970 - DNA, 20 bp, human
ggaattatcccaatagctac

SEQ ID NO: 28971 - DNA, 20 bp, human
gggtaactcaagctctggga

SEQ ID NO: 28972 - DNA, 20 bp, human
gtcccaggtgaccaggtcca

SEQ ID NO: 28973 - DNA, 20 bp, human
gagtcccccactcctatctc

SEQ ID NO: 28974 - DNA, 20 bp, human
gtttccccgccagggtccaa

SEQ ID NO: 28975 - DNA, 20 bp, human
ggataattcgggaaatccac

SEQ ID NO: 28976 - DNA, 20 bp, human
ggcgaggcagtacagcttca

SEQ ID NO: 28977 - DNA, 20 bp, human
ggaccttcatcctctcagcg

SEQ ID NO: 28978 - DNA, 20 bp, human
ggagcccacagggtcttatg

SEQ ID NO: 28979 - DNA, 20 bp, human
ggctgtactgcctcgctgag

SEQ ID NO: 28980 - DNA, 20 bp, human
gtaagtagttccaggaaact

SEQ ID NO: 28981 - DNA, 20 bp, human
gtcctcaggagtcccaagcg

SEQ ID NO: 28982 - DNA, 20 bp, human
gaccacgcttgggactcctg

SEQ ID NO: 28983 - DNA, 20 bp, human
ggcaggaatgatcattcagg

SEQ ID NO: 28984 - DNA, 20 bp, human
gctcgccactcattcttcca

SEQ ID NO: 28985 - DNA, 20 bp, human
gctggcctcataagaccctg

SEQ ID NO: 28986 - DNA, 20 bp, human
gcccaggaggagggtgacca

SEQ ID NO: 28987 - DNA, 20 bp, human
gagggtgtctccctgagcag

SEQ ID NO: 28988 - DNA, 20 bp, human
gccagggccagcatcttcag

SEQ ID NO: 28989 - DNA, 20 bp, human
gcacacagagactccctcct

SEQ ID NO: 28990 - DNA, 20 bp, human
gccctgctgagagtcgaggg

SEQ ID NO: 28991 - DNA, 20 bp, human
gaccaaggcgagcacatctt

SEQ ID NO: 28992 - DNA, 20 bp, human
gacaccctgctgagagtcga

SEQ ID NO: 28993 - DNA, 20 bp, human
gctgcaatggccgtgaggtg

SEQ ID NO: 28994 - DNA, 20 bp, human
gagggaatcagcataaagat

SEQ ID NO: 28995 - DNA, 20 bp, human
gtcttttgtgggagtaggtg

SEQ ID NO: 28996 - DNA, 20 bp, human
ggtgcagacgaggacaagga

SEQ ID NO: 28997 - DNA, 20 bp, human
gcagctcataccccagaagg

SEQ ID NO: 28998 - DNA, 20 bp, human
ggcctgcccagcatcatgaa

SEQ ID NO: 28999 - DNA, 20 bp, human
ggaactctaggagactgctg

SEQ ID NO: 29000 - DNA, 20 bp, human
ggaagtggtcagagtgagct

SEQ ID NO: 29001 - DNA, 20 bp, human
ggcccttcatgatgctgggc

SEQ ID NO: 29002 - DNA, 20 bp, human
gacccaaggggttgaactct

SEQ ID NO: 29003 - DNA, 20 bp, human
gggctccctgggcagaagtc

SEQ ID NO: 29004 - DNA, 20 bp, human
gttagcgtgaggtagaatct

SEQ ID NO: 29005 - DNA, 20 bp, human
gtcctagagttcaacccctt

SEQ ID NO: 29006 - DNA, 20 bp, human
ggtgaggctgcagggcgact

SEQ ID NO: 29007 - DNA, 20 bp, human
ggatgcaggggtgaaatgca

SEQ ID NO: 29008 - DNA, 20 bp, human
gcacccgcattgggattcag

SEQ ID NO: 29009 - DNA, 20 bp, human
ggtgtgagcgccagctgtct

SEQ ID NO: 29010 - DNA, 20 bp, human
gcagagacagtcacagccat

SEQ ID NO: 29011 - DNA, 20 bp, human
gctctggacttccccaggta

SEQ ID NO: 29012 - DNA, 20 bp, human
gtgcagggcgactgggatgc

SEQ ID NO: 29013 - DNA, 20 bp, human
gtgcttggcactggacgtaa

SEQ ID NO: 29014 - DNA, 20 bp, human
gtagcacatcctggggccta

SEQ ID NO: 29015 - DNA, 20 bp, human
ggtgaacagaggcaggccaa

SEQ ID NO: 29016 - DNA, 20 bp, human
gagcagccagaggaaccgag

SEQ ID NO: 29017 - DNA, 20 bp, human
gatcagggtaatcaaagaga

SEQ ID NO: 29018 - DNA, 20 bp, human
gacgctggagacccagaatc

SEQ ID NO: 29019 - DNA, 20 bp, human
gagcgttaaagcaagactgt

SEQ ID NO: 29020 - DNA, 20 bp, human
ggcgagcccttggggaatga

SEQ ID NO: 29021 - DNA, 20 bp, human
ggcggcagagactttcatgc

SEQ ID NO: 29022 - DNA, 20 bp, human
gtgactcagaaaaggacaag

SEQ ID NO: 29023 - DNA, 20 bp, human
gtggaccatccaagcagacg

SEQ ID NO: 29024 - DNA, 20 bp, human
gtctgggtctccagcgtgtc

SEQ ID NO: 29025 - DNA, 20 bp, human
gttgagaattggatgtttct

SEQ ID NO: 29026 - DNA, 20 bp, human
ggcagccaggagcaaactct

SEQ ID NO: 29027 - DNA, 20 bp, human
gctcaactgggggtccctaa

SEQ ID NO: 29028 - DNA, 20 bp, human
gctataaatagggccatccc

SEQ ID NO: 29029 - DNA, 20 bp, human
gcgaaagttggggacacagg

SEQ ID NO: 29030 - DNA, 20 bp, human
gtagccttgagctcaactgg

SEQ ID NO: 29031 - DNA, 20 bp, human
gaacagcactcccaaagaac

SEQ ID NO: 29032 - DNA, 20 bp, human
gttgggaggtacgaaagttg

SEQ ID NO: 29033 - DNA, 20 bp, human
gtcaaaatggccccatctac

SEQ ID NO: 29034 - DNA, 20 bp, human
gaaactcttggtacagcaca

SEQ ID NO: 29035 - DNA, 20 bp, human
ggtacgaaagttggggacac

SEQ ID NO: 29036 - DNA, 20 bp, human
ggtcaaacggaactagtata

SEQ ID NO: 29037 - DNA, 20 bp, human
gatttattgtgggcttcaca

SEQ ID NO: 29038 - DNA, 20 bp, human
gtgaagcccacaataaattt

SEQ ID NO: 29039 - DNA, 20 bp, human
ggctattaaagtgatatatt

SEQ ID NO: 29040 - DNA, 20 bp, human
gtttggtctcaaacactttc

SEQ ID NO: 29041 - DNA, 20 bp, human
gtctgaatgaaactctaaaa

SEQ ID NO: 29042 - DNA, 20 bp, human
gagttcactttaaacaggac

SEQ ID NO: 29043 - DNA, 20 bp, human
ggtgggcttcacacggcagc

SEQ ID NO: 29044 - DNA, 20 bp, human
gcttcatcctaaatttattg

SEQ ID NO: 29045 - DNA, 20 bp, human
gtaattttcttgatttatat

SEQ ID NO: 29046 - DNA, 20 bp, human
gggccagaaccaggataagg

SEQ ID NO: 29047 - DNA, 20 bp, human
gtgagtggacacaaaggggt

SEQ ID NO: 29048 - DNA, 20 bp, human
gatggtgggcaagactaaga

SEQ ID NO: 29049 - DNA, 20 bp, human
gctgcagggtgggattcaca

SEQ ID NO: 29050 - DNA, 20 bp, human
gcttgcggggcaagaacctg

SEQ ID NO: 29051 - DNA, 20 bp, human
ggtgggcagctgcaagttgg

SEQ ID NO: 29052 - DNA, 20 bp, human
gtactggctggtgacggggt

SEQ ID NO: 29053 - DNA, 20 bp, human
ggagctatgtgcagacccaa

SEQ ID NO: 29054 - DNA, 20 bp, human
gggcaagaacctgcgggtgg

SEQ ID NO: 29055 - DNA, 20 bp, human
ggacacaaaggggtgggtac

SEQ ID NO: 29056 - DNA, 20 bp, human
gcacctgggctgagacatac

SEQ ID NO: 29057 - DNA, 20 bp, human
ggtgggtgaggagcttctaa

SEQ ID NO: 29058 - DNA, 20 bp, human
gcgccacagcaaggaggacg

SEQ ID NO: 29059 - DNA, 20 bp, human
gaaccaggagtgcagtctgt

SEQ ID NO: 29060 - DNA, 20 bp, human
gctcaagcatagggccctag

SEQ ID NO: 29061 - DNA, 20 bp, human
ggtcaggtctgagtggggga

SEQ ID NO: 29062 - DNA, 20 bp, human
gtgaggagcttctaagggtc

SEQ ID NO: 29063 - DNA, 20 bp, human
gaaggaggacgaggacaacc

SEQ ID NO: 29064 - DNA, 20 bp, human
gttgaagcgccacagcaagg

SEQ ID NO: 29065 - DNA, 20 bp, human
ggtggcgcttcaagcaactg

SEQ ID NO: 29066 - DNA, 20 bp, human
gaccttcccttagcagacat

SEQ ID NO: 29067 - DNA, 20 bp, human
gatggagagtagttacagga

SEQ ID NO: 29068 - DNA, 20 bp, human
gcagaaccaggtctatactc

SEQ ID NO: 29069 - DNA, 20 bp, human
ggagtaccatgaccacgtct

SEQ ID NO: 29070 - DNA, 20 bp, human
gaccatgaccacgtctggga

SEQ ID NO: 29071 - DNA, 20 bp, human
gtgggatggagagtagttac

SEQ ID NO: 29072 - DNA, 20 bp, human
gggaggggaatatacacata

SEQ ID NO: 29073 - DNA, 20 bp, human
gcatggtaactcaagctctg

SEQ ID NO: 29074 - DNA, 20 bp, human
gtccatcccagacgtggtca

SEQ ID NO: 29075 - DNA, 20 bp, human
gatatggctggtccaatgtg

SEQ ID NO: 29076 - DNA, 20 bp, human
ggagcagaagcaccagctcg

SEQ ID NO: 29077 - DNA, 20 bp, human
gtgaccacagagcctagaag

SEQ ID NO: 29078 - DNA, 20 bp, human
gcccgtagggatgatgtggt

SEQ ID NO: 29079 - DNA, 20 bp, human
gctcaaggcaggagtgatgt

SEQ ID NO: 29080 - DNA, 20 bp, human
ggcttctgctctctgagaca

SEQ ID NO: 29081 - DNA, 20 bp, human
ggtgcaggaggaaaggacct

SEQ ID NO: 29082 - DNA, 20 bp, human
gcgacaggatgcagttccaa

SEQ ID NO: 29083 - DNA, 20 bp, human
ggctgggatggcacagtggg

SEQ ID NO: 29084 - DNA, 20 bp, human
gtctgaggcccagagccaag

SEQ ID NO: 29085 - DNA, 20 bp, human
ggggctcaaagctgacgtgc

SEQ ID NO: 29086 - DNA, 20 bp, human
gggattggggagacttccgg

SEQ ID NO: 29087 - DNA, 20 bp, human
gagcttggcctacagcccgg

SEQ ID NO: 29088 - DNA, 20 bp, human
gccgatatccactgggtcaa

SEQ ID NO: 29089 - DNA, 20 bp, human
gggccacctggggtcgtgga

SEQ ID NO: 29090 - DNA, 20 bp, human
gagttcctgcatgtcaggag

SEQ ID NO: 29091 - DNA, 20 bp, human
gatgggattggggagacttc

SEQ ID NO: 29092 - DNA, 20 bp, human
gatcagctcccttgacccag

SEQ ID NO: 29093 - DNA, 20 bp, human
gcgaataacggggccacctg

SEQ ID NO: 29094 - DNA, 20 bp, human
ggagaggggcacttggtggt

SEQ ID NO: 29095 - DNA, 20 bp, human
gggcacctggacgaataacg

SEQ ID NO: 29096 - DNA, 20 bp, human
gaggtggagactcaggaggg

SEQ ID NO: 29097 - DNA, 20 bp, human
gtccaaggtggagactcagg

SEQ ID NO: 29098 - DNA, 20 bp, human
gagttccaaggtggagactc

SEQ ID NO: 29099 - DNA, 20 bp, human
gccaggatgagccttgggat

SEQ ID NO: 29100 - DNA, 20 bp, human
gcgtacgtgtggcagttcca

SEQ ID NO: 29101 - DNA, 20 bp, human
gagcttcgcacccaggtcca

SEQ ID NO: 29102 - DNA, 20 bp, human
gtgggccagctacgtacgtg

SEQ ID NO: 29103 - DNA, 20 bp, human
gcttgttagtgtgcagaggt

SEQ ID NO: 29104 - DNA, 20 bp, human
gcgggaaggaaccccaggag

SEQ ID NO: 29105 - DNA, 20 bp, human
gggatcaggcaggaggagtt

SEQ ID NO: 29106 - DNA, 20 bp, human
gaccagatgaaaacctgagt

SEQ ID NO: 29107 - DNA, 20 bp, human
gacagcaggtgagtacttgg

SEQ ID NO: 29108 - DNA, 20 bp, human
ggaattagcagttagggctg

SEQ ID NO: 29109 - DNA, 20 bp, human
ggagtcaggggtatcagggg

SEQ ID NO: 29110 - DNA, 20 bp, human
ggtcagagtcaggggtatca

SEQ ID NO: 29111 - DNA, 20 bp, human
ggggttgggatcagcattag

SEQ ID NO: 29112 - DNA, 20 bp, human
ggcaacagaattagcagtta

SEQ ID NO: 29113 - DNA, 20 bp, human
gtagcagttagggctggggt

SEQ ID NO: 29114 - DNA, 20 bp, human
gtgggactgaggtcagagtc

SEQ ID NO: 29115 - DNA, 20 bp, human
gggtggcagtaggaatgcta

SEQ ID NO: 29116 - DNA, 20 bp, human
gactacgcgaagggtaggta

SEQ ID NO: 29117 - DNA, 20 bp, human
gcaagtactacgcgaagggt

SEQ ID NO: 29118 - DNA, 20 bp, human
gacgcgaagggtaggtaggg

SEQ ID NO: 29119 - DNA, 20 bp, human
gcgcgggtaggaaccgtcca

SEQ ID NO: 29120 - DNA, 20 bp, human
ggtacgcgcagaggcgggaa

SEQ ID NO: 29121 - DNA, 20 bp, human
gagcgacagcaacaagaaag

SEQ ID NO: 29122 - DNA, 20 bp, human
gagcctcctcaccaggtcag

SEQ ID NO: 29123 - DNA, 20 bp, human
gtataacaagtactacgcga

SEQ ID NO: 29124 - DNA, 20 bp, human
gtgaagtggaaaacagcggg

SEQ ID NO: 29125 - DNA, 20 bp, human
gtttggcagcttcttcacgt

SEQ ID NO: 29126 - DNA, 20 bp, human
gggacacgggcagcagacag

SEQ ID NO: 29127 - DNA, 20 bp, human
ggacctgcatgattctgagc

SEQ ID NO: 29128 - DNA, 20 bp, human
gaaagggctgccaaacatct

SEQ ID NO: 29129 - DNA, 20 bp, human
gcacctgctcagaatcatgc

SEQ ID NO: 29130 - DNA, 20 bp, human
gccacaagaaaagattgatg

SEQ ID NO: 29131 - DNA, 20 bp, human
gctcacgtgatgcagagaac

SEQ ID NO: 29132 - DNA, 20 bp, human
gtcttagccccctagtctcc

SEQ ID NO: 29133 - DNA, 20 bp, human
gttctcatacctggagacta

SEQ ID NO: 29134 - DNA, 20 bp, human
gtgagtctgagtttcgttgt

SEQ ID NO: 29135 - DNA, 20 bp, human
gtcagacttcagaaggacac

SEQ ID NO: 29136 - DNA, 20 bp, human
gtcagacatcagaaggacgc

SEQ ID NO: 29137 - DNA, 20 bp, human
ggagccccgaagagaaaaga

SEQ ID NO: 29138 - DNA, 20 bp, human
gcagtggagacctgcatgat

SEQ ID NO: 29139 - DNA, 20 bp, human
ggatggcttcagacatcaga

SEQ ID NO: 29140 - DNA, 20 bp, human
ggacctgcatgattgggagc

SEQ ID NO: 29141 - DNA, 20 bp, human
gtcatacctggagactagga

SEQ ID NO: 29142 - DNA, 20 bp, human
gccgcaaaaaaagactgatg

SEQ ID NO: 29143 - DNA, 20 bp, human
gagagtagtcagtcccttct

SEQ ID NO: 29144 - DNA, 20 bp, human
ggttgtgaagaaaaagacca

SEQ ID NO: 29145 - DNA, 20 bp, human
gggactcacgtggtgcagag

SEQ ID NO: 29146 - DNA, 20 bp, human
gtcagacatcagaaggacgc

SEQ ID NO: 29147 - DNA, 20 bp, human
ggatggcttcagacatcaga

SEQ ID NO: 29148 - DNA, 20 bp, human
ggagccccgaagagaaaaga

SEQ ID NO: 29149 - DNA, 20 bp, human
gcagtggagacctgcatgat

SEQ ID NO: 29150 - DNA, 20 bp, human
gagagtagtcagtcccttct

SEQ ID NO: 29151 - DNA, 20 bp, human
ggacctgcatgattgggagc

SEQ ID NO: 29152 - DNA, 20 bp, human
gtcatacctggagactagga

SEQ ID NO: 29153 - DNA, 20 bp, human
ggttgtgaagaaaaagacca

SEQ ID NO: 29154 - DNA, 20 bp, human
gacgtggtgcagagaggacc

SEQ ID NO: 29155 - DNA, 20 bp, human
gggactcacgtggtgcagag

SEQ ID NO: 29156 - DNA, 20 bp, human
gtacttggtgctgagagcgc

SEQ ID NO: 29157 - DNA, 20 bp, human
ggaaggcagctactagcatg

SEQ ID NO: 29158 - DNA, 20 bp, human
gcctgtgctgatactgactt

SEQ ID NO: 29159 - DNA, 20 bp, human
gatcagcacaggacacagct

SEQ ID NO: 29160 - DNA, 20 bp, human
gggcaaagaggttttctcag

SEQ ID NO: 29161 - DNA, 20 bp, human
gagaggttttctcagaggtg

SEQ ID NO: 29162 - DNA, 20 bp, human
gtactagcatgaggagagac

SEQ ID NO: 29163 - DNA, 20 bp, human
gaccagcagaggaaaacgat

SEQ ID NO: 29164 - DNA, 20 bp, human
gcagagcttcatggtattgg

SEQ ID NO: 29165 - DNA, 20 bp, human
gccaaggcacagagagggac

SEQ ID NO: 29166 - DNA, 20 bp, human
gggcaaagaggttttctcag

SEQ ID NO: 29167 - DNA, 20 bp, human
gagaggttttctcagaggtg

SEQ ID NO: 29168 - DNA, 20 bp, human
gtactagcacgaggagagac

SEQ ID NO: 29169 - DNA, 20 bp, human
gaccagcagaggaaaacgat

SEQ ID NO: 29170 - DNA, 20 bp, human
gcagagcttcatggtattgg

SEQ ID NO: 29171 - DNA, 20 bp, human
gatcagcacaggacacagct

SEQ ID NO: 29172 - DNA, 20 bp, human
gacgcagagcttcatggtat

SEQ ID NO: 29173 - DNA, 20 bp, human
ggaaggcagctactagcacg

SEQ ID NO: 29174 - DNA, 20 bp, human
gccaaggcacagagagggac

SEQ ID NO: 29175 - DNA, 20 bp, human
gtgcttgaacaaataattaa

SEQ ID NO: 29176 - DNA, 20 bp, human
gggcaaagaggttttctcag

SEQ ID NO: 29177 - DNA, 20 bp, human
gagaggttttctcagaggtg

SEQ ID NO: 29178 - DNA, 20 bp, human
gtactagcacgaggagagac

SEQ ID NO: 29179 - DNA, 20 bp, human
gatcagcacaggacacagct

SEQ ID NO: 29180 - DNA, 20 bp, human
gcagagcttcatggtattgg

SEQ ID NO: 29181 - DNA, 20 bp, human
gaccagcagaggaaaacgat

SEQ ID NO: 29182 - DNA, 20 bp, human
gacgcagagcttcatggtat

SEQ ID NO: 29183 - DNA, 20 bp, human
ggaaggcagctactagcacg

SEQ ID NO: 29184 - DNA, 20 bp, human
gctatttcgagtcaaggtgt

SEQ ID NO: 29185 - DNA, 20 bp, human
gccaaggcacagagagggac

SEQ ID NO: 29186 - DNA, 20 bp, human
gcatggtagagatgatgtca

SEQ ID NO: 29187 - DNA, 20 bp, human
gcatagaggaaagatgaggg

SEQ ID NO: 29188 - DNA, 20 bp, human
gcagggcgatgtcatcatag

SEQ ID NO: 29189 - DNA, 20 bp, human
gcatcatagaggaaagatga

SEQ ID NO: 29190 - DNA, 20 bp, human
gaggcctaggacaaatgtgg

SEQ ID NO: 29191 - DNA, 20 bp, human
gctatttcgagtcaaggtgt

SEQ ID NO: 29192 - DNA, 20 bp, human
gaggtgcaggcgagaagaaa

SEQ ID NO: 29193 - DNA, 20 bp, human
gaaagcagtgaccgagactg

SEQ ID NO: 29194 - DNA, 20 bp, human
gggaaagatgagggaggtgc

SEQ ID NO: 29195 - DNA, 20 bp, human
gtctcagcttctcttcccca

SEQ ID NO: 29196 - DNA, 20 bp, human
gagaccttcatggtacctgt

SEQ ID NO: 29197 - DNA, 20 bp, human
ggctgccgcggagaccttca

SEQ ID NO: 29198 - DNA, 20 bp, human
gggtaccatgaaggtctccg

SEQ ID NO: 29199 - DNA, 20 bp, human
gttcatggtacctgtgggag

SEQ ID NO: 29200 - DNA, 20 bp, human
gggcagatgcaggagcgcag

SEQ ID NO: 29201 - DNA, 20 bp, human
gatgacagcgagggctgccg

SEQ ID NO: 29202 - DNA, 20 bp, human
gagaggatcaagacagcacg

SEQ ID NO: 29203 - DNA, 20 bp, human
gcaagaccaggacttacatg

SEQ ID NO: 29204 - DNA, 20 bp, human
gctacaccctcaaggcctac

SEQ ID NO: 29205 - DNA, 20 bp, human
ggaccaggacttacatgggg

SEQ ID NO: 29206 - DNA, 20 bp, human
gagacacagaagtgctgcag

SEQ ID NO: 29207 - DNA, 20 bp, human
gtgggcttccacatgagaat

SEQ ID NO: 29208 - DNA, 20 bp, human
gcagaggctttcatgttgga

SEQ ID NO: 29209 - DNA, 20 bp, human
gtaccgggagacccagaatc

SEQ ID NO: 29210 - DNA, 20 bp, human
ggatcagggtgatcaaagac

SEQ ID NO: 29211 - DNA, 20 bp, human
ggaaacctccaattctcatg

SEQ ID NO: 29212 - DNA, 20 bp, human
gggagtggtaactgcactga

SEQ ID NO: 29213 - DNA, 20 bp, human
gaggagagagggaccttacc

SEQ ID NO: 29214 - DNA, 20 bp, human
gccagcagaatttgggatca

SEQ ID NO: 29215 - DNA, 20 bp, human
gtccaggataacccagagag

SEQ ID NO: 29216 - DNA, 20 bp, human
ggagccaccgaggagcagag

SEQ ID NO: 29217 - DNA, 20 bp, human
gcagaaaccttcatcttgga

SEQ ID NO: 29218 - DNA, 20 bp, human
gtggggtcaggaaagatcaa

SEQ ID NO: 29219 - DNA, 20 bp, human
gccttcatcttggagggcaa

SEQ ID NO: 29220 - DNA, 20 bp, human
gaaggcaggcagagccaccg

SEQ ID NO: 29221 - DNA, 20 bp, human
gcaacctctctgctcctcgg

SEQ ID NO: 29222 - DNA, 20 bp, human
gccagaggaatctcagcgta

SEQ ID NO: 29223 - DNA, 20 bp, human
gaggacatttcaggccgtag

SEQ ID NO: 29224 - DNA, 20 bp, human
gtttcaggccgtagtggaga

SEQ ID NO: 29225 - DNA, 20 bp, human
gctaatgagctgtgacataa

SEQ ID NO: 29226 - DNA, 20 bp, human
gggagccgcacgcggcgata

SEQ ID NO: 29227 - DNA, 20 bp, human
gggcccggaagtgcgggtgt

SEQ ID NO: 29228 - DNA, 20 bp, human
ggcccgggtcgagcatgtag

SEQ ID NO: 29229 - DNA, 20 bp, human
ggccgctacatgctcgaccc

SEQ ID NO: 29230 - DNA, 20 bp, human
gaggaagtgggcccggcgag

SEQ ID NO: 29231 - DNA, 20 bp, human
ggcgcagggaaggccgtctg

SEQ ID NO: 29232 - DNA, 20 bp, human
ggcggcgatatggaagagga

SEQ ID NO: 29233 - DNA, 20 bp, human
gggctggaactggagctagt

SEQ ID NO: 29234 - DNA, 20 bp, human
ggcacgcggcgatatggaag

SEQ ID NO: 29235 - DNA, 20 bp, human
gggatatccagtaaaagcaa

SEQ ID NO: 29236 - DNA, 20 bp, human
gcagacctaggagagtccgg

SEQ ID NO: 29237 - DNA, 20 bp, human
gagcgacggcagacgttcag

SEQ ID NO: 29238 - DNA, 20 bp, human
gtggccagccggcctcggcg

SEQ ID NO: 29239 - DNA, 20 bp, human
gaccccagagccgcgaggtc

SEQ ID NO: 29240 - DNA, 20 bp, human
ggtcgggcagctgggagcga

SEQ ID NO: 29241 - DNA, 20 bp, human
ggccgggcggtagctgggag

SEQ ID NO: 29242 - DNA, 20 bp, human
gacctgacctcgcggctctg

SEQ ID NO: 29243 - DNA, 20 bp, human
gctctgagtcccgatccccg

SEQ ID NO: 29244 - DNA, 20 bp, human
gacccagacctaggagagtc

SEQ ID NO: 29245 - DNA, 20 bp, human
gaccgtcagccgcggggatc

SEQ ID NO: 29246 - DNA, 20 bp, human
ggagggtggcaggagtagag

SEQ ID NO: 29247 - DNA, 20 bp, human
gggaatatgaagtcaagaaa

SEQ ID NO: 29248 - DNA, 20 bp, human
gggagctgcggggaacacca

SEQ ID NO: 29249 - DNA, 20 bp, human
gtgccagaggccactgagag

SEQ ID NO: 29250 - DNA, 20 bp, human
gcagccagggcaattccgat

SEQ ID NO: 29251 - DNA, 20 bp, human
gtgtctggctgtccaagagt

SEQ ID NO: 29252 - DNA, 20 bp, human
gcttggacagccagacagtc

SEQ ID NO: 29253 - DNA, 20 bp, human
gtccacgttagggatgccag

SEQ ID NO: 29254 - DNA, 20 bp, human
ggataggatgttgcctacac

SEQ ID NO: 29255 - DNA, 20 bp, human
gtccctaacgtggacagaca

SEQ ID NO: 29256 - DNA, 20 bp, human
ggacacagcgaacctctagg

SEQ ID NO: 29257 - DNA, 20 bp, human
gcacatagaaagataacgac

SEQ ID NO: 29258 - DNA, 20 bp, human
gaaggacacagcgaacctct

SEQ ID NO: 29259 - DNA, 20 bp, human
gaagataacgacgggaagag

SEQ ID NO: 29260 - DNA, 20 bp, human
gcctcctcccaccagacagg

SEQ ID NO: 29261 - DNA, 20 bp, human
gtctcagctgggaaggaccg

SEQ ID NO: 29262 - DNA, 20 bp, human
gagggcaggtgcgaccgcac

SEQ ID NO: 29263 - DNA, 20 bp, human
gagggagagcaccaagcaat

SEQ ID NO: 29264 - DNA, 20 bp, human
ggaacaactggcaagtgcac

SEQ ID NO: 29265 - DNA, 20 bp, human
gcgattcaacagacgcgggt

SEQ ID NO: 29266 - DNA, 20 bp, human
gaggaggttgcgaaaggcgc

SEQ ID NO: 29267 - DNA, 20 bp, human
ggagcagcccgccggagcgg

SEQ ID NO: 29268 - DNA, 20 bp, human
gcagaggccgaagacgagac

SEQ ID NO: 29269 - DNA, 20 bp, human
gggctgctcgctgcatctct

SEQ ID NO: 29270 - DNA, 20 bp, human
gactgaagtccgggaacccg

SEQ ID NO: 29271 - DNA, 20 bp, human
gcgctggcggtactgaagtc

SEQ ID NO: 29272 - DNA, 20 bp, human
ggggccgaggaggttgcgaa

SEQ ID NO: 29273 - DNA, 20 bp, human
ggatgcagcgagcagcccgc

SEQ ID NO: 29274 - DNA, 20 bp, human
gccggtctgctctctatagg

SEQ ID NO: 29275 - DNA, 20 bp, human
ggcaagaacagccgccgctc

SEQ ID NO: 29276 - DNA, 20 bp, human
ggctgcggcggaacggctgt

SEQ ID NO: 29277 - DNA, 20 bp, human
gcatggcgctccgagtcacc

SEQ ID NO: 29278 - DNA, 20 bp, human
ggcggggagaagcagaacac

SEQ ID NO: 29279 - DNA, 20 bp, human
ggggaggtggagagtcgact

SEQ ID NO: 29280 - DNA, 20 bp, human
gtgatagagggtccctgagt

SEQ ID NO: 29281 - DNA, 20 bp, human
ggggagaagcagaacaccgg

SEQ ID NO: 29282 - DNA, 20 bp, human
gttgctggcgggcccactca

SEQ ID NO: 29283 - DNA, 20 bp, human
gtctgctgggtgtaggtcct

SEQ ID NO: 29284 - DNA, 20 bp, human
ggcctggtgagagagtgtgg

SEQ ID NO: 29285 - DNA, 20 bp, human
gggctcttctcggcgtgctg

SEQ ID NO: 29286 - DNA, 20 bp, human
gccagcccaccaaaacggag

SEQ ID NO: 29287 - DNA, 20 bp, human
ggggccctctagacactcac

SEQ ID NO: 29288 - DNA, 20 bp, human
gaccaggactcggagacgga

SEQ ID NO: 29289 - DNA, 20 bp, human
ggttctgaagacacttccca

SEQ ID NO: 29290 - DNA, 20 bp, human
ggagggcccaggtccttact

SEQ ID NO: 29291 - DNA, 20 bp, human
gacaaacccagtaaggacct

SEQ ID NO: 29292 - DNA, 20 bp, human
gtttccctctccgttttggt

SEQ ID NO: 29293 - DNA, 20 bp, human
gagtactgcagaggcccacg

SEQ ID NO: 29294 - DNA, 20 bp, human
gtctccggtgagtgtctaga

SEQ ID NO: 29295 - DNA, 20 bp, human
gaaataaaggcctgccacct

SEQ ID NO: 29296 - DNA, 20 bp, human
ggaagcgacaggggagctgt

SEQ ID NO: 29297 - DNA, 20 bp, human
ggctcggagagcagtcctaa

SEQ ID NO: 29298 - DNA, 20 bp, human
gggacgcggactgaaaaggg

SEQ ID NO: 29299 - DNA, 20 bp, human
gactaggcctagtgctctgg

SEQ ID NO: 29300 - DNA, 20 bp, human
ggcccggggaccgctctcag

SEQ ID NO: 29301 - DNA, 20 bp, human
ggagggacgcggactgaaaa

SEQ ID NO: 29302 - DNA, 20 bp, human
ggggaggacactagcgtacg

SEQ ID NO: 29303 - DNA, 20 bp, human
gggagggcggaatccagacg

SEQ ID NO: 29304 - DNA, 20 bp, human
gtagcgtacgaggcgccgtt

SEQ ID NO: 29305 - DNA, 20 bp, human
gtaggaaagcgcttccgaga

SEQ ID NO: 29306 - DNA, 20 bp, human
gtgagacagttgggctgagg

SEQ ID NO: 29307 - DNA, 20 bp, human
gtacttcaggctgaccgtgg

SEQ ID NO: 29308 - DNA, 20 bp, human
gccgtcattctgagacagtt

SEQ ID NO: 29309 - DNA, 20 bp, human
gacagttgggctgaggcggt

SEQ ID NO: 29310 - DNA, 20 bp, human
gtcagaacaactggtacgag

SEQ ID NO: 29311 - DNA, 20 bp, human
gttctgagacagttgggctg

SEQ ID NO: 29312 - DNA, 20 bp, human
gaagtacttcaggctgaccg

SEQ ID NO: 29313 - DNA, 20 bp, human
ggttctgaggtgcatttctg

SEQ ID NO: 29314 - DNA, 20 bp, human
gaaagtttgttggtttgaca

SEQ ID NO: 29315 - DNA, 20 bp, human
gtgggaggaaaactggctga

SEQ ID NO: 29316 - DNA, 20 bp, human
gaccatagacccagcccgtc

SEQ ID NO: 29317 - DNA, 20 bp, human
ggaggagcgcggttaccgga

SEQ ID NO: 29318 - DNA, 20 bp, human
ggctcgactccgctccgcgg

SEQ ID NO: 29319 - DNA, 20 bp, human
ggcggggggtcggatagagt

SEQ ID NO: 29320 - DNA, 20 bp, human
gagccgagctgatttgatcg

SEQ ID NO: 29321 - DNA, 20 bp, human
gatagagtgggcacaggtac

SEQ ID NO: 29322 - DNA, 20 bp, human
gcgagtgccggggtcctcac

SEQ ID NO: 29323 - DNA, 20 bp, human
gaccggacgggctgggtcta

SEQ ID NO: 29324 - DNA, 20 bp, human
gtgggtctatggtcgctccg

SEQ ID NO: 29325 - DNA, 20 bp, human
gcggtctcccgtgaggaccc

SEQ ID NO: 29326 - DNA, 20 bp, human
ggtccgcacgctccggcgag

SEQ ID NO: 29327 - DNA, 20 bp, human
gcagcagagtccgcacgctc

SEQ ID NO: 29328 - DNA, 20 bp, human
ggtgagtagcaaagaaacgt

SEQ ID NO: 29329 - DNA, 20 bp, human
gcggatccctagaaacacca

SEQ ID NO: 29330 - DNA, 20 bp, human
gtgcgccgacagccctctgg

SEQ ID NO: 29331 - DNA, 20 bp, human
gtgcccctcgccggagcgtg

SEQ ID NO: 29332 - DNA, 20 bp, human
gtactgcgccgacagccctc

SEQ ID NO: 29333 - DNA, 20 bp, human
gctgcgggccatgctgaagg

SEQ ID NO: 29334 - DNA, 20 bp, human
gacccggtcgttgaggaggt

SEQ ID NO: 29335 - DNA, 20 bp, human
gagcaaagaaacgtgggtct

SEQ ID NO: 29336 - DNA, 20 bp, human
gttgaaagtagggacctcag

SEQ ID NO: 29337 - DNA, 20 bp, human
gggaggtggcaagagtgtgg

SEQ ID NO: 29338 - DNA, 20 bp, human
gatgggtgcaaggaaaatta

SEQ ID NO: 29339 - DNA, 20 bp, human
gcatctgattggacaggcat

SEQ ID NO: 29340 - DNA, 20 bp, human
gattcatcggaaccgaactt

SEQ ID NO: 29341 - DNA, 20 bp, human
gttctctaggtaaacctctg

SEQ ID NO: 29342 - DNA, 20 bp, human
gattaaatctgtaacatcaa

SEQ ID NO: 29343 - DNA, 20 bp, human
gaggtgagaaaaaaacaatc

SEQ ID NO: 29344 - DNA, 20 bp, human
gagagaacaggtggttttta

SEQ ID NO: 29345 - DNA, 20 bp, human
gtttaggaagtgttgaaggg

SEQ ID NO: 29346 - DNA, 20 bp, human
ggtgggcgagcagagcctcg

SEQ ID NO: 29347 - DNA, 20 bp, human
gttgcgtcaccgcttcagag

SEQ ID NO: 29348 - DNA, 20 bp, human
gagcggagaagagcgagcag

SEQ ID NO: 29349 - DNA, 20 bp, human
gccagttttaaggggaggac

SEQ ID NO: 29350 - DNA, 20 bp, human
ggagctgctgtgccacgagg

SEQ ID NO: 29351 - DNA, 20 bp, human
gagagcgagaccagttttaa

SEQ ID NO: 29352 - DNA, 20 bp, human
gggggctgcctcactcgcac

SEQ ID NO: 29353 - DNA, 20 bp, human
gatgctggaggtaggtcggg

SEQ ID NO: 29354 - DNA, 20 bp, human
gggaaggtagcgctcctcga

SEQ ID NO: 29355 - DNA, 20 bp, human
gacttgaagtaggagcactg

SEQ ID NO: 29356 - DNA, 20 bp, human
ggagtcccaaggcaggcgac

SEQ ID NO: 29357 - DNA, 20 bp, human
ggcgacgtccgagcattcca

SEQ ID NO: 29358 - DNA, 20 bp, human
gtgcgggctcgcgagtccca

SEQ ID NO: 29359 - DNA, 20 bp, human
gtccgaggctaagactcccg

SEQ ID NO: 29360 - DNA, 20 bp, human
gggctcgcgagtcccaaggc

SEQ ID NO: 29361 - DNA, 20 bp, human
gttagggctcgggaaagcaa

SEQ ID NO: 29362 - DNA, 20 bp, human
ggcgtgggtgccctagtgaa

SEQ ID NO: 29363 - DNA, 20 bp, human
gtgcacgcactggaagtagg

SEQ ID NO: 29364 - DNA, 20 bp, human
gcaatctgcaggatgctccg

SEQ ID NO: 29365 - DNA, 20 bp, human
gcccgggtctggacacaccg

SEQ ID NO: 29366 - DNA, 20 bp, human
gcgggacgctggaggaactg

SEQ ID NO: 29367 - DNA, 20 bp, human
gtgccgaaggccgcaaacac

SEQ ID NO: 29368 - DNA, 20 bp, human
gcttcggcaagcgactgaga

SEQ ID NO: 29369 - DNA, 20 bp, human
gttccgggccacagcgtcaa

SEQ ID NO: 29370 - DNA, 20 bp, human
gggctgtcgcagtgcggctc

SEQ ID NO: 29371 - DNA, 20 bp, human
gaactcctcggtggtctcct

SEQ ID NO: 29372 - DNA, 20 bp, human
gacacgccacacccacaagt

SEQ ID NO: 29373 - DNA, 20 bp, human
gcaaaggcgaagccagggtg

SEQ ID NO: 29374 - DNA, 20 bp, human
gcgacagccgctccacttcc

SEQ ID NO: 29375 - DNA, 20 bp, human
gggagagcagtcccctccgt

SEQ ID NO: 29376 - DNA, 20 bp, human
ggccgccagcgcggtgtagg

SEQ ID NO: 29377 - DNA, 20 bp, human
ggcggccgccagcgcggtgt

SEQ ID NO: 29378 - DNA, 20 bp, human
gggcctgtcacccgcgaccc

SEQ ID NO: 29379 - DNA, 20 bp, human
gggacggcgcgctccagtcc

SEQ ID NO: 29380 - DNA, 20 bp, human
gtgacaggccaccccgccat

SEQ ID NO: 29381 - DNA, 20 bp, human
gggcgacgggccggtgaggg

SEQ ID NO: 29382 - DNA, 20 bp, human
gccgcgcgcaaagggggaag

SEQ ID NO: 29383 - DNA, 20 bp, human
gtccgccgcggacaagaccc

SEQ ID NO: 29384 - DNA, 20 bp, human
gaagatggccgatggcgggg

SEQ ID NO: 29385 - DNA, 20 bp, human
gccgggccccgggaggcgac

SEQ ID NO: 29386 - DNA, 20 bp, human
gcgcgtaggggggatgtggg

SEQ ID NO: 29387 - DNA, 20 bp, human
gccgatcacttaccacaggc

SEQ ID NO: 29388 - DNA, 20 bp, human
gctgcgcgtaggggggatgt

SEQ ID NO: 29389 - DNA, 20 bp, human
ggcccctccgagcggcggta

SEQ ID NO: 29390 - DNA, 20 bp, human
ggccctaccgccgctcggag

SEQ ID NO: 29391 - DNA, 20 bp, human
gagccgagcggtagctggtc

SEQ ID NO: 29392 - DNA, 20 bp, human
ggtcccggcgcccctccgag

SEQ ID NO: 29393 - DNA, 20 bp, human
gggagttgctgcgcgtaggg

SEQ ID NO: 29394 - DNA, 20 bp, human
ggagaagcccctagaatgag

SEQ ID NO: 29395 - DNA, 20 bp, human
ggtgaggagttgctgcgcgt

SEQ ID NO: 29396 - DNA, 20 bp, human
gcgacgcgagcgcggcgatg

SEQ ID NO: 29397 - DNA, 20 bp, human
gcgcgggcgcgctctcaggc

SEQ ID NO: 29398 - DNA, 20 bp, human
gccacggccccgctggactg

SEQ ID NO: 29399 - DNA, 20 bp, human
gacccaccgtccgccccgca

SEQ ID NO: 29400 - DNA, 20 bp, human
gaaagggctgcggagcgcgt

SEQ ID NO: 29401 - DNA, 20 bp, human
ggctggactgaggctcggtc

SEQ ID NO: 29402 - DNA, 20 bp, human
gccccgcagggcaggcagaa

SEQ ID NO: 29403 - DNA, 20 bp, human
gcgcgctctcaggcgggctc

SEQ ID NO: 29404 - DNA, 20 bp, human
gggccgtggacctagctctg

SEQ ID NO: 29405 - DNA, 20 bp, human
gggcggcagcgacgcgagcg

SEQ ID NO: 29406 - DNA, 20 bp, human
gctgggtcggcagacacgaa

SEQ ID NO: 29407 - DNA, 20 bp, human
gtccgagctgaccctgatca

SEQ ID NO: 29408 - DNA, 20 bp, human
ggacaactcggccctgatca

SEQ ID NO: 29409 - DNA, 20 bp, human
gagtcccagggactagcctg

SEQ ID NO: 29410 - DNA, 20 bp, human
gacgaggagaggggactcgt

SEQ ID NO: 29411 - DNA, 20 bp, human
gcagggccgagttgtctcgg

SEQ ID NO: 29412 - DNA, 20 bp, human
gctcgtaggcaagaggagag

SEQ ID NO: 29413 - DNA, 20 bp, human
gcagcgccgccgagacaact

SEQ ID NO: 29414 - DNA, 20 bp, human
gggagctgcagtctctgtca

SEQ ID NO: 29415 - DNA, 20 bp, human
ggtctgccgacccagtccca

SEQ ID NO: 29416 - DNA, 20 bp, human
gtcatccgctggagcgacca

SEQ ID NO: 29417 - DNA, 20 bp, human
gcgggcgccagctccccccg

SEQ ID NO: 29418 - DNA, 20 bp, human
gttgcgccgcggcggagggt

SEQ ID NO: 29419 - DNA, 20 bp, human
ggcggtgggctggtcttccg

SEQ ID NO: 29420 - DNA, 20 bp, human
gagcaccctggtcgctccag

SEQ ID NO: 29421 - DNA, 20 bp, human
gctcggggaggtttccgctg

SEQ ID NO: 29422 - DNA, 20 bp, human
ggaggttgcgactaggttaa

SEQ ID NO: 29423 - DNA, 20 bp, human
gggacagatagatgctcgtg

SEQ ID NO: 29424 - DNA, 20 bp, human
ggctccagcggatgaggagc

SEQ ID NO: 29425 - DNA, 20 bp, human
gctccgccgcggcgcaacgc

SEQ ID NO: 29426 - DNA, 20 bp, human
gaagatctcgcggaagccta

SEQ ID NO: 29427 - DNA, 20 bp, human
gtccgcgagatcttcggtgg

SEQ ID NO: 29428 - DNA, 20 bp, human
ggcaccttgccaggttccgt

SEQ ID NO: 29429 - DNA, 20 bp, human
ggaatcgtgaccaggtccag

SEQ ID NO: 29430 - DNA, 20 bp, human
ggcttccgcgagatcttcgg

SEQ ID NO: 29431 - DNA, 20 bp, human
gcgtggccaacgggaaggtg

SEQ ID NO: 29432 - DNA, 20 bp, human
gagatcttcggtgggggtac

SEQ ID NO: 29433 - DNA, 20 bp, human
gcccaaacgcatcagcgtcc

SEQ ID NO: 29434 - DNA, 20 bp, human
gacccccaccgaagatctcg

SEQ ID NO: 29435 - DNA, 20 bp, human
gaaagccgtggccaacggga

SEQ ID NO: 29436 - DNA, 20 bp, human
gagagctgtaggcctcacag

SEQ ID NO: 29437 - DNA, 20 bp, human
ggggacgactcggccaactg

SEQ ID NO: 29438 - DNA, 20 bp, human
gccgctcgcggggaaggctg

SEQ ID NO: 29439 - DNA, 20 bp, human
gcgcgcctatgagaatgagg

SEQ ID NO: 29440 - DNA, 20 bp, human
ggctccctctcgccataggg

SEQ ID NO: 29441 - DNA, 20 bp, human
gataagaaaaagcgagacag

SEQ ID NO: 29442 - DNA, 20 bp, human
gaccccgcgtcaccactgtg

SEQ ID NO: 29443 - DNA, 20 bp, human
gccgcgcgcctatgagaatg

SEQ ID NO: 29444 - DNA, 20 bp, human
gacgactcggccaactgagg

SEQ ID NO: 29445 - DNA, 20 bp, human
gctcaggccgggggtcatca

SEQ ID NO: 29446 - DNA, 20 bp, human
gcggcagcgacgggtacctg

SEQ ID NO: 29447 - DNA, 20 bp, human
gacgcgcgaggagggccacg

SEQ ID NO: 29448 - DNA, 20 bp, human
gccgcagccgtcgagctcag

SEQ ID NO: 29449 - DNA, 20 bp, human
gagggccacgcggcagcgac

SEQ ID NO: 29450 - DNA, 20 bp, human
gcccgaggccatgtcgtgag

SEQ ID NO: 29451 - DNA, 20 bp, human
gtccgggctggcgggtccca

SEQ ID NO: 29452 - DNA, 20 bp, human
gcgctgacctctgagctcga

SEQ ID NO: 29453 - DNA, 20 bp, human
gcagctggcccaggaccgcg

SEQ ID NO: 29454 - DNA, 20 bp, human
gtgccgtgcacgcgcgagga

SEQ ID NO: 29455 - DNA, 20 bp, human
gtggcggggcggcaaacccc

SEQ ID NO: 29456 - DNA, 20 bp, human
gctcccatggcaaagcccgg

SEQ ID NO: 29457 - DNA, 20 bp, human
gcaggcagacgctcaccccc

SEQ ID NO: 29458 - DNA, 20 bp, human
gctctccccgctcctcaggg

SEQ ID NO: 29459 - DNA, 20 bp, human
gacgtccatgcggagacccg

SEQ ID NO: 29460 - DNA, 20 bp, human
gggcaactctcgaacaaaga

SEQ ID NO: 29461 - DNA, 20 bp, human
gtggcaactcagggcccgag

SEQ ID NO: 29462 - DNA, 20 bp, human
gagttctcccgccctccctg

SEQ ID NO: 29463 - DNA, 20 bp, human
gttccgcgcggcctcagaaa

SEQ ID NO: 29464 - DNA, 20 bp, human
gggggcagcggaccctcccg

SEQ ID NO: 29465 - DNA, 20 bp, human
gcgcgagacgagattggcag

SEQ ID NO: 29466 - DNA, 20 bp, human
gccgtgtccggcgagcagag

SEQ ID NO: 29467 - DNA, 20 bp, human
gtgtccggcgagcagagggg

SEQ ID NO: 29468 - DNA, 20 bp, human
gtctggtccgcggaaggctg

SEQ ID NO: 29469 - DNA, 20 bp, human
ggacctccagctcctctgag

SEQ ID NO: 29470 - DNA, 20 bp, human
gggaggtcgcctctggtccg

SEQ ID NO: 29471 - DNA, 20 bp, human
gccggctcgagggcaggatg

SEQ ID NO: 29472 - DNA, 20 bp, human
gcgggacccgagcgcacgca

SEQ ID NO: 29473 - DNA, 20 bp, human
gaggcgctccgcactcccga

SEQ ID NO: 29474 - DNA, 20 bp, human
gcccctcctgcgccgctcag

SEQ ID NO: 29475 - DNA, 20 bp, human
gcaattcccccagcgaggga

SEQ ID NO: 29476 - DNA, 20 bp, human
ggcaaggagagacgtcgctg

SEQ ID NO: 29477 - DNA, 20 bp, human
gtgagtgacccaccgactga

SEQ ID NO: 29478 - DNA, 20 bp, human
gcggcgctgccctcagtcgg

SEQ ID NO: 29479 - DNA, 20 bp, human
gtatacaagatggccgcagt

SEQ ID NO: 29480 - DNA, 20 bp, human
gaagatggccgcagtcggca

SEQ ID NO: 29481 - DNA, 20 bp, human
gtagcggccctcgcactggg

SEQ ID NO: 29482 - DNA, 20 bp, human
gggacgcagcgtgatgacgt

SEQ ID NO: 29483 - DNA, 20 bp, human
ggccaaccgccgctatccac

SEQ ID NO: 29484 - DNA, 20 bp, human
gtctaggggttgggcaaaag

SEQ ID NO: 29485 - DNA, 20 bp, human
gggggcttgcctgaagcgag

SEQ ID NO: 29486 - DNA, 20 bp, human
gggctgttgcagctgatggg

SEQ ID NO: 29487 - DNA, 20 bp, human
gcttgcggcacttgtggtgt

SEQ ID NO: 29488 - DNA, 20 bp, human
gtgcctctgagaaccaggag

SEQ ID NO: 29489 - DNA, 20 bp, human
gctcagaggcagcctgtcct

SEQ ID NO: 29490 - DNA, 20 bp, human
gcaacgacactgctaggaca

SEQ ID NO: 29491 - DNA, 20 bp, human
gccgacaggcttcagaaccc

SEQ ID NO: 29492 - DNA, 20 bp, human
gacacggcaacgacaccgac

SEQ ID NO: 29493 - DNA, 20 bp, human
gtaagcgagccgtggtgagt

SEQ ID NO: 29494 - DNA, 20 bp, human
gatggttcggagctttgaga

SEQ ID NO: 29495 - DNA, 20 bp, human
gggaaagcctgctctaccca

SEQ ID NO: 29496 - DNA, 20 bp, human
ggagccgcccgcgcttgggg

SEQ ID NO: 29497 - DNA, 20 bp, human
gcccagaacccggcggtcac

SEQ ID NO: 29498 - DNA, 20 bp, human
ggtgcggctcgctaagacta

SEQ ID NO: 29499 - DNA, 20 bp, human
ggcacggtgatactgagatg

SEQ ID NO: 29500 - DNA, 20 bp, human
ggtatcaccgtgccccggga

SEQ ID NO: 29501 - DNA, 20 bp, human
gcgtgaagcggcccagaacc

SEQ ID NO: 29502 - DNA, 20 bp, human
ggatgcggcgtaggggacgg

SEQ ID NO: 29503 - DNA, 20 bp, human
gatactgagatgcggcgtag

SEQ ID NO: 29504 - DNA, 20 bp, human
ggctgcgttgggcttgcgtg

SEQ ID NO: 29505 - DNA, 20 bp, human
ggggccggagcactgacctg

SEQ ID NO: 29506 - DNA, 20 bp, human
ggggagtcggcggcacaaaa

SEQ ID NO: 29507 - DNA, 20 bp, human
gctgagggaagaagccgaag

SEQ ID NO: 29508 - DNA, 20 bp, human
gtggctagggaatggcgccg

SEQ ID NO: 29509 - DNA, 20 bp, human
gagtgcgctggatcccgaga

SEQ ID NO: 29510 - DNA, 20 bp, human
gctcgcagcccaccacgcgg

SEQ ID NO: 29511 - DNA, 20 bp, human
ggccggcgccccgggatctg

SEQ ID NO: 29512 - DNA, 20 bp, human
gcgaggccgctcgacatgga

SEQ ID NO: 29513 - DNA, 20 bp, human
gccggcccaggtaaccgctg

SEQ ID NO: 29514 - DNA, 20 bp, human
ggactcgccgccaacaaagg

SEQ ID NO: 29515 - DNA, 20 bp, human
ggcggccgcgccctcacctg

SEQ ID NO: 29516 - DNA, 20 bp, human
ggcactcgaaagtgcgaagg

SEQ ID NO: 29517 - DNA, 20 bp, human
gttcaacgcccgggctgcgg

SEQ ID NO: 29518 - DNA, 20 bp, human
gggcacggcagccacaagtg

SEQ ID NO: 29519 - DNA, 20 bp, human
gaccttcaacgcccgggctg

SEQ ID NO: 29520 - DNA, 20 bp, human
ggcagctctggccgtagtcg

SEQ ID NO: 29521 - DNA, 20 bp, human
gcgcctcccgcgggtggaag

SEQ ID NO: 29522 - DNA, 20 bp, human
gcgaaagtgcgaaggaggcc

SEQ ID NO: 29523 - DNA, 20 bp, human
gggcgttgaaggtagtaaag

SEQ ID NO: 29524 - DNA, 20 bp, human
ggggaggagaggaagagcgg

SEQ ID NO: 29525 - DNA, 20 bp, human
gtcaccatgatgcggccggg

SEQ ID NO: 29526 - DNA, 20 bp, human
gcggatgtgggtcgcctctt

SEQ ID NO: 29527 - DNA, 20 bp, human
gccttctggttgaagcacta

SEQ ID NO: 29528 - DNA, 20 bp, human
ggttgggagagcccacgatg

SEQ ID NO: 29529 - DNA, 20 bp, human
gagttagcgctagggaagcg

SEQ ID NO: 29530 - DNA, 20 bp, human
ggcccccgcacagcggatgt

SEQ ID NO: 29531 - DNA, 20 bp, human
ggaattcccagcaaggctgg

SEQ ID NO: 29532 - DNA, 20 bp, human
gcatggcgggaccaactcca

SEQ ID NO: 29533 - DNA, 20 bp, human
gaaccagaaggcagcggcga

SEQ ID NO: 29534 - DNA, 20 bp, human
gacccacatccgctgtgcgg

SEQ ID NO: 29535 - DNA, 20 bp, human
gcttcccagcgtcacctaag

SEQ ID NO: 29536 - DNA, 20 bp, human
gggcggaggaggaagtgtca

SEQ ID NO: 29537 - DNA, 20 bp, human
ggggtgaatgaaggagcggg

SEQ ID NO: 29538 - DNA, 20 bp, human
gcgggtccgcgcagtctcgt

SEQ ID NO: 29539 - DNA, 20 bp, human
gcgcatgccgggtctagggt

SEQ ID NO: 29540 - DNA, 20 bp, human
gcgtgaggctgcgacagtga

SEQ ID NO: 29541 - DNA, 20 bp, human
gatgaaggagcgggcggagg

SEQ ID NO: 29542 - DNA, 20 bp, human
gggaggaagtgtcatggcgt

SEQ ID NO: 29543 - DNA, 20 bp, human
gggtgtgaagagaggcggtc

SEQ ID NO: 29544 - DNA, 20 bp, human
gggcaccaggcccggcgacc

SEQ ID NO: 29545 - DNA, 20 bp, human
ggacccgcccaaaaggaaaa

SEQ ID NO: 29546 - DNA, 20 bp, human
gcgcgccgcgaggagtccgg

SEQ ID NO: 29547 - DNA, 20 bp, human
ggactagccgacgagcgggc

SEQ ID NO: 29548 - DNA, 20 bp, human
gacctgagccgcgaggacac

SEQ ID NO: 29549 - DNA, 20 bp, human
gccggccgccgggtcagcag

SEQ ID NO: 29550 - DNA, 20 bp, human
gcgctcgccgccacgggagg

SEQ ID NO: 29551 - DNA, 20 bp, human
gcaactggggaagcgcgggg

SEQ ID NO: 29552 - DNA, 20 bp, human
gccgctgcccgcccgctcgt

SEQ ID NO: 29553 - DNA, 20 bp, human
ggttccgccccctcccgtgg

SEQ ID NO: 29554 - DNA, 20 bp, human
gccggaggaatgcccactcc

SEQ ID NO: 29555 - DNA, 20 bp, human
ggcccgctcgccgccacggg

SEQ ID NO: 29556 - DNA, 20 bp, human
gagacgagtcagcttaaggg

SEQ ID NO: 29557 - DNA, 20 bp, human
gcgcagacgagtcagcttaa

SEQ ID NO: 29558 - DNA, 20 bp, human
gccctctccgaaatccaact

SEQ ID NO: 29559 - DNA, 20 bp, human
ggcgaccgcgagatgcccga

SEQ ID NO: 29560 - DNA, 20 bp, human
gttgagggcggcggagtagg

SEQ ID NO: 29561 - DNA, 20 bp, human
gcttaccttcgggcatctcg

SEQ ID NO: 29562 - DNA, 20 bp, human
ggcggtagcgcccgctgtgg

SEQ ID NO: 29563 - DNA, 20 bp, human
gaggagcggaggcttcccat

SEQ ID NO: 29564 - DNA, 20 bp, human
gccgcgctctctcccggcag

SEQ ID NO: 29565 - DNA, 20 bp, human
gcggcggcagcgcggcggtg

SEQ ID NO: 29566 - DNA, 20 bp, human
ggatccgtaatatggcgggg

SEQ ID NO: 29567 - DNA, 20 bp, human
gccgccatattacggatctc

SEQ ID NO: 29568 - DNA, 20 bp, human
gggatctcaggctgcaacgc

SEQ ID NO: 29569 - DNA, 20 bp, human
gacgggtccgggctgagagg

SEQ ID NO: 29570 - DNA, 20 bp, human
gcagcctgagatccgtaata

SEQ ID NO: 29571 - DNA, 20 bp, human
ggagccggagaaccccatcg

SEQ ID NO: 29572 - DNA, 20 bp, human
ggcccgccctcagcttctca

SEQ ID NO: 29573 - DNA, 20 bp, human
gctgagaggtggagtcgggg

SEQ ID NO: 29574 - DNA, 20 bp, human
ggcctggagggccctcggtt

SEQ ID NO: 29575 - DNA, 20 bp, human
ggccctgagaggtggagtcg

SEQ ID NO: 29576 - DNA, 20 bp, human
ggctgtgaccgccgccactg

SEQ ID NO: 29577 - DNA, 20 bp, human
gggcagccagcacaatcggg

SEQ ID NO: 29578 - DNA, 20 bp, human
gtggggcagccagcacaatc

SEQ ID NO: 29579 - DNA, 20 bp, human
gcctagtacagtacctgaag

SEQ ID NO: 29580 - DNA, 20 bp, human
ggtggcggcggtcacagctc

SEQ ID NO: 29581 - DNA, 20 bp, human
gcagcacaatcgggcggagg

SEQ ID NO: 29582 - DNA, 20 bp, human
gcgaactgcgcgccaagggt

SEQ ID NO: 29583 - DNA, 20 bp, human
gctcaaagcctgcccagtga

SEQ ID NO: 29584 - DNA, 20 bp, human
gcggctcagtagaggagcag

SEQ ID NO: 29585 - DNA, 20 bp, human
gactcgcgcacggcccgagg

SEQ ID NO: 29586 - DNA, 20 bp, human
gacacttactctggttccaa

SEQ ID NO: 29587 - DNA, 20 bp, human
ggcagctaggggctcctcaa

SEQ ID NO: 29588 - DNA, 20 bp, human
ggccttggagatgcatccat

SEQ ID NO: 29589 - DNA, 20 bp, human
gagacaagtgacacttactc

SEQ ID NO: 29590 - DNA, 20 bp, human
ggcccatggatgcatctcca

SEQ ID NO: 29591 - DNA, 20 bp, human
gcccagaaacaaagacttca

SEQ ID NO: 29592 - DNA, 20 bp, human
ggtcagtactaagggacaaa

SEQ ID NO: 29593 - DNA, 20 bp, human
gggagacaatcctggccata

SEQ ID NO: 29594 - DNA, 20 bp, human
gtcttatctgttactgtgga

SEQ ID NO: 29595 - DNA, 20 bp, human
gaagacatgcatgcagctag

SEQ ID NO: 29596 - DNA, 20 bp, human
gtctgaggtatagccacagg

SEQ ID NO: 29597 - DNA, 20 bp, human
gtagccagagatggggacgg

SEQ ID NO: 29598 - DNA, 20 bp, human
gacctgtgtagccagagatg

SEQ ID NO: 29599 - DNA, 20 bp, human
gggttgtgggacagggacta

SEQ ID NO: 29600 - DNA, 20 bp, human
gtgaggcaaagcctgcatat

SEQ ID NO: 29601 - DNA, 20 bp, human
gctggactccaacctccgtc

SEQ ID NO: 29602 - DNA, 20 bp, human
gagaagggttacagagaggg

SEQ ID NO: 29603 - DNA, 20 bp, human
gtccaacctccgtctggagt

SEQ ID NO: 29604 - DNA, 20 bp, human
ggacagggactagggctgag

SEQ ID NO: 29605 - DNA, 20 bp, human
gccaggagagggcgctgcaa

SEQ ID NO: 29606 - DNA, 20 bp, human
gcaactcaggagatccacag

SEQ ID NO: 29607 - DNA, 20 bp, human
gcaggcagtcctggtatgtc

SEQ ID NO: 29608 - DNA, 20 bp, human
gcgtccttgggtgctcagag

SEQ ID NO: 29609 - DNA, 20 bp, human
gccagcttgtggcttgtctc

SEQ ID NO: 29610 - DNA, 20 bp, human
gccacaagctggtgagttgt

SEQ ID NO: 29611 - DNA, 20 bp, human
gctgagaagcctgacatacc

SEQ ID NO: 29612 - DNA, 20 bp, human
gctgaaccaaacagatctag

SEQ ID NO: 29613 - DNA, 20 bp, human
gtgatcaagatgagaggcag

SEQ ID NO: 29614 - DNA, 20 bp, human
gaagtgaaggcggagataca

SEQ ID NO: 29615 - DNA, 20 bp, human
ggaactgttagtctaaatat

SEQ ID NO: 29616 - DNA, 20 bp, human
gggtagtatggggccagagt

SEQ ID NO: 29617 - DNA, 20 bp, human
gaagtataggagggtaacat

SEQ ID NO: 29618 - DNA, 20 bp, human
gggtcttcttgtgcttatcc

SEQ ID NO: 29619 - DNA, 20 bp, human
ggtgacgcctaagctatcac

SEQ ID NO: 29620 - DNA, 20 bp, human
ggctatcactggacatatca

SEQ ID NO: 29621 - DNA, 20 bp, human
gagaagaaaatggagatatg

SEQ ID NO: 29622 - DNA, 20 bp, human
gggtataaagggccaagttt

SEQ ID NO: 29623 - DNA, 20 bp, human
gttagaagagattttcaggt

SEQ ID NO: 29624 - DNA, 20 bp, human
gcagtgctcttggatctagg

SEQ ID NO: 29625 - DNA, 20 bp, human
gctattaagtgtaagctctt

SEQ ID NO: 29626 - DNA, 20 bp, human
ggtgtgcgacccaagaccct

SEQ ID NO: 29627 - DNA, 20 bp, human
gctgaaagcggctctgagga

SEQ ID NO: 29628 - DNA, 20 bp, human
gaagcaaggtaagcagggac

SEQ ID NO: 29629 - DNA, 20 bp, human
gaaaggcataaacaaggctg

SEQ ID NO: 29630 - DNA, 20 bp, human
gctctgagccctcatctgat

SEQ ID NO: 29631 - DNA, 20 bp, human
gcagaaaagcaaggtaagca

SEQ ID NO: 29632 - DNA, 20 bp, human
gaaaatgaaaggcataaaca

SEQ ID NO: 29633 - DNA, 20 bp, human
ggaggagttaggaaattatc

SEQ ID NO: 29634 - DNA, 20 bp, human
gtaagccctagactcgtgag

SEQ ID NO: 29635 - DNA, 20 bp, human
gcagggacggggacattccc

SEQ ID NO: 29636 - DNA, 20 bp, human
ggctgagaggttacttaccg

SEQ ID NO: 29637 - DNA, 20 bp, human
gtattcagaaggcatctcac

SEQ ID NO: 29638 - DNA, 20 bp, human
gcaagagggaagcctaaaaa

SEQ ID NO: 29639 - DNA, 20 bp, human
gaggcttccctcttgtctgg

SEQ ID NO: 29640 - DNA, 20 bp, human
gcttagacacaacttcttgt

SEQ ID NO: 29641 - DNA, 20 bp, human
gccggggagagtttcttgta

SEQ ID NO: 29642 - DNA, 20 bp, human
gtaaggaaagggtcacagtt

SEQ ID NO: 29643 - DNA, 20 bp, human
ggtgagtgaaagactttaaa

SEQ ID NO: 29644 - DNA, 20 bp, human
gagagtttcttgtaggggaa

SEQ ID NO: 29645 - DNA, 20 bp, human
gatctcagaagctaactaac

SEQ ID NO: 29646 - DNA, 20 bp, human
ggagtctctgcaagccgact

SEQ ID NO: 29647 - DNA, 20 bp, human
gccaggagataaccaggtaa

SEQ ID NO: 29648 - DNA, 20 bp, human
gggcccggagtgaggctgaa

SEQ ID NO: 29649 - DNA, 20 bp, human
gaagccgactgggaagattt

SEQ ID NO: 29650 - DNA, 20 bp, human
ggaggcattgaactccccag

SEQ ID NO: 29651 - DNA, 20 bp, human
ggattgtggggcccggagtg

SEQ ID NO: 29652 - DNA, 20 bp, human
ggcctgaggtgagcatgcca

SEQ ID NO: 29653 - DNA, 20 bp, human
gtagggtattgagtaatcgt

SEQ ID NO: 29654 - DNA, 20 bp, human
gccgtgtgagttaaagacat

SEQ ID NO: 29655 - DNA, 20 bp, human
gtgagtaatcgtaggatccc

SEQ ID NO: 29656 - DNA, 20 bp, human
gcccagtgtatgggtgaagg

SEQ ID NO: 29657 - DNA, 20 bp, human
gggcagcagtgtggccggag

SEQ ID NO: 29658 - DNA, 20 bp, human
gtgatgaccacagagtcctg

SEQ ID NO: 29659 - DNA, 20 bp, human
gcagcacaccacccagtgta

SEQ ID NO: 29660 - DNA, 20 bp, human
gaaggaggcagcagtgtggc

SEQ ID NO: 29661 - DNA, 20 bp, human
gcacataatagactcaacaa

SEQ ID NO: 29662 - DNA, 20 bp, human
gaatcctggcaggtaggtgt

SEQ ID NO: 29663 - DNA, 20 bp, human
gccacccagtgtatgggtga

SEQ ID NO: 29664 - DNA, 20 bp, human
gtgtggtcatcagtaagaga

SEQ ID NO: 29665 - DNA, 20 bp, human
gttcaccagcatatacacgt

SEQ ID NO: 29666 - DNA, 20 bp, human
gctgggcggtaaaaccacac

SEQ ID NO: 29667 - DNA, 20 bp, human
gcaggtccatgacgctctct

SEQ ID NO: 29668 - DNA, 20 bp, human
gaaaggtcctaagctctcta

SEQ ID NO: 29669 - DNA, 20 bp, human
gctcgcactacccctgtctg

SEQ ID NO: 29670 - DNA, 20 bp, human
ggtccatgacgctctctggg

SEQ ID NO: 29671 - DNA, 20 bp, human
gcagcagggacataagagag

SEQ ID NO: 29672 - DNA, 20 bp, human
gacaggggtagtgcgaggcc

SEQ ID NO: 29673 - DNA, 20 bp, human
gtgaagaggctcactcaccc

SEQ ID NO: 29674 - DNA, 20 bp, human
ggacagcagggggcattctc

SEQ ID NO: 29675 - DNA, 20 bp, human
ggtgagaaggaacagtacca

SEQ ID NO: 29676 - DNA, 20 bp, human
ggagcgcaggctgggaacga

SEQ ID NO: 29677 - DNA, 20 bp, human
gacctgggtgccatgcaggg

SEQ ID NO: 29678 - DNA, 20 bp, human
gctgccaggccaagcatcag

SEQ ID NO: 29679 - DNA, 20 bp, human
ggagcccctgaggatttagg

SEQ ID NO: 29680 - DNA, 20 bp, human
ggcctccctgcatggcaccc

SEQ ID NO: 29681 - DNA, 20 bp, human
gaaatgcccgagcgcaggct

SEQ ID NO: 29682 - DNA, 20 bp, human
gggggagctctgttgcaaca

SEQ ID NO: 29683 - DNA, 20 bp, human
ggcaggtggtgctgtggcca

SEQ ID NO: 29684 - DNA, 20 bp, human
gtccgctgtccactcaaaga

SEQ ID NO: 29685 - DNA, 20 bp, human
gactacaaatgcccgagcgc

SEQ ID NO: 29686 - DNA, 20 bp, human
gtgggaggatacctccagag

SEQ ID NO: 29687 - DNA, 20 bp, human
gaggtaactgaaggacacct

SEQ ID NO: 29688 - DNA, 20 bp, human
ggactttgtgaagaaggaat

SEQ ID NO: 29689 - DNA, 20 bp, human
gtgggtacagggcttctatc

SEQ ID NO: 29690 - DNA, 20 bp, human
ggaagatcctttataatacc

SEQ ID NO: 29691 - DNA, 20 bp, human
ggcctgcagagaatatggca

SEQ ID NO: 29692 - DNA, 20 bp, human
gaactcctacaagagtggga

SEQ ID NO: 29693 - DNA, 20 bp, human
gtgaaaactcctacaagagt

SEQ ID NO: 29694 - DNA, 20 bp, human
ggcttctatcaggtaactga

SEQ ID NO: 29695 - DNA, 20 bp, human
gatctgctgtttgtagtggg

SEQ ID NO: 29696 - DNA, 20 bp, human
gctcagactcaaggacctca

SEQ ID NO: 29697 - DNA, 20 bp, human
ggctgggttgctctctgcct

SEQ ID NO: 29698 - DNA, 20 bp, human
ggggcagtgtctcagactca

SEQ ID NO: 29699 - DNA, 20 bp, human
gagtctgagacactgcccca

SEQ ID NO: 29700 - DNA, 20 bp, human
gccaccagctctcagtgtct

SEQ ID NO: 29701 - DNA, 20 bp, human
gagatggtggccaggggtaa

SEQ ID NO: 29702 - DNA, 20 bp, human
ggggcgatgcaactctccct

SEQ ID NO: 29703 - DNA, 20 bp, human
gcaactctccctgggacagc

SEQ ID NO: 29704 - DNA, 20 bp, human
gcctacaagaaacctgggtt

SEQ ID NO: 29705 - DNA, 20 bp, human
gggtaaaggacacacccatg

SEQ ID NO: 29706 - DNA, 20 bp, human
gcgcttcagagatcctctgg

SEQ ID NO: 29707 - DNA, 20 bp, human
gtaaagagaaccaagtacga

SEQ ID NO: 29708 - DNA, 20 bp, human
gaaggtcacagggaaatcaa

SEQ ID NO: 29709 - DNA, 20 bp, human
ggaagcgtctgaaagcaacc

SEQ ID NO: 29710 - DNA, 20 bp, human
ggccccactcaccgagctca

SEQ ID NO: 29711 - DNA, 20 bp, human
gccaccaggggaatcaacag

SEQ ID NO: 29712 - DNA, 20 bp, human
gagtactcaaaagctccccc

SEQ ID NO: 29713 - DNA, 20 bp, human
gcagagatcctctggaggcc

SEQ ID NO: 29714 - DNA, 20 bp, human
gtcacaggaagctgcttcgg

SEQ ID NO: 29715 - DNA, 20 bp, human
gagcagtctgatcaaaagga

SEQ ID NO: 29716 - DNA, 20 bp, human
ggcagacggtgccgacgcag

SEQ ID NO: 29717 - DNA, 20 bp, human
ggtgagtgcaccccagttcc

SEQ ID NO: 29718 - DNA, 20 bp, human
gggtgttgcacctccctctc

SEQ ID NO: 29719 - DNA, 20 bp, human
gttccgggcggagaacgcca

SEQ ID NO: 29720 - DNA, 20 bp, human
gagtgcaccccagttccggg

SEQ ID NO: 29721 - DNA, 20 bp, human
gtcgcgcggcgcaggttctg

SEQ ID NO: 29722 - DNA, 20 bp, human
gactgtccgggcagtgtggg

SEQ ID NO: 29723 - DNA, 20 bp, human
gcgttctccgcccggaactg

SEQ ID NO: 29724 - DNA, 20 bp, human
gtcaggccagactccacgac

SEQ ID NO: 29725 - DNA, 20 bp, human
gaggtgcaacaccgctgcgt

SEQ ID NO: 29726 - DNA, 20 bp, human
ggtggtgactgggtccagaa

SEQ ID NO: 29727 - DNA, 20 bp, human
gggagttctgcgtctcgggg

SEQ ID NO: 29728 - DNA, 20 bp, human
ggaccaaccgatgatcgctg

SEQ ID NO: 29729 - DNA, 20 bp, human
gggaggagttctgcgtctcg

SEQ ID NO: 29730 - DNA, 20 bp, human
ggcacttccccagcgatcat

SEQ ID NO: 29731 - DNA, 20 bp, human
ggcaggagcaccaaccagcg

SEQ ID NO: 29732 - DNA, 20 bp, human
gccgcgaactccaactgcaa

SEQ ID NO: 29733 - DNA, 20 bp, human
gtagggtgcgagggtagcag

SEQ ID NO: 29734 - DNA, 20 bp, human
ggggccatgggatgaaacta

SEQ ID NO: 29735 - DNA, 20 bp, human
ggcgtctcggggtggtgact

SEQ ID NO: 29736 - DNA, 20 bp, human
ggtcgtgtaccgggtcccgt

SEQ ID NO: 29737 - DNA, 20 bp, human
ggacccggtacacgacacag

SEQ ID NO: 29738 - DNA, 20 bp, human
ggagcggctggcgctcgagg

SEQ ID NO: 29739 - DNA, 20 bp, human
gggaggctccgggactgagg

SEQ ID NO: 29740 - DNA, 20 bp, human
gcctcgctgcccgcagccta

SEQ ID NO: 29741 - DNA, 20 bp, human
gccaggtacccggcccggag

SEQ ID NO: 29742 - DNA, 20 bp, human
ggtagagccggcgacccagg

SEQ ID NO: 29743 - DNA, 20 bp, human
ggacccaggaggaggcggaa

SEQ ID NO: 29744 - DNA, 20 bp, human
gggtggcgccgcctcagtcc

SEQ ID NO: 29745 - DNA, 20 bp, human
ggaccgcacgcctagctcag

SEQ ID NO: 29746 - DNA, 20 bp, human
gctcgcaggcggccccgaca

SEQ ID NO: 29747 - DNA, 20 bp, human
gaggcggattggcagtaggt

SEQ ID NO: 29748 - DNA, 20 bp, human
gaggtgaccgcgccgtgtcg

SEQ ID NO: 29749 - DNA, 20 bp, human
gatgactgactgggaagcgg

SEQ ID NO: 29750 - DNA, 20 bp, human
gtgtctcaacatgactgact

SEQ ID NO: 29751 - DNA, 20 bp, human
ggggcgggctcgctcaccac

SEQ ID NO: 29752 - DNA, 20 bp, human
gcgtgctcggcgcagagacc

SEQ ID NO: 29753 - DNA, 20 bp, human
gggctcctcccgggcactca

SEQ ID NO: 29754 - DNA, 20 bp, human
gggagaggcggattggcagt

SEQ ID NO: 29755 - DNA, 20 bp, human
gcgccgagcacgccgggcct

SEQ ID NO: 29756 - DNA, 20 bp, human
gggacggaaggtgagacgaa

SEQ ID NO: 29757 - DNA, 20 bp, human
ggggctggcggggatgtgac

SEQ ID NO: 29758 - DNA, 20 bp, human
gcgcctttcaggagaaatca

SEQ ID NO: 29759 - DNA, 20 bp, human
ggacgcgatgctggttgctg

SEQ ID NO: 29760 - DNA, 20 bp, human
gctggaggccgggtacggga

SEQ ID NO: 29761 - DNA, 20 bp, human
gtggagtccggcgctccctc

SEQ ID NO: 29762 - DNA, 20 bp, human
gagaccaggcacgcagtccg

SEQ ID NO: 29763 - DNA, 20 bp, human
gctggcggggatgtgacggg

SEQ ID NO: 29764 - DNA, 20 bp, human
gcaggccgcggacgcgatgc

SEQ ID NO: 29765 - DNA, 20 bp, human
gccgaactcccgggctgagg

SEQ ID NO: 29766 - DNA, 20 bp, human
gcccgagcacgagctgtgag

SEQ ID NO: 29767 - DNA, 20 bp, human
ggcggaactcctcggaacca

SEQ ID NO: 29768 - DNA, 20 bp, human
gggtctgagccatcagaggg

SEQ ID NO: 29769 - DNA, 20 bp, human
ggaggggattcacttgtgtg

SEQ ID NO: 29770 - DNA, 20 bp, human
gacggggtctgagccatcag

SEQ ID NO: 29771 - DNA, 20 bp, human
gaggggccgcagccttccga

SEQ ID NO: 29772 - DNA, 20 bp, human
gagctcgtgctcgggaccag

SEQ ID NO: 29773 - DNA, 20 bp, human
gctcgggaccagcggactga

SEQ ID NO: 29774 - DNA, 20 bp, human
gcgctccgccctccttctag

SEQ ID NO: 29775 - DNA, 20 bp, human
gtccaggctccgcccctaga

SEQ ID NO: 29776 - DNA, 20 bp, human
gtgaggtgtaagccctgagg

SEQ ID NO: 29777 - DNA, 20 bp, human
gtcagtggcccggtcagtgg

SEQ ID NO: 29778 - DNA, 20 bp, human
gggcgacgcgatgcagagcc

SEQ ID NO: 29779 - DNA, 20 bp, human
gactggacgatggcccatca

SEQ ID NO: 29780 - DNA, 20 bp, human
gggggctgagggacagaacg

SEQ ID NO: 29781 - DNA, 20 bp, human
ggagggacagaacgcggagt

SEQ ID NO: 29782 - DNA, 20 bp, human
gcagctacatagcgacaatc

SEQ ID NO: 29783 - DNA, 20 bp, human
ggagaggaaagcgggacact

SEQ ID NO: 29784 - DNA, 20 bp, human
gggttgaggtgtaagccctg

SEQ ID NO: 29785 - DNA, 20 bp, human
gccaagacgagcacacgtca

SEQ ID NO: 29786 - DNA, 20 bp, human
ggcttaccgttattacactg

SEQ ID NO: 29787 - DNA, 20 bp, human
ggccggccgcagtgtaataa

SEQ ID NO: 29788 - DNA, 20 bp, human
gactccgggttggcgatcat

SEQ ID NO: 29789 - DNA, 20 bp, human
gctgcggccggccagaatcc

SEQ ID NO: 29790 - DNA, 20 bp, human
gtctatagggaggacaagag

SEQ ID NO: 29791 - DNA, 20 bp, human
gccactgggctgcttctata

SEQ ID NO: 29792 - DNA, 20 bp, human
gtcacgaaccttccagaaag

SEQ ID NO: 29793 - DNA, 20 bp, human
gtgtctgggttggctcggga

SEQ ID NO: 29794 - DNA, 20 bp, human
gtcgccaacccggagtatgg

SEQ ID NO: 29795 - DNA, 20 bp, human
gcgggaaggacggatggacc

SEQ ID NO: 29796 - DNA, 20 bp, human
gcaaccggcggagaccgcta

SEQ ID NO: 29797 - DNA, 20 bp, human
gggccccacccagctccgaa

SEQ ID NO: 29798 - DNA, 20 bp, human
ggcctgcgcgagttgaggag

SEQ ID NO: 29799 - DNA, 20 bp, human
ggggcgcccatattcatcga

SEQ ID NO: 29800 - DNA, 20 bp, human
gattacttccccccaaccgg

SEQ ID NO: 29801 - DNA, 20 bp, human
gcgcgggcgaccggactgag

SEQ ID NO: 29802 - DNA, 20 bp, human
ggacgccggcgcctaatcct

SEQ ID NO: 29803 - DNA, 20 bp, human
gctcgcggtgggctaagggg

SEQ ID NO: 29804 - DNA, 20 bp, human
ggtcgcccgcgggagcaaag

SEQ ID NO: 29805 - DNA, 20 bp, human
gtcctgggctcggaatgtgg

SEQ ID NO: 29806 - DNA, 20 bp, human
gagacccggatagttcctcc

SEQ ID NO: 29807 - DNA, 20 bp, human
ggtggccgggaggaactatc

SEQ ID NO: 29808 - DNA, 20 bp, human
ggtctccgcggagaacaaag

SEQ ID NO: 29809 - DNA, 20 bp, human
ggccatagctgctccagcgg

SEQ ID NO: 29810 - DNA, 20 bp, human
ggccacgccgcgccggctct

SEQ ID NO: 29811 - DNA, 20 bp, human
ggatgctgagtgcccagagc

SEQ ID NO: 29812 - DNA, 20 bp, human
gtgagtgcccagagccggcg

SEQ ID NO: 29813 - DNA, 20 bp, human
gagggcaccatgaagatgta

SEQ ID NO: 29814 - DNA, 20 bp, human
gagaaatggccgggacggtg

SEQ ID NO: 29815 - DNA, 20 bp, human
ggacacaggaccgaccccgg

SEQ ID NO: 29816 - DNA, 20 bp, human
gccatagcctaaccgttcag

SEQ ID NO: 29817 - DNA, 20 bp, human
gtaggctatggctgcgataa

SEQ ID NO: 29818 - DNA, 20 bp, human
gctcccggggccctctacta

SEQ ID NO: 29819 - DNA, 20 bp, human
gataaaggccgtcaactcca

SEQ ID NO: 29820 - DNA, 20 bp, human
gttgctcagaatcgcgacta

SEQ ID NO: 29821 - DNA, 20 bp, human
gaaccttgacgacaagtcgg

SEQ ID NO: 29822 - DNA, 20 bp, human
ggagggcgacaggacaccaa

SEQ ID NO: 29823 - DNA, 20 bp, human
gggttggagcggccattacg

SEQ ID NO: 29824 - DNA, 20 bp, human
gcgcggacgcctgcctcaga

SEQ ID NO: 29825 - DNA, 20 bp, human
gcggggccctctactagggg

SEQ ID NO: 29826 - DNA, 20 bp, human
gcggcccggtctcggagaag

SEQ ID NO: 29827 - DNA, 20 bp, human
gctcggagaagaggggagag

SEQ ID NO: 29828 - DNA, 20 bp, human
gatctgggcgaggacagagg

SEQ ID NO: 29829 - DNA, 20 bp, human
gctattgcgcgaggcattgt

SEQ ID NO: 29830 - DNA, 20 bp, human
ggggatctgggcgaggacag

SEQ ID NO: 29831 - DNA, 20 bp, human
gggcattgtgggttgctggg

SEQ ID NO: 29832 - DNA, 20 bp, human
ggggcccgcgaacccacgtc

SEQ ID NO: 29833 - DNA, 20 bp, human
gcgcggtcggcagctagact

SEQ ID NO: 29834 - DNA, 20 bp, human
gcagctagacttggaagctg

SEQ ID NO: 29835 - DNA, 20 bp, human
gtctcccggcccaagcttct

SEQ ID NO: 29836 - DNA, 20 bp, human
gccttctgggaaagcagcgt

SEQ ID NO: 29837 - DNA, 20 bp, human
gggagcacgcacagccttct

SEQ ID NO: 29838 - DNA, 20 bp, human
ggagaaggccgagggatcgg

SEQ ID NO: 29839 - DNA, 20 bp, human
gggcccgtcacccttaaagg

SEQ ID NO: 29840 - DNA, 20 bp, human
ggtgctcctcgcttcctccg

SEQ ID NO: 29841 - DNA, 20 bp, human
gagtaggagggcctactaac

SEQ ID NO: 29842 - DNA, 20 bp, human
gcggccgcggcgaagtagga

SEQ ID NO: 29843 - DNA, 20 bp, human
ggcgtgctgccctggctcag

SEQ ID NO: 29844 - DNA, 20 bp, human
gtaaggcccgtcacccttaa

SEQ ID NO: 29845 - DNA, 20 bp, human
gcccttaaaggaggttgtga

SEQ ID NO: 29846 - DNA, 20 bp, human
ggtatctgaagacatcagca

SEQ ID NO: 29847 - DNA, 20 bp, human
gcggaccagcactccactgt

SEQ ID NO: 29848 - DNA, 20 bp, human
ggaacttctgccggccgtgg

SEQ ID NO: 29849 - DNA, 20 bp, human
ggaacccaagggagagcccg

SEQ ID NO: 29850 - DNA, 20 bp, human
gctcctcttctggactcctc

SEQ ID NO: 29851 - DNA, 20 bp, human
gcaggaacttctgccggccg

SEQ ID NO: 29852 - DNA, 20 bp, human
gtggacccacagtggagtgc

SEQ ID NO: 29853 - DNA, 20 bp, human
gaggccggatgacactggcc

SEQ ID NO: 29854 - DNA, 20 bp, human
gagagaggagaggccaccgt

SEQ ID NO: 29855 - DNA, 20 bp, human
gcggctggcactgaacccaa

SEQ ID NO: 29856 - DNA, 20 bp, human
ggggcggcgccggtgttccc

SEQ ID NO: 29857 - DNA, 20 bp, human
gccccgggaaggtggccctg

SEQ ID NO: 29858 - DNA, 20 bp, human
gtagaagcgtggaaccaggg

SEQ ID NO: 29859 - DNA, 20 bp, human
ggcgcaaagagcctcaacct

SEQ ID NO: 29860 - DNA, 20 bp, human
gaactagaagcgtggaacca

SEQ ID NO: 29861 - DNA, 20 bp, human
gaggctagcgtctgccaccc

SEQ ID NO: 29862 - DNA, 20 bp, human
gttgtgccaggtgcgagtcc

SEQ ID NO: 29863 - DNA, 20 bp, human
gcactccacaccccaggttg

SEQ ID NO: 29864 - DNA, 20 bp, human
ggcgccggtgttccccggga

SEQ ID NO: 29865 - DNA, 20 bp, human
gctcgcacctggcacaatgc

SEQ ID NO: 29866 - DNA, 20 bp, human
gcagacaacaaggccacccg

SEQ ID NO: 29867 - DNA, 20 bp, human
ggcctgcggcgagtgcttcc

SEQ ID NO: 29868 - DNA, 20 bp, human
gctcttcaggcacccccggg

SEQ ID NO: 29869 - DNA, 20 bp, human
ggtcctcttcaggcaccccc

SEQ ID NO: 29870 - DNA, 20 bp, human
gggccaggaaacagacaaca

SEQ ID NO: 29871 - DNA, 20 bp, human
gacaacaacaggctgggcgg

SEQ ID NO: 29872 - DNA, 20 bp, human
gaccaaaacaacaacaggct

SEQ ID NO: 29873 - DNA, 20 bp, human
ggtttcaggaaaaaccgagc

SEQ ID NO: 29874 - DNA, 20 bp, human
ggcttgagtgtcggacgttg

SEQ ID NO: 29875 - DNA, 20 bp, human
gataccaccaaaacaacaac

SEQ ID NO: 29876 - DNA, 20 bp, human
gctggaactcaaggatgtct

SEQ ID NO: 29877 - DNA, 20 bp, human
gtagtgtcactaacattcag

SEQ ID NO: 29878 - DNA, 20 bp, human
gaggactgtgctggcccaaa

SEQ ID NO: 29879 - DNA, 20 bp, human
gggacgaaaaaggactgtgc

SEQ ID NO: 29880 - DNA, 20 bp, human
ggacactattgggacgaaaa

SEQ ID NO: 29881 - DNA, 20 bp, human
gtactgtctcttgggatgat

SEQ ID NO: 29882 - DNA, 20 bp, human
gtgctaacatcagaaatata

SEQ ID NO: 29883 - DNA, 20 bp, human
gcaagcaaaactgacagatc

SEQ ID NO: 29884 - DNA, 20 bp, human
gaggaagatgagtaaagcca

SEQ ID NO: 29885 - DNA, 20 bp, human
gtaatatcaggcaaacctta

SEQ ID NO: 29886 - DNA, 20 bp, human
ggtgcacacgcagaggaggt

SEQ ID NO: 29887 - DNA, 20 bp, human
gcgcggcggtgcacacgcag

SEQ ID NO: 29888 - DNA, 20 bp, human
gggcggtgcacacgcagagg

SEQ ID NO: 29889 - DNA, 20 bp, human
gcggtgcccgcgaacttccc

SEQ ID NO: 29890 - DNA, 20 bp, human
gggcggcggtcaggagcggt

SEQ ID NO: 29891 - DNA, 20 bp, human
gacagcctgaggaacccggt

SEQ ID NO: 29892 - DNA, 20 bp, human
gcggcagcggactgtagccc

SEQ ID NO: 29893 - DNA, 20 bp, human
gggctcccgggtaggaacgt

SEQ ID NO: 29894 - DNA, 20 bp, human
ggctctaccaacgatgccca

SEQ ID NO: 29895 - DNA, 20 bp, human
gatctcgacggcgtctgcct

SEQ ID NO: 29896 - DNA, 20 bp, human
ggaacctctgagctccggac

SEQ ID NO: 29897 - DNA, 20 bp, human
ggagcctgtccggagctcag

SEQ ID NO: 29898 - DNA, 20 bp, human
gtcgcagagacgtgcaccag

SEQ ID NO: 29899 - DNA, 20 bp, human
gtagcttctttcctacacag

SEQ ID NO: 29900 - DNA, 20 bp, human
ggcgtgcggcggctcacagt

SEQ ID NO: 29901 - DNA, 20 bp, human
gtcagcatactgccgcgggt

SEQ ID NO: 29902 - DNA, 20 bp, human
gccgcggcagtatgctgaca

SEQ ID NO: 29903 - DNA, 20 bp, human
gtagaggtggagatccatgc

SEQ ID NO: 29904 - DNA, 20 bp, human
gcagtatgctgacacggtca

SEQ ID NO: 29905 - DNA, 20 bp, human
gggctctaggttgagaccgc

SEQ ID NO: 29906 - DNA, 20 bp, human
gccggactcggacgcgtggt

SEQ ID NO: 29907 - DNA, 20 bp, human
gtgtccagggacaatgagca

SEQ ID NO: 29908 - DNA, 20 bp, human
ggacaatgagcagggtgtcc

SEQ ID NO: 29909 - DNA, 20 bp, human
gccgctcggccgagctgtcg

SEQ ID NO: 29910 - DNA, 20 bp, human
gagggaagactgccgtgtcc

SEQ ID NO: 29911 - DNA, 20 bp, human
ggccggtccaagggcccggg

SEQ ID NO: 29912 - DNA, 20 bp, human
gcagcctagccagaggccct

SEQ ID NO: 29913 - DNA, 20 bp, human
gcccccgcccgcgtgcaagt

SEQ ID NO: 29914 - DNA, 20 bp, human
ggcggcctcccggaacctcc

SEQ ID NO: 29915 - DNA, 20 bp, human
gcggcccggagcctacgagg

SEQ ID NO: 29916 - DNA, 20 bp, human
gccctgtgaggcacctccgg

SEQ ID NO: 29917 - DNA, 20 bp, human
gcaagccgggaggtgccacg

SEQ ID NO: 29918 - DNA, 20 bp, human
gcaagccccgtggcacctcc

SEQ ID NO: 29919 - DNA, 20 bp, human
ggggccagctccaagccccg

SEQ ID NO: 29920 - DNA, 20 bp, human
gtggccctgtgaggcacctc

SEQ ID NO: 29921 - DNA, 20 bp, human
gtggcctgagacaagccggg

SEQ ID NO: 29922 - DNA, 20 bp, human
gtgacgaaactggagagata

SEQ ID NO: 29923 - DNA, 20 bp, human
gctaggacatgaacttcccc

SEQ ID NO: 29924 - DNA, 20 bp, human
gctattcacggacctccaag

SEQ ID NO: 29925 - DNA, 20 bp, human
gtccatgacgtgaaccacct

SEQ ID NO: 29926 - DNA, 20 bp, human
ggcatcaggagagtaaggag

SEQ ID NO: 29927 - DNA, 20 bp, human
gtgaatctatggcagatcaa

SEQ ID NO: 29928 - DNA, 20 bp, human
gggaatgagcaaactcagaa

SEQ ID NO: 29929 - DNA, 20 bp, human
gcattgaagttataaatctt

SEQ ID NO: 29930 - DNA, 20 bp, human
gtggtgctacttgaagactc

SEQ ID NO: 29931 - DNA, 20 bp, human
gaaagatagaatatgcagaa

SEQ ID NO: 29932 - DNA, 20 bp, human
gtaattattatgacagtcaa

SEQ ID NO: 29933 - DNA, 20 bp, human
ggctgaggtgaaattaagtc

SEQ ID NO: 29934 - DNA, 20 bp, human
gttgaagactctggatctgc

SEQ ID NO: 29935 - DNA, 20 bp, human
gctacatttcccctttaatg

SEQ ID NO: 29936 - DNA, 20 bp, human
gagagtagcagcaatattgg

SEQ ID NO: 29937 - DNA, 20 bp, human
ggatgctgcctcaaaactcg

SEQ ID NO: 29938 - DNA, 20 bp, human
gaactcgtggcatattggta

SEQ ID NO: 29939 - DNA, 20 bp, human
gctcaaaactcgtggcatat

SEQ ID NO: 29940 - DNA, 20 bp, human
gctgccatttgggagatggt

SEQ ID NO: 29941 - DNA, 20 bp, human
gcttagagtagcagcaatat

SEQ ID NO: 29942 - DNA, 20 bp, human
gtggaaaatgaagacttata

SEQ ID NO: 29943 - DNA, 20 bp, human
gaggagttacatcaggactc

SEQ ID NO: 29944 - DNA, 20 bp, human
gtttgaggcagcatcattat

SEQ ID NO: 29945 - DNA, 20 bp, human
gtagatattattgtctccat

SEQ ID NO: 29946 - DNA, 20 bp, human
gcggagtggtgaccagcggg

SEQ ID NO: 29947 - DNA, 20 bp, human
ggggagcgtagtctcggagg

SEQ ID NO: 29948 - DNA, 20 bp, human
gggcgttcgggagaaagcta

SEQ ID NO: 29949 - DNA, 20 bp, human
gggcggcccaaagcagtgag

SEQ ID NO: 29950 - DNA, 20 bp, human
gggcgccgcaggggattgag

SEQ ID NO: 29951 - DNA, 20 bp, human
gcgctgaggacacgatgtcg

SEQ ID NO: 29952 - DNA, 20 bp, human
gcaccactccggcaccaggt

SEQ ID NO: 29953 - DNA, 20 bp, human
gccggccacgagtggactcc

SEQ ID NO: 29954 - DNA, 20 bp, human
gccagcgggagggacgtcac

SEQ ID NO: 29955 - DNA, 20 bp, human
gccagcctggagtccactcg

SEQ ID NO: 29956 - DNA, 20 bp, human
gcagctgggcacataggagg

SEQ ID NO: 29957 - DNA, 20 bp, human
gccaccccgcgagcccatgg

SEQ ID NO: 29958 - DNA, 20 bp, human
gcgggtgtatgcaaagggag

SEQ ID NO: 29959 - DNA, 20 bp, human
gggtggctccaactgaatct

SEQ ID NO: 29960 - DNA, 20 bp, human
ggaaccccgggtgtatgcaa

SEQ ID NO: 29961 - DNA, 20 bp, human
gagccagctgggcacatagg

SEQ ID NO: 29962 - DNA, 20 bp, human
gcggggttcccagattcagt

SEQ ID NO: 29963 - DNA, 20 bp, human
gagtctgggagggacgcgcc

SEQ ID NO: 29964 - DNA, 20 bp, human
gcgtgtgcggagcgagacct

SEQ ID NO: 29965 - DNA, 20 bp, human
gagcgagacctgggcaaccg

SEQ ID NO: 29966 - DNA, 20 bp, human
gggagggagacgctgctaca

SEQ ID NO: 29967 - DNA, 20 bp, human
gctacacggcgtaggctgag

SEQ ID NO: 29968 - DNA, 20 bp, human
gaggctggaaaggggatcac

SEQ ID NO: 29969 - DNA, 20 bp, human
gtcactcacctggcagtggg

SEQ ID NO: 29970 - DNA, 20 bp, human
ggggaggatgaaccccagga

SEQ ID NO: 29971 - DNA, 20 bp, human
gcagtgggaggatgaacccc

SEQ ID NO: 29972 - DNA, 20 bp, human
gcgcgctcatgacccgtctg

SEQ ID NO: 29973 - DNA, 20 bp, human
gagacgctgctacacggcgt

SEQ ID NO: 29974 - DNA, 20 bp, human
ggtccctgcacagggatcaa

SEQ ID NO: 29975 - DNA, 20 bp, human
gtcatcactcacctggcagt

SEQ ID NO: 29976 - DNA, 20 bp, human
gctgccaggggatcatctgg

SEQ ID NO: 29977 - DNA, 20 bp, human
gggcaatttggcagccagag

SEQ ID NO: 29978 - DNA, 20 bp, human
ggtactcagaagggtgatct

SEQ ID NO: 29979 - DNA, 20 bp, human
gagccagagaggtactcaga

SEQ ID NO: 29980 - DNA, 20 bp, human
gacccttctgagtacctctc

SEQ ID NO: 29981 - DNA, 20 bp, human
gatgccaccagatgatcccc

SEQ ID NO: 29982 - DNA, 20 bp, human
gactctgccaggggatcatc

SEQ ID NO: 29983 - DNA, 20 bp, human
gtgtgaaggccctggcaatt

SEQ ID NO: 29984 - DNA, 20 bp, human
gcatctggtggcatcttaat

SEQ ID NO: 29985 - DNA, 20 bp, human
gatcccctggcagagttctt

SEQ ID NO: 29986 - DNA, 20 bp, human
gatggtggtcagactctccg

SEQ ID NO: 29987 - DNA, 20 bp, human
ggccatctgaggtccccttg

SEQ ID NO: 29988 - DNA, 20 bp, human
gtcaccactagaggttcctc

SEQ ID NO: 29989 - DNA, 20 bp, human
gctgtgctgcagtgcctcaa

SEQ ID NO: 29990 - DNA, 20 bp, human
ggaccaggtcagctgctgag

SEQ ID NO: 29991 - DNA, 20 bp, human
gcctggtgtgaggagtcggg

SEQ ID NO: 29992 - DNA, 20 bp, human
gcagcagctgacctggtctc

SEQ ID NO: 29993 - DNA, 20 bp, human
gtcctcgggcctgacttcca

SEQ ID NO: 29994 - DNA, 20 bp, human
gaggcctgggaatccacatg

SEQ ID NO: 29995 - DNA, 20 bp, human
gcttcgcgcaggggatgctg

SEQ ID NO: 29996 - DNA, 20 bp, human
gagactgagtaggcatctca

SEQ ID NO: 29997 - DNA, 20 bp, human
ggagtcatggatagtcagaa

SEQ ID NO: 29998 - DNA, 20 bp, human
gcttatgaaggtggttgata

SEQ ID NO: 29999 - DNA, 20 bp, human
ggggaaggtgaataagttgg

SEQ ID NO: 30000 - DNA, 20 bp, human
gtaggggaaggtgaataagt

SEQ ID NO: 30001 - DNA, 20 bp, human
gaggtgaataagttggaggt

SEQ ID NO: 30002 - DNA, 20 bp, human
gtagcagttgaattagggga

SEQ ID NO: 30003 - DNA, 20 bp, human
gagtcagaatggaaccagcc

SEQ ID NO: 30004 - DNA, 20 bp, human
gggtccctgagctcttatga

SEQ ID NO: 30005 - DNA, 20 bp, human
ggtcagaatagagatatcgt

SEQ ID NO: 30006 - DNA, 20 bp, human
ggagagaagaagtcactaca

SEQ ID NO: 30007 - DNA, 20 bp, human
ggggagatgcaacttcttac

SEQ ID NO: 30008 - DNA, 20 bp, human
ggtacctgggcacaaactca

SEQ ID NO: 30009 - DNA, 20 bp, human
gaacatggtaagagtcactc

SEQ ID NO: 30010 - DNA, 20 bp, human
ggaacagctaacagttgaaa

SEQ ID NO: 30011 - DNA, 20 bp, human
ggaggtctggataacatgaa

SEQ ID NO: 30012 - DNA, 20 bp, human
gccagaatggttgaagaggg

SEQ ID NO: 30013 - DNA, 20 bp, human
ggcagcagcagcatttcact

SEQ ID NO: 30014 - DNA, 20 bp, human
gatggctgggatagcgactc

SEQ ID NO: 30015 - DNA, 20 bp, human
ggtctggataacatgaaagg

SEQ ID NO: 30016 - DNA, 20 bp, human
gagtcagaatataggtacag

SEQ ID NO: 30017 - DNA, 20 bp, human
gagtggtgcgtggcattgaa

SEQ ID NO: 30018 - DNA, 20 bp, human
gatgacacgcaaggtccaga

SEQ ID NO: 30019 - DNA, 20 bp, human
gagataagatggagcttagt

SEQ ID NO: 30020 - DNA, 20 bp, human
gggagacaggtatgctcaga

SEQ ID NO: 30021 - DNA, 20 bp, human
ggttttaacggaaaatggag

SEQ ID NO: 30022 - DNA, 20 bp, human
ggctcagatggcaagcattc

SEQ ID NO: 30023 - DNA, 20 bp, human
gtagctcttcttctcccagg

SEQ ID NO: 30024 - DNA, 20 bp, human
gggggaagattgttggtaga

SEQ ID NO: 30025 - DNA, 20 bp, human
gccttagacaaagtggtgcg

SEQ ID NO: 30026 - DNA, 20 bp, human
gggcagaagcagcaaaccgc

SEQ ID NO: 30027 - DNA, 20 bp, human
gtaagggcgagggcgccctt

SEQ ID NO: 30028 - DNA, 20 bp, human
gttgcagctcgcacagctaa

SEQ ID NO: 30029 - DNA, 20 bp, human
gtcctcgctgggcttgccgg

SEQ ID NO: 30030 - DNA, 20 bp, human
gagaggagatgagcttcagg

SEQ ID NO: 30031 - DNA, 20 bp, human
gctcgcacagctaagggcga

SEQ ID NO: 30032 - DNA, 20 bp, human
ggtgcgagctgcaaagaggt

SEQ ID NO: 30033 - DNA, 20 bp, human
gagctgtgcgagctgcaaag

SEQ ID NO: 30034 - DNA, 20 bp, human
gctgcctctccccggagcca

SEQ ID NO: 30035 - DNA, 20 bp, human
gccagcgaggagggctgccg

SEQ ID NO: 30036 - DNA, 20 bp, human
ggtcagacgagagtgcaaga

SEQ ID NO: 30037 - DNA, 20 bp, human
gacgagagtgcaagagggtg

SEQ ID NO: 30038 - DNA, 20 bp, human
gcctatggtagggcaccaga

SEQ ID NO: 30039 - DNA, 20 bp, human
gctgacagggaagtcagcag

SEQ ID NO: 30040 - DNA, 20 bp, human
gtgttaaaggagggattcct

SEQ ID NO: 30041 - DNA, 20 bp, human
gtggaaagatacctatggta

SEQ ID NO: 30042 - DNA, 20 bp, human
ggcaggtggaaagataccta

SEQ ID NO: 30043 - DNA, 20 bp, human
gagagagaatgtaaagggat

SEQ ID NO: 30044 - DNA, 20 bp, human
gagggctgagaggaagctct

SEQ ID NO: 30045 - DNA, 20 bp, human
gacagcagagaccctcgaag

SEQ ID NO: 30046 - DNA, 20 bp, human
gtacatggaaagctcatctt

SEQ ID NO: 30047 - DNA, 20 bp, human
ggatgatcaggatatctaca

SEQ ID NO: 30048 - DNA, 20 bp, human
gcgaatgccttggaaacctg

SEQ ID NO: 30049 - DNA, 20 bp, human
gggaactgaagtgagactgg

SEQ ID NO: 30050 - DNA, 20 bp, human
gtcctgacccaaggcacccc

SEQ ID NO: 30051 - DNA, 20 bp, human
gaagttgatgtcctgaccca

SEQ ID NO: 30052 - DNA, 20 bp, human
gtgactcttatgcttacctt

SEQ ID NO: 30053 - DNA, 20 bp, human
gcatctgaagaccgatgatc

SEQ ID NO: 30054 - DNA, 20 bp, human
gtggaaacctggggtgcctt

SEQ ID NO: 30055 - DNA, 20 bp, human
gtatttgatttgaagattca

SEQ ID NO: 30056 - DNA, 20 bp, human
gcgcgcgaggtggctgactg

SEQ ID NO: 30057 - DNA, 20 bp, human
gcgaagctggcgcatcctcc

SEQ ID NO: 30058 - DNA, 20 bp, human
gggtccggggactagatcag

SEQ ID NO: 30059 - DNA, 20 bp, human
gggctccagctcccaaaact

SEQ ID NO: 30060 - DNA, 20 bp, human
gccgagccgagcctgcccgg

SEQ ID NO: 30061 - DNA, 20 bp, human
gtagtccccggaccagattg

SEQ ID NO: 30062 - DNA, 20 bp, human
gctgcctgtaaaccaccctt

SEQ ID NO: 30063 - DNA, 20 bp, human
ggcctgcctagcagagctcc

SEQ ID NO: 30064 - DNA, 20 bp, human
ggcttgggaaggagggcgca

SEQ ID NO: 30065 - DNA, 20 bp, human
gatggagaggctggtgagcg

SEQ ID NO: 30066 - DNA, 20 bp, human
gtaggttagcagttctccaa

SEQ ID NO: 30067 - DNA, 20 bp, human
gctcaggaagagctgagacc

SEQ ID NO: 30068 - DNA, 20 bp, human
gtcttaccccatcaacagtg

SEQ ID NO: 30069 - DNA, 20 bp, human
gttgcaataataaatatagg

SEQ ID NO: 30070 - DNA, 20 bp, human
gaataaagtaaactagatat

SEQ ID NO: 30071 - DNA, 20 bp, human
ggagtgccccactgttgatg

SEQ ID NO: 30072 - DNA, 20 bp, human
gcgcatggtgagaccctctc

SEQ ID NO: 30073 - DNA, 20 bp, human
gatagggggttgctaaatat

SEQ ID NO: 30074 - DNA, 20 bp, human
gcgtgaaggaaggggctaga

SEQ ID NO: 30075 - DNA, 20 bp, human
gtcctccacacaggtacaga

SEQ ID NO: 30076 - DNA, 20 bp, human
ggaaaactgggcgcatacac

SEQ ID NO: 30077 - DNA, 20 bp, human
gtggccatgctgaaatagat

SEQ ID NO: 30078 - DNA, 20 bp, human
ggatttacattatcccagtt

SEQ ID NO: 30079 - DNA, 20 bp, human
gcacctaggaattaaattgt

SEQ ID NO: 30080 - DNA, 20 bp, human
gtgcacttcttagcttttta

SEQ ID NO: 30081 - DNA, 20 bp, human
gggaccaatctatttcagca

SEQ ID NO: 30082 - DNA, 20 bp, human
gacaaataaatgttgggcgg

SEQ ID NO: 30083 - DNA, 20 bp, human
gaacaccatgtgaagataaa

SEQ ID NO: 30084 - DNA, 20 bp, human
gacaagccaaggaaaaccaa

SEQ ID NO: 30085 - DNA, 20 bp, human
gttataaaaagaggaaaact

SEQ ID NO: 30086 - DNA, 20 bp, human
gtgagcactcaggatgactg

SEQ ID NO: 30087 - DNA, 20 bp, human
ggccacaggcaggagaaacc

SEQ ID NO: 30088 - DNA, 20 bp, human
gcacctgtgctcccaggata

SEQ ID NO: 30089 - DNA, 20 bp, human
gtaagagcccttggagagac

SEQ ID NO: 30090 - DNA, 20 bp, human
gaggataagggtgagcactc

SEQ ID NO: 30091 - DNA, 20 bp, human
gacagtgaagtgcgcatcag

SEQ ID NO: 30092 - DNA, 20 bp, human
ggaagtggtctcgatctgaa

SEQ ID NO: 30093 - DNA, 20 bp, human
ggccggctggccacagagag

SEQ ID NO: 30094 - DNA, 20 bp, human
ggagatggaccggacttggg

SEQ ID NO: 30095 - DNA, 20 bp, human
gaggagaaacccggagagca

SEQ ID NO: 30096 - DNA, 20 bp, human
gcagtgtccagaactcctgg

SEQ ID NO: 30097 - DNA, 20 bp, human
ggaagtaaagatcacagggt

SEQ ID NO: 30098 - DNA, 20 bp, human
gctggacactgggggagagt

SEQ ID NO: 30099 - DNA, 20 bp, human
gttaggaagtaaagatcaca

SEQ ID NO: 30100 - DNA, 20 bp, human
gccaagactcctgggttctg

SEQ ID NO: 30101 - DNA, 20 bp, human
ggacctgaggaggttgagtt

SEQ ID NO: 30102 - DNA, 20 bp, human
gagacgtgaaatcagagcct

SEQ ID NO: 30103 - DNA, 20 bp, human
gtcgagtctgtcggaatcca

SEQ ID NO: 30104 - DNA, 20 bp, human
gaggagagacgagagactcc

SEQ ID NO: 30105 - DNA, 20 bp, human
gtcccaggaaccaggaattc

SEQ ID NO: 30106 - DNA, 20 bp, human
gcccaggcccgggaattgga

SEQ ID NO: 30107 - DNA, 20 bp, human
gtctctggagcacaggagta

SEQ ID NO: 30108 - DNA, 20 bp, human
gccgggaattggaaggctga

SEQ ID NO: 30109 - DNA, 20 bp, human
gcgcgtgtcttccctcttca

SEQ ID NO: 30110 - DNA, 20 bp, human
gaaggagctccaggagtctc

SEQ ID NO: 30111 - DNA, 20 bp, human
gagcacaggagtagggcccc

SEQ ID NO: 30112 - DNA, 20 bp, human
gcagcagttattatgcacag

SEQ ID NO: 30113 - DNA, 20 bp, human
gcaccggtaagagagagcca

SEQ ID NO: 30114 - DNA, 20 bp, human
gcaaggaggatgctcaagac

SEQ ID NO: 30115 - DNA, 20 bp, human
gagggccttgcagaaccttg

SEQ ID NO: 30116 - DNA, 20 bp, human
ggaacttacattctatgtgg

SEQ ID NO: 30117 - DNA, 20 bp, human
ggaagagccaaaagtaaagt

SEQ ID NO: 30118 - DNA, 20 bp, human
gtctctctcggggaaccagt

SEQ ID NO: 30119 - DNA, 20 bp, human
gcttacattctatgtggagg

SEQ ID NO: 30120 - DNA, 20 bp, human
gataaataataagtgaaagg

SEQ ID NO: 30121 - DNA, 20 bp, human
gacgactgataacatctgag

SEQ ID NO: 30122 - DNA, 20 bp, human
gctgataacatctgagagga

SEQ ID NO: 30123 - DNA, 20 bp, human
gtcatcttatgctctcagtg

SEQ ID NO: 30124 - DNA, 20 bp, human
gaggccttagcttaaaagac

SEQ ID NO: 30125 - DNA, 20 bp, human
gcagaggctgaagtgggcgg

SEQ ID NO: 30126 - DNA, 20 bp, human
gacgcgccgcgcaccgacgt

SEQ ID NO: 30127 - DNA, 20 bp, human
gtttggggccaacccagtgt

SEQ ID NO: 30128 - DNA, 20 bp, human
ggcaccgacgtaggggacat

SEQ ID NO: 30129 - DNA, 20 bp, human
gggcgtctggaagtccaatg

SEQ ID NO: 30130 - DNA, 20 bp, human
ggcgcgtctagcaggatgct

SEQ ID NO: 30131 - DNA, 20 bp, human
ggagaaccgctggctccggg

SEQ ID NO: 30132 - DNA, 20 bp, human
gtgggtgcttggagaaccgc

SEQ ID NO: 30133 - DNA, 20 bp, human
gctgcccatgtcccctacgt

SEQ ID NO: 30134 - DNA, 20 bp, human
ggggcgggcgcaggcaaggt

SEQ ID NO: 30135 - DNA, 20 bp, human
ggtgttggaagtactctggg

SEQ ID NO: 30136 - DNA, 20 bp, human
gaggctggcagtgcactggg

SEQ ID NO: 30137 - DNA, 20 bp, human
gcagcaatccaggaagtctt

SEQ ID NO: 30138 - DNA, 20 bp, human
gcagtcagcaagaggacgat

SEQ ID NO: 30139 - DNA, 20 bp, human
gccgtgcacggcagagagtc

SEQ ID NO: 30140 - DNA, 20 bp, human
gcgcctgctgtgagctgaca

SEQ ID NO: 30141 - DNA, 20 bp, human
gtgaggagattccttcccac

SEQ ID NO: 30142 - DNA, 20 bp, human
ggcacggcagagagtctggt

SEQ ID NO: 30143 - DNA, 20 bp, human
gactgggaggtctgtgagag

SEQ ID NO: 30144 - DNA, 20 bp, human
ggtgtatgtggcacaagcag

SEQ ID NO: 30145 - DNA, 20 bp, human
gagtctaaatcagacaggac

SEQ ID NO: 30146 - DNA, 20 bp, human
gccagggtagagaaacggag

SEQ ID NO: 30147 - DNA, 20 bp, human
gggaagcaagagagcaaccg

SEQ ID NO: 30148 - DNA, 20 bp, human
gagcggtggccgggacggtt

SEQ ID NO: 30149 - DNA, 20 bp, human
gcgcagcacgaaacatggcc

SEQ ID NO: 30150 - DNA, 20 bp, human
gggtagggccgacgtgtcga

SEQ ID NO: 30151 - DNA, 20 bp, human
gcagttgccgattacaggta

SEQ ID NO: 30152 - DNA, 20 bp, human
ggctccgtcacagccgagtt

SEQ ID NO: 30153 - DNA, 20 bp, human
gggctgaggcagcggtggcc

SEQ ID NO: 30154 - DNA, 20 bp, human
gtagaatacacagctcctcc

SEQ ID NO: 30155 - DNA, 20 bp, human
gaaggacaagatgaagtgga

SEQ ID NO: 30156 - DNA, 20 bp, human
gcggggccggaccagtccgg

SEQ ID NO: 30157 - DNA, 20 bp, human
gacactgggccaggacccct

SEQ ID NO: 30158 - DNA, 20 bp, human
ggcacgagccctccagccag

SEQ ID NO: 30159 - DNA, 20 bp, human
gggccgcccaggccagcaac

SEQ ID NO: 30160 - DNA, 20 bp, human
gacacgctgggcctcctcgg

SEQ ID NO: 30161 - DNA, 20 bp, human
gcgtgcacgctggctgtcga

SEQ ID NO: 30162 - DNA, 20 bp, human
gggcttcacgtggaccacag

SEQ ID NO: 30163 - DNA, 20 bp, human
gctcgaagccaaactggcac

SEQ ID NO: 30164 - DNA, 20 bp, human
gtgctcgccacttgcctcca

SEQ ID NO: 30165 - DNA, 20 bp, human
ggagagcgtagcagctgctg

SEQ ID NO: 30166 - DNA, 20 bp, human
gtcctgggaggagagggtaa

SEQ ID NO: 30167 - DNA, 20 bp, human
gagcccagtagtgcctctct

SEQ ID NO: 30168 - DNA, 20 bp, human
ggtgagactgagctcaagca

SEQ ID NO: 30169 - DNA, 20 bp, human
ggggaggcaccaccttgaag

SEQ ID NO: 30170 - DNA, 20 bp, human
gttggaggtgctaactccag

SEQ ID NO: 30171 - DNA, 20 bp, human
gtctcttctttgcaccccct

SEQ ID NO: 30172 - DNA, 20 bp, human
ggactgtgaccagcatagaa

SEQ ID NO: 30173 - DNA, 20 bp, human
ggtggcaagccaacctttga

SEQ ID NO: 30174 - DNA, 20 bp, human
gggtgagtggcgaaagagag

SEQ ID NO: 30175 - DNA, 20 bp, human
gctggtcacagtccttcacg

SEQ ID NO: 30176 - DNA, 20 bp, human
gctgcaggcggacagaagcg

SEQ ID NO: 30177 - DNA, 20 bp, human
ggacagaagcgcggctggtg

SEQ ID NO: 30178 - DNA, 20 bp, human
gcgagctagccagagatact

SEQ ID NO: 30179 - DNA, 20 bp, human
ggggaagctgcgcagaactg

SEQ ID NO: 30180 - DNA, 20 bp, human
gaggctggaggtctggacac

SEQ ID NO: 30181 - DNA, 20 bp, human
ggccagagatactgggccgt

SEQ ID NO: 30182 - DNA, 20 bp, human
ggcccacggcccagtatctc

SEQ ID NO: 30183 - DNA, 20 bp, human
gagggagcgttgttcctccg

SEQ ID NO: 30184 - DNA, 20 bp, human
ggttactagcaagcagctgg

SEQ ID NO: 30185 - DNA, 20 bp, human
gcaggtccaggatccctgaa

SEQ ID NO: 30186 - DNA, 20 bp, human
ggcgccgactctgggactca

SEQ ID NO: 30187 - DNA, 20 bp, human
gcccggcccgcagcagacaa

SEQ ID NO: 30188 - DNA, 20 bp, human
gcgtccctgagtcccagagt

SEQ ID NO: 30189 - DNA, 20 bp, human
gcatgcccgctccagacccg

SEQ ID NO: 30190 - DNA, 20 bp, human
gttcgggccgggcctcgctg

SEQ ID NO: 30191 - DNA, 20 bp, human
gcgaggcccggcccgaatgg

SEQ ID NO: 30192 - DNA, 20 bp, human
gaccgcgccgcgccgactct

SEQ ID NO: 30193 - DNA, 20 bp, human
ggcttcgttaagcttcaaca

SEQ ID NO: 30194 - DNA, 20 bp, human
ggaccccggaagctgcggac

SEQ ID NO: 30195 - DNA, 20 bp, human
gaggcctgagccagcccgct

SEQ ID NO: 30196 - DNA, 20 bp, human
ggaggaacccgaagtgtgag

SEQ ID NO: 30197 - DNA, 20 bp, human
ggcatctttgtcctgacgat

SEQ ID NO: 30198 - DNA, 20 bp, human
gcacttcgggttcctcgggg

SEQ ID NO: 30199 - DNA, 20 bp, human
gggaaccctagcccatcgtc

SEQ ID NO: 30200 - DNA, 20 bp, human
gcgtcaggacaaagatgctc

SEQ ID NO: 30201 - DNA, 20 bp, human
gttgtcctgacgatgggcta

SEQ ID NO: 30202 - DNA, 20 bp, human
gttcgggttcctcggggagg

SEQ ID NO: 30203 - DNA, 20 bp, human
gacctgttacttgaattgaa

SEQ ID NO: 30204 - DNA, 20 bp, human
gttcagttcccctcacactt

SEQ ID NO: 30205 - DNA, 20 bp, human
gaagatgctcaggctgctct

SEQ ID NO: 30206 - DNA, 20 bp, human
gtccctccccactgcgggag

SEQ ID NO: 30207 - DNA, 20 bp, human
ggccgagggtctgggcaaac

SEQ ID NO: 30208 - DNA, 20 bp, human
gcgacaccgtagactaaggt

SEQ ID NO: 30209 - DNA, 20 bp, human
gaaggcgacaccgtagacta

SEQ ID NO: 30210 - DNA, 20 bp, human
gccgcgggagcccccagcat

SEQ ID NO: 30211 - DNA, 20 bp, human
gccgcgcgagccaccactgg

SEQ ID NO: 30212 - DNA, 20 bp, human
gcgcgagccaccactggagg

SEQ ID NO: 30213 - DNA, 20 bp, human
ggggtccccaccttagtcta

SEQ ID NO: 30214 - DNA, 20 bp, human
gtagcactcgcagttagaaa

SEQ ID NO: 30215 - DNA, 20 bp, human
gactgcgagtgctaaggaag

SEQ ID NO: 30216 - DNA, 20 bp, human
gtgcgccagggctacatccg

SEQ ID NO: 30217 - DNA, 20 bp, human
gggatgctagacccaagtcc

SEQ ID NO: 30218 - DNA, 20 bp, human
ggaatccgcggaaggcgagg

SEQ ID NO: 30219 - DNA, 20 bp, human
ggcacccggccgccatcacc

SEQ ID NO: 30220 - DNA, 20 bp, human
gatcacccggaagaggactg

SEQ ID NO: 30221 - DNA, 20 bp, human
gtgggaatccgcggaaggcg

SEQ ID NO: 30222 - DNA, 20 bp, human
gggtgccccggatgtagccc

SEQ ID NO: 30223 - DNA, 20 bp, human
gggagcagggaggaacgggg

SEQ ID NO: 30224 - DNA, 20 bp, human
gggccgccatcacccggaag

SEQ ID NO: 30225 - DNA, 20 bp, human
ggacggaggagcggaccctc

SEQ ID NO: 30226 - DNA, 20 bp, human
gaggcaggatgtgtcagggt

SEQ ID NO: 30227 - DNA, 20 bp, human
ggcaagtgccgcctgtgctg

SEQ ID NO: 30228 - DNA, 20 bp, human
gagagcccaaggcagccaca

SEQ ID NO: 30229 - DNA, 20 bp, human
gttcccctcgggtccaggta

SEQ ID NO: 30230 - DNA, 20 bp, human
gacatgcccctcgcagtcag

SEQ ID NO: 30231 - DNA, 20 bp, human
gggcagccactgactgcgag

SEQ ID NO: 30232 - DNA, 20 bp, human
ggatgaaggtccacacccct

SEQ ID NO: 30233 - DNA, 20 bp, human
gcagcggggcaagtgataag

SEQ ID NO: 30234 - DNA, 20 bp, human
gggggcaagtgataaggggt

SEQ ID NO: 30235 - DNA, 20 bp, human
gaccctgcacccagtgagcc

SEQ ID NO: 30236 - DNA, 20 bp, human
gtggctgcatcgccacccaa

SEQ ID NO: 30237 - DNA, 20 bp, human
gaagtccagggtcccttggg

SEQ ID NO: 30238 - DNA, 20 bp, human
gtgacgtctggcaaagtcca

SEQ ID NO: 30239 - DNA, 20 bp, human
ggcaaagtccagggtccctt

SEQ ID NO: 30240 - DNA, 20 bp, human
ggccagacgtcagggttgag

SEQ ID NO: 30241 - DNA, 20 bp, human
gagctccccaagtccagggt

SEQ ID NO: 30242 - DNA, 20 bp, human
gctgtgcaagaccccaggag

SEQ ID NO: 30243 - DNA, 20 bp, human
gtggagtagcggtcatagag

SEQ ID NO: 30244 - DNA, 20 bp, human
gggggagctctgtcctgagt

SEQ ID NO: 30245 - DNA, 20 bp, human
ggacagagctccccaagtcc

SEQ ID NO: 30246 - DNA, 20 bp, human
gggaatccaagtatatgtaa

SEQ ID NO: 30247 - DNA, 20 bp, human
gcttccaagagcaaagtgag

SEQ ID NO: 30248 - DNA, 20 bp, human
gtagatgagtgagaacacaa

SEQ ID NO: 30249 - DNA, 20 bp, human
gagtagaaagtggatgaccc

SEQ ID NO: 30250 - DNA, 20 bp, human
gaacttggacaagtagaaag

SEQ ID NO: 30251 - DNA, 20 bp, human
gtaggtagaagagctgtcct

SEQ ID NO: 30252 - DNA, 20 bp, human
gtgtcctgggttcaaaccag

SEQ ID NO: 30253 - DNA, 20 bp, human
gacagcacccagaacagtcc

SEQ ID NO: 30254 - DNA, 20 bp, human
gttccgtcctcagcaaatct

SEQ ID NO: 30255 - DNA, 20 bp, human
gagtatatgtaacggagcct

SEQ ID NO: 30256 - DNA, 20 bp, human
gtgggcgcttggtatgacag

SEQ ID NO: 30257 - DNA, 20 bp, human
gggcggtctagatgtgcaga

SEQ ID NO: 30258 - DNA, 20 bp, human
gcatccagggaaatgagagg

SEQ ID NO: 30259 - DNA, 20 bp, human
gccactggttgcagatcagg

SEQ ID NO: 30260 - DNA, 20 bp, human
gtgagccatggcctcaagcc

SEQ ID NO: 30261 - DNA, 20 bp, human
gttgccactggttgcagatc

SEQ ID NO: 30262 - DNA, 20 bp, human
ggcttggtatgacaggggca

SEQ ID NO: 30263 - DNA, 20 bp, human
gggccattaaagaagactcc

SEQ ID NO: 30264 - DNA, 20 bp, human
gattcgacaaaggtgcactg

SEQ ID NO: 30265 - DNA, 20 bp, human
gagaacttccagagtgcatc

SEQ ID NO: 30266 - DNA, 20 bp, human
gacctgtgatcaccaaggag

SEQ ID NO: 30267 - DNA, 20 bp, human
gttggattcaagtccctgaa

SEQ ID NO: 30268 - DNA, 20 bp, human
gcagacacctgtgatcacca

SEQ ID NO: 30269 - DNA, 20 bp, human
gaggtgtctggtgcccttca

SEQ ID NO: 30270 - DNA, 20 bp, human
gtagcttcttgttggaacag

SEQ ID NO: 30271 - DNA, 20 bp, human
gctcaggaaggagacatgtc

SEQ ID NO: 30272 - DNA, 20 bp, human
gagggacttgaatccaagct

SEQ ID NO: 30273 - DNA, 20 bp, human
gagacgctctgttctcagga

SEQ ID NO: 30274 - DNA, 20 bp, human
gcggtgttgacttccgagct

SEQ ID NO: 30275 - DNA, 20 bp, human
ggagtgtggctggagcttta

SEQ ID NO: 30276 - DNA, 20 bp, human
ggcaggtagagtgtcagcag

SEQ ID NO: 30277 - DNA, 20 bp, human
ggatcacccagtccaggatc

SEQ ID NO: 30278 - DNA, 20 bp, human
gactgaaggaggaagttcaa

SEQ ID NO: 30279 - DNA, 20 bp, human
gaaaagcagaggaggaacat

SEQ ID NO: 30280 - DNA, 20 bp, human
gaggtccccgttcccctcag

SEQ ID NO: 30281 - DNA, 20 bp, human
ggagagtgagtaccagcaga

SEQ ID NO: 30282 - DNA, 20 bp, human
gtgagtaccagcagaaggct

SEQ ID NO: 30283 - DNA, 20 bp, human
ggtgacagatcacccagtcc

SEQ ID NO: 30284 - DNA, 20 bp, human
ggaaatgctaggtgaatggt

SEQ ID NO: 30285 - DNA, 20 bp, human
gggccagaaggtgtccttaa

SEQ ID NO: 30286 - DNA, 20 bp, human
ggtgtccagcgcccagaatg

SEQ ID NO: 30287 - DNA, 20 bp, human
gcaccgtgggagcagacgct

SEQ ID NO: 30288 - DNA, 20 bp, human
gagcccgccccgctccccta

SEQ ID NO: 30289 - DNA, 20 bp, human
gttaacagggcaaccagatg

SEQ ID NO: 30290 - DNA, 20 bp, human
ggcggacaagacaccccatc

SEQ ID NO: 30291 - DNA, 20 bp, human
ggccatgaggggaaacccac

SEQ ID NO: 30292 - DNA, 20 bp, human
gcacaggtctggagaaaacc

SEQ ID NO: 30293 - DNA, 20 bp, human
gatatttgctgagtttaaca

SEQ ID NO: 30294 - DNA, 20 bp, human
gcgcctccaggcttggcaca

SEQ ID NO: 30295 - DNA, 20 bp, human
gttcatctttcagggttgtg

SEQ ID NO: 30296 - DNA, 20 bp, human
gcagcggcgaggcccagcaa

SEQ ID NO: 30297 - DNA, 20 bp, human
gccggcgagggactacgtaa

SEQ ID NO: 30298 - DNA, 20 bp, human
gttacccgcgacggcagcag

SEQ ID NO: 30299 - DNA, 20 bp, human
ggcaacggcagcaggagcgc

SEQ ID NO: 30300 - DNA, 20 bp, human
ggcggcccggagcatgacgg

SEQ ID NO: 30301 - DNA, 20 bp, human
gcatgacggcgggtgcgggt

SEQ ID NO: 30302 - DNA, 20 bp, human
gccggagccaggacccacgg

SEQ ID NO: 30303 - DNA, 20 bp, human
gcagttggccggagaactga

SEQ ID NO: 30304 - DNA, 20 bp, human
gggacttggagtcgcacgac

SEQ ID NO: 30305 - DNA, 20 bp, human
gcgtaagggcttacccgcga

SEQ ID NO: 30306 - DNA, 20 bp, human
ggctcatgctgtccccacag

SEQ ID NO: 30307 - DNA, 20 bp, human
ggtgcgcagggataagagag

SEQ ID NO: 30308 - DNA, 20 bp, human
ggtgacaatgggggacgaca

SEQ ID NO: 30309 - DNA, 20 bp, human
gcgggcgccgcagaactcag

SEQ ID NO: 30310 - DNA, 20 bp, human
gcagggataagagagcggtc

SEQ ID NO: 30311 - DNA, 20 bp, human
gaccacgctggtatgaaggg

SEQ ID NO: 30312 - DNA, 20 bp, human
ggttggagcgtggcgaacag

SEQ ID NO: 30313 - DNA, 20 bp, human
ggccggagcaaaaccgttaa

SEQ ID NO: 30314 - DNA, 20 bp, human
gggcttggaggtgacaatgg

SEQ ID NO: 30315 - DNA, 20 bp, human
gctaggaagaccccatgctg

SEQ ID NO: 30316 - DNA, 20 bp, human
ggtagagatgagataagggt

SEQ ID NO: 30317 - DNA, 20 bp, human
ggccgggttctagagtgcca

SEQ ID NO: 30318 - DNA, 20 bp, human
gggagggagggtccaggtga

SEQ ID NO: 30319 - DNA, 20 bp, human
gggccgcaagggaagttcat

SEQ ID NO: 30320 - DNA, 20 bp, human
gacaaccaggagaagatcgg

SEQ ID NO: 30321 - DNA, 20 bp, human
gagcgggggagcttgaccag

SEQ ID NO: 30322 - DNA, 20 bp, human
gctgtgggtcaagtctagtg

SEQ ID NO: 30323 - DNA, 20 bp, human
ggggagttcttgtcgtagta

SEQ ID NO: 30324 - DNA, 20 bp, human
ggcttcagaagtggccgcaa

SEQ ID NO: 30325 - DNA, 20 bp, human
gaaccagtaaccatgaactg

SEQ ID NO: 30326 - DNA, 20 bp, human
gcctagagagacgcaccgag

SEQ ID NO: 30327 - DNA, 20 bp, human
gccgagtggaagacactact

SEQ ID NO: 30328 - DNA, 20 bp, human
gtcagcacgactggttccaa

SEQ ID NO: 30329 - DNA, 20 bp, human
gagccagaaccgggagactg

SEQ ID NO: 30330 - DNA, 20 bp, human
gcagagcagagtctcacgga

SEQ ID NO: 30331 - DNA, 20 bp, human
gctcacctgggagctgacgg

SEQ ID NO: 30332 - DNA, 20 bp, human
gggctaacgcacactcgcgg

SEQ ID NO: 30333 - DNA, 20 bp, human
gcgcctttgggaccaaccag

SEQ ID NO: 30334 - DNA, 20 bp, human
ggttagtagcagccaaggag

SEQ ID NO: 30335 - DNA, 20 bp, human
ggctgtgggcggcagtgcgt

SEQ ID NO: 30336 - DNA, 20 bp, human
ggtactgaggactgcagtgt

SEQ ID NO: 30337 - DNA, 20 bp, human
gccatcacccagatgacggg

SEQ ID NO: 30338 - DNA, 20 bp, human
gatgcttaaaccatacccaa

SEQ ID NO: 30339 - DNA, 20 bp, human
gtataggaggacaggaaaaa

SEQ ID NO: 30340 - DNA, 20 bp, human
gcatttggacaattcttaat

SEQ ID NO: 30341 - DNA, 20 bp, human
gaattcttaataggatcaaa

SEQ ID NO: 30342 - DNA, 20 bp, human
gcatgaaatgccattgggta

SEQ ID NO: 30343 - DNA, 20 bp, human
gtggtttaagcataaaatat

SEQ ID NO: 30344 - DNA, 20 bp, human
ggtgtcacctcccgtcatct

SEQ ID NO: 30345 - DNA, 20 bp, human
gacatctaacctcattatat

SEQ ID NO: 30346 - DNA, 20 bp, human
gctgcagagtagggcaccgt

SEQ ID NO: 30347 - DNA, 20 bp, human
gcttgtctcagggagaccta

SEQ ID NO: 30348 - DNA, 20 bp, human
ggtagcctgcctgcagagta

SEQ ID NO: 30349 - DNA, 20 bp, human
gctgagacaagggagacccc

SEQ ID NO: 30350 - DNA, 20 bp, human
ggctgacagtgggggagaca

SEQ ID NO: 30351 - DNA, 20 bp, human
gtcaggctgccgaggacctg

SEQ ID NO: 30352 - DNA, 20 bp, human
gagaccccaggaagttgctt

SEQ ID NO: 30353 - DNA, 20 bp, human
ggtgggttccagtagatcag

SEQ ID NO: 30354 - DNA, 20 bp, human
gcaacccaagcaacttcctg

SEQ ID NO: 30355 - DNA, 20 bp, human
gagaggagatgcggatacgg

SEQ ID NO: 30356 - DNA, 20 bp, human
gggctgggcgaagatgaggc

SEQ ID NO: 30357 - DNA, 20 bp, human
ggtgctgagtagggagtccc

SEQ ID NO: 30358 - DNA, 20 bp, human
gatgaggccggcaggaggct

SEQ ID NO: 30359 - DNA, 20 bp, human
ggaactcgcagttggccata

SEQ ID NO: 30360 - DNA, 20 bp, human
gcagccgagagcccgccggg

SEQ ID NO: 30361 - DNA, 20 bp, human
gatagggctccaggcggggt

SEQ ID NO: 30362 - DNA, 20 bp, human
gcgccgggtggtgctgagta

SEQ ID NO: 30363 - DNA, 20 bp, human
gcggaaccgggcatcttccg

SEQ ID NO: 30364 - DNA, 20 bp, human
ggctctcggctgacccgcca

SEQ ID NO: 30365 - DNA, 20 bp, human
ggcgactaaggcgcaccggt

SEQ ID NO: 30366 - DNA, 20 bp, human
gctgtgagtcagctagggga

SEQ ID NO: 30367 - DNA, 20 bp, human
ggctatgttccatctcccag

SEQ ID NO: 30368 - DNA, 20 bp, human
ggtacctgtgagtcagctag

SEQ ID NO: 30369 - DNA, 20 bp, human
gaggtaaggctactccaggt

SEQ ID NO: 30370 - DNA, 20 bp, human
ggtcaccgaactatcagcct

SEQ ID NO: 30371 - DNA, 20 bp, human
ggccttaccttgcgagagaa

SEQ ID NO: 30372 - DNA, 20 bp, human
ggatgagttccgctgggaga

SEQ ID NO: 30373 - DNA, 20 bp, human
gtctcacaggttgcctaggt

SEQ ID NO: 30374 - DNA, 20 bp, human
gctactggatgagttccgct

SEQ ID NO: 30375 - DNA, 20 bp, human
gaaggtctcacaggttgcct

SEQ ID NO: 30376 - DNA, 20 bp, human
gacgctctcccaggcacccg

SEQ ID NO: 30377 - DNA, 20 bp, human
gaggtgcctgcttcagaaaa

SEQ ID NO: 30378 - DNA, 20 bp, human
gcccaatgctaggatgaaaa

SEQ ID NO: 30379 - DNA, 20 bp, human
ggatgcagtcgggcactcac

SEQ ID NO: 30380 - DNA, 20 bp, human
ggtgcctgggagagcgttcg

SEQ ID NO: 30381 - DNA, 20 bp, human
gaatgctaggatgaaaaagg

SEQ ID NO: 30382 - DNA, 20 bp, human
ggctagagataaggaccctg

SEQ ID NO: 30383 - DNA, 20 bp, human
gggccattgttcccaatgct

SEQ ID NO: 30384 - DNA, 20 bp, human
gggggactaaagaaaaagat

SEQ ID NO: 30385 - DNA, 20 bp, human
gccccacacaggaagtagag

SEQ ID NO: 30386 - DNA, 20 bp, human
gaacctggtgcgagcagccc

SEQ ID NO: 30387 - DNA, 20 bp, human
gatcctgggacccacacctc

SEQ ID NO: 30388 - DNA, 20 bp, human
gacagggttgcctgaggtgt

SEQ ID NO: 30389 - DNA, 20 bp, human
ggcgccctgcaagattggac

SEQ ID NO: 30390 - DNA, 20 bp, human
gggcgtgaagttccagccag

SEQ ID NO: 30391 - DNA, 20 bp, human
gtcaggcaaccctgtagccc

SEQ ID NO: 30392 - DNA, 20 bp, human
gagccccaggccggcggtga

SEQ ID NO: 30393 - DNA, 20 bp, human
gatccacgtggtctgcaacc

SEQ ID NO: 30394 - DNA, 20 bp, human
gtaggggcaatccgtccgga

SEQ ID NO: 30395 - DNA, 20 bp, human
gagaccacgtggatccaaag

SEQ ID NO: 30396 - DNA, 20 bp, human
gcagccccaacagtgatggg

SEQ ID NO: 30397 - DNA, 20 bp, human
gcatgtcagtctctgtcctc

SEQ ID NO: 30398 - DNA, 20 bp, human
gagcccccagctctgaagta

SEQ ID NO: 30399 - DNA, 20 bp, human
gctgtcctccggcaaaagcg

SEQ ID NO: 30400 - DNA, 20 bp, human
ggccagtctagctgctgcac

SEQ ID NO: 30401 - DNA, 20 bp, human
gcataggccaagaaactaaa

SEQ ID NO: 30402 - DNA, 20 bp, human
ggctggctggctggctgcta

SEQ ID NO: 30403 - DNA, 20 bp, human
gatttgaatgcagcccaaaa

SEQ ID NO: 30404 - DNA, 20 bp, human
gactagtgagacaggaatat

SEQ ID NO: 30405 - DNA, 20 bp, human
gcaaggtaagggcctactag

SEQ ID NO: 30406 - DNA, 20 bp, human
ggagctgtgggcagacaact

SEQ ID NO: 30407 - DNA, 20 bp, human
ggaagactggagactatccc

SEQ ID NO: 30408 - DNA, 20 bp, human
ggtggaaggcaactagtcgt

SEQ ID NO: 30409 - DNA, 20 bp, human
gaggctgggaaaggcgtgga

SEQ ID NO: 30410 - DNA, 20 bp, human
ggacttggagctctgcaacc

SEQ ID NO: 30411 - DNA, 20 bp, human
gctagtcgtgggcagttgag

SEQ ID NO: 30412 - DNA, 20 bp, human
gaaacaggcgtatctgtgtg

SEQ ID NO: 30413 - DNA, 20 bp, human
gaacaaagcaccctccccac

SEQ ID NO: 30414 - DNA, 20 bp, human
gctggagactatcccaggct

SEQ ID NO: 30415 - DNA, 20 bp, human
gttaggtcactactcctcta

SEQ ID NO: 30416 - DNA, 20 bp, human
gaccatagcgaggtgagacc

SEQ ID NO: 30417 - DNA, 20 bp, human
gaggcagacgaaccatagcg

SEQ ID NO: 30418 - DNA, 20 bp, human
ggcctggtctcacctcgcta

SEQ ID NO: 30419 - DNA, 20 bp, human
ggtcagcagaggcctcgctc

SEQ ID NO: 30420 - DNA, 20 bp, human
ggaccaggcggcaggaccac

SEQ ID NO: 30421 - DNA, 20 bp, human
gggccacacagagactggta

SEQ ID NO: 30422 - DNA, 20 bp, human
ggggaagtgaggcggaccaa

SEQ ID NO: 30423 - DNA, 20 bp, human
gagactggtagggggttcag

SEQ ID NO: 30424 - DNA, 20 bp, human
ggggcaaaaacaactcacag

SEQ ID NO: 30425 - DNA, 20 bp, human
gtcccgggagcggcctacag

SEQ ID NO: 30426 - DNA, 20 bp, human
gaggataacagagatggtat

SEQ ID NO: 30427 - DNA, 20 bp, human
ggtccagtggccgcagatcg

SEQ ID NO: 30428 - DNA, 20 bp, human
gtaactaatcctgagtaagg

SEQ ID NO: 30429 - DNA, 20 bp, human
gcgcagatcggggagaagtt

SEQ ID NO: 30430 - DNA, 20 bp, human
gcaaagtggccaccttactc

SEQ ID NO: 30431 - DNA, 20 bp, human
gtcttaactaatcctgagta

SEQ ID NO: 30432 - DNA, 20 bp, human
gagtgctgacccaatcatct

SEQ ID NO: 30433 - DNA, 20 bp, human
gatgctgatgggcagtccag

SEQ ID NO: 30434 - DNA, 20 bp, human
gcatgagaagactgtcaaag

SEQ ID NO: 30435 - DNA, 20 bp, human
gcttgtaaaaagcttaggag

SEQ ID NO: 30436 - DNA, 20 bp, human
gggcggaccgaacctggcag

SEQ ID NO: 30437 - DNA, 20 bp, human
ggcggaggacgggacgagga

SEQ ID NO: 30438 - DNA, 20 bp, human
gcgatctgcgccaggctcag

SEQ ID NO: 30439 - DNA, 20 bp, human
ggaggacgggacgaggatgg

SEQ ID NO: 30440 - DNA, 20 bp, human
ggaggatggcggaccgaacc

SEQ ID NO: 30441 - DNA, 20 bp, human
ggccggcggaggacgggacg

SEQ ID NO: 30442 - DNA, 20 bp, human
gaaactgcagccaacttccg

SEQ ID NO: 30443 - DNA, 20 bp, human
gagggccgactcagccggag

SEQ ID NO: 30444 - DNA, 20 bp, human
gcgcgggcgaaaggagctgg

SEQ ID NO: 30445 - DNA, 20 bp, human
gatgaggctgcctcggaagt

SEQ ID NO: 30446 - DNA, 20 bp, human
gcccttctgggtccagatat

SEQ ID NO: 30447 - DNA, 20 bp, human
ggactgggcgccctaggtga

SEQ ID NO: 30448 - DNA, 20 bp, human
gcagaacaagccctcaccta

SEQ ID NO: 30449 - DNA, 20 bp, human
ggattgttgcgtcccatatc

SEQ ID NO: 30450 - DNA, 20 bp, human
ggcccgaggtgaagcttgtt

SEQ ID NO: 30451 - DNA, 20 bp, human
gggggacagggttctctgag

SEQ ID NO: 30452 - DNA, 20 bp, human
gaccaaacaagcttcacctc

SEQ ID NO: 30453 - DNA, 20 bp, human
gactagagctctcctcagtc

SEQ ID NO: 30454 - DNA, 20 bp, human
gtcccatatctggacccaga

SEQ ID NO: 30455 - DNA, 20 bp, human
gctcagtcgggcaagagtcg

SEQ ID NO: 30456 - DNA, 20 bp, human
gcggtcggtcctgcctgtaa

SEQ ID NO: 30457 - DNA, 20 bp, human
gtcggtcctgcctgtaacgg

SEQ ID NO: 30458 - DNA, 20 bp, human
gcaagaaagggcgcgatcag

SEQ ID NO: 30459 - DNA, 20 bp, human
gttggagatggagaaccggg

SEQ ID NO: 30460 - DNA, 20 bp, human
gcagccgccgccgccgttac

SEQ ID NO: 30461 - DNA, 20 bp, human
ggtcctgcctgtaacggcgg

SEQ ID NO: 30462 - DNA, 20 bp, human
ggcgcccgaagtgcagacgt

SEQ ID NO: 30463 - DNA, 20 bp, human
gtcctgcctgtgacgcgcgg

SEQ ID NO: 30464 - DNA, 20 bp, human
ggaccgccgccgcgcgtcac

SEQ ID NO: 30465 - DNA, 20 bp, human
ggccccggccaccctcttca

SEQ ID NO: 30466 - DNA, 20 bp, human
ggttgctgggaagttctgga

SEQ ID NO: 30467 - DNA, 20 bp, human
gaaggaagcatgtgctccag

SEQ ID NO: 30468 - DNA, 20 bp, human
gctgcgttgctgggaagttc

SEQ ID NO: 30469 - DNA, 20 bp, human
gttcatggaccaccaaccac

SEQ ID NO: 30470 - DNA, 20 bp, human
gaaccacgggacaaaatatg

SEQ ID NO: 30471 - DNA, 20 bp, human
gagaggttgggattcgtgtc

SEQ ID NO: 30472 - DNA, 20 bp, human
gagcctggctagaaaaaggc

SEQ ID NO: 30473 - DNA, 20 bp, human
ggcatggtcagttgggaaag

SEQ ID NO: 30474 - DNA, 20 bp, human
gaaaaggccggggctaaaaa

SEQ ID NO: 30475 - DNA, 20 bp, human
gaggtctcaaagaatgccta

SEQ ID NO: 30476 - DNA, 20 bp, human
ggcggttgcagagaccccat

SEQ ID NO: 30477 - DNA, 20 bp, human
gagctgggcaccgcaggtga

SEQ ID NO: 30478 - DNA, 20 bp, human
gctgggcagctgggcaccgc

SEQ ID NO: 30479 - DNA, 20 bp, human
gggtatctcgctctcagaga

SEQ ID NO: 30480 - DNA, 20 bp, human
gcaccgcaggtgagggtgtc

SEQ ID NO: 30481 - DNA, 20 bp, human
gtcgctctcagagagggaga

SEQ ID NO: 30482 - DNA, 20 bp, human
ggtgcaagagagactgcagg

SEQ ID NO: 30483 - DNA, 20 bp, human
gatccccagcaggtacaagg

SEQ ID NO: 30484 - DNA, 20 bp, human
gggtgggacatgcaggacag

SEQ ID NO: 30485 - DNA, 20 bp, human
gggccagaaaccatgcccat

SEQ ID NO: 30486 - DNA, 20 bp, human
gtgatctcagggctgtctgg

SEQ ID NO: 30487 - DNA, 20 bp, human
gaggtgatctcagggctgtc

SEQ ID NO: 30488 - DNA, 20 bp, human
gcagctggggagcacttaca

SEQ ID NO: 30489 - DNA, 20 bp, human
gaggatcttcgtggctgtct

SEQ ID NO: 30490 - DNA, 20 bp, human
gatctccccagactccctgt

SEQ ID NO: 30491 - DNA, 20 bp, human
gccctgagtgaggaaggcat

SEQ ID NO: 30492 - DNA, 20 bp, human
gatcggcccacagggagtct

SEQ ID NO: 30493 - DNA, 20 bp, human
gggcgcgttggggcacccaa

SEQ ID NO: 30494 - DNA, 20 bp, human
gtctcctggcctctccccaa

SEQ ID NO: 30495 - DNA, 20 bp, human
gaggaaggcatcggcccaca

SEQ ID NO: 30496 - DNA, 20 bp, human
gccttgaggtggccgagaca

SEQ ID NO: 30497 - DNA, 20 bp, human
gctggtaacacagatatccg

SEQ ID NO: 30498 - DNA, 20 bp, human
gttagtgattatccttgagg

SEQ ID NO: 30499 - DNA, 20 bp, human
gtctgaagaccagagcacat

SEQ ID NO: 30500 - DNA, 20 bp, human
gaattctgccgaaaggactg

SEQ ID NO: 30501 - DNA, 20 bp, human
gacggtgcctggaaaaggta

SEQ ID NO: 30502 - DNA, 20 bp, human
gatctcgcatagaaagctcc

SEQ ID NO: 30503 - DNA, 20 bp, human
gtggcttgctgtctaatgtg

SEQ ID NO: 30504 - DNA, 20 bp, human
gtaaagacagctctggctgt

SEQ ID NO: 30505 - DNA, 20 bp, human
gtctatgcgagatgacattg

SEQ ID NO: 30506 - DNA, 20 bp, human
gggaaggccacagtcaccta

SEQ ID NO: 30507 - DNA, 20 bp, human
ggagtcgcagctacgcccag

SEQ ID NO: 30508 - DNA, 20 bp, human
gggcgcgccgggttagaaca

SEQ ID NO: 30509 - DNA, 20 bp, human
gctgggtgggaggtccaagt

SEQ ID NO: 30510 - DNA, 20 bp, human
gctgcgactcggcggagtcc

SEQ ID NO: 30511 - DNA, 20 bp, human
gtgctccgcaaacccagccg

SEQ ID NO: 30512 - DNA, 20 bp, human
gctggcaaaatcgaaaggga

SEQ ID NO: 30513 - DNA, 20 bp, human
ggtctctgagacacgcacag

SEQ ID NO: 30514 - DNA, 20 bp, human
gcaagcctggcaaaatcgaa

SEQ ID NO: 30515 - DNA, 20 bp, human
gcgcagctacgcccagcggc

SEQ ID NO: 30516 - DNA, 20 bp, human
gtggctgggcactcgcgcag

SEQ ID NO: 30517 - DNA, 20 bp, human
gacgcggtcggccagaagta

SEQ ID NO: 30518 - DNA, 20 bp, human
gccagcaaccatggctcgtc

SEQ ID NO: 30519 - DNA, 20 bp, human
ggcgtcgctcccagcaacca

SEQ ID NO: 30520 - DNA, 20 bp, human
gaggccggcccgacgagcca

SEQ ID NO: 30521 - DNA, 20 bp, human
gtaggcggtgcttgaactta

SEQ ID NO: 30522 - DNA, 20 bp, human
gtggtcactggagctcggga

SEQ ID NO: 30523 - DNA, 20 bp, human
gtgggcactcgcgcagaggc

SEQ ID NO: 30524 - DNA, 20 bp, human
ggagtcagcaaggaactgtg

SEQ ID NO: 30525 - DNA, 20 bp, human
gtgtggccttagggaaggac

SEQ ID NO: 30526 - DNA, 20 bp, human
ggaactgccgtgaccacgga

SEQ ID NO: 30527 - DNA, 20 bp, human
gttcgggccttcttacctgg

SEQ ID NO: 30528 - DNA, 20 bp, human
gctggagcgaaagaatgcgg

SEQ ID NO: 30529 - DNA, 20 bp, human
gcgcagaagcggctcgaggc

SEQ ID NO: 30530 - DNA, 20 bp, human
gtgggcgccgccaggtaaga

SEQ ID NO: 30531 - DNA, 20 bp, human
gtgagcgcagaagcggctcg

SEQ ID NO: 30532 - DNA, 20 bp, human
gtgggtgagccgagccgagg

SEQ ID NO: 30533 - DNA, 20 bp, human
ggtctcaagggaagctctag

SEQ ID NO: 30534 - DNA, 20 bp, human
gggccagccctccgtggtca

SEQ ID NO: 30535 - DNA, 20 bp, human
ggggctggagcgaaagaatg

SEQ ID NO: 30536 - DNA, 20 bp, human
gcagagcctctgggagagga

SEQ ID NO: 30537 - DNA, 20 bp, human
ggactgaactgggaaactca

SEQ ID NO: 30538 - DNA, 20 bp, human
gggtccagagcctctgggag

SEQ ID NO: 30539 - DNA, 20 bp, human
gtgtaaagggtctgccagat

SEQ ID NO: 30540 - DNA, 20 bp, human
gtgtgtaggtccagagcctc

SEQ ID NO: 30541 - DNA, 20 bp, human
ggcctgtgatggttcattgt

SEQ ID NO: 30542 - DNA, 20 bp, human
gaacaggagtgtgtataaac

SEQ ID NO: 30543 - DNA, 20 bp, human
gtgatggttcattgtaggta

SEQ ID NO: 30544 - DNA, 20 bp, human
gcaaggttctttttactgtg

SEQ ID NO: 30545 - DNA, 20 bp, human
gcagtaccttaatttctagg

SEQ ID NO: 30546 - DNA, 20 bp, human
gaatagcagagccatgacca

SEQ ID NO: 30547 - DNA, 20 bp, human
gtagctgcaagtatgttaag

SEQ ID NO: 30548 - DNA, 20 bp, human
ggttaccaaatgtaaaaagg

SEQ ID NO: 30549 - DNA, 20 bp, human
ggctgaaatttaaggctaga

SEQ ID NO: 30550 - DNA, 20 bp, human
gccttcacctgccttggtca

SEQ ID NO: 30551 - DNA, 20 bp, human
gcaaatgtgtatggattaag

SEQ ID NO: 30552 - DNA, 20 bp, human
gaaagacaggtcctgagtgc

SEQ ID NO: 30553 - DNA, 20 bp, human
gagatactcaccaaggatca

SEQ ID NO: 30554 - DNA, 20 bp, human
ggcagttctacttcctttcc

SEQ ID NO: 30555 - DNA, 20 bp, human
gtaatgctttgcctgcactc

SEQ ID NO: 30556 - DNA, 20 bp, human
gccctagggacccattggta

SEQ ID NO: 30557 - DNA, 20 bp, human
ggcaggcgtgagacactcac

SEQ ID NO: 30558 - DNA, 20 bp, human
gtcctggagtgacagaatgt

SEQ ID NO: 30559 - DNA, 20 bp, human
gcagggaggtccagcatctg

SEQ ID NO: 30560 - DNA, 20 bp, human
ggacacaggagcccctcgag

SEQ ID NO: 30561 - DNA, 20 bp, human
ggatcgcatgcgtgtcggag

SEQ ID NO: 30562 - DNA, 20 bp, human
gacagccccagcccctcgag

SEQ ID NO: 30563 - DNA, 20 bp, human
gccctagggtgtgaggaggg

SEQ ID NO: 30564 - DNA, 20 bp, human
gggactgagagggccggacc

SEQ ID NO: 30565 - DNA, 20 bp, human
gtagagcagacctgcgccag

SEQ ID NO: 30566 - DNA, 20 bp, human
ggcctcacctgggcttccca

SEQ ID NO: 30567 - DNA, 20 bp, human
gagactggcgggccgagggt

SEQ ID NO: 30568 - DNA, 20 bp, human
gctagagagccccggagccg

SEQ ID NO: 30569 - DNA, 20 bp, human
gggaacgcgcagccagcctt

SEQ ID NO: 30570 - DNA, 20 bp, human
gggggcccaggacagatcca

SEQ ID NO: 30571 - DNA, 20 bp, human
gcgtgaagggaagccctcga

SEQ ID NO: 30572 - DNA, 20 bp, human
gaggcccgcggagactcgtc

SEQ ID NO: 30573 - DNA, 20 bp, human
gctctcctgcgggtaaagag

SEQ ID NO: 30574 - DNA, 20 bp, human
gctgggccccagaggcggcg

SEQ ID NO: 30575 - DNA, 20 bp, human
gaggacagatccaagggcgc

SEQ ID NO: 30576 - DNA, 20 bp, human
gagctggactttgggtgagg

SEQ ID NO: 30577 - DNA, 20 bp, human
gggcggttcagccatgaggc

SEQ ID NO: 30578 - DNA, 20 bp, human
gagacagcctagctggactt

SEQ ID NO: 30579 - DNA, 20 bp, human
gtgggtgtcaccgtgaagga

SEQ ID NO: 30580 - DNA, 20 bp, human
gggagatggttagcaaccca

SEQ ID NO: 30581 - DNA, 20 bp, human
ggcatttccatgactagtgg

SEQ ID NO: 30582 - DNA, 20 bp, human
gccacggttacagagagcac

SEQ ID NO: 30583 - DNA, 20 bp, human
gagtggcagttgagggtccc

SEQ ID NO: 30584 - DNA, 20 bp, human
ggggagcagggttgagcaac

SEQ ID NO: 30585 - DNA, 20 bp, human
gaccgtgggtgtcaccgtga

SEQ ID NO: 30586 - DNA, 20 bp, human
gagattccctagttaatctc

SEQ ID NO: 30587 - DNA, 20 bp, human
gacttgacctgagattaact

SEQ ID NO: 30588 - DNA, 20 bp, human
ggtagttatacaagatatac

SEQ ID NO: 30589 - DNA, 20 bp, human
gctacagtgaaagtctttgc

SEQ ID NO: 30590 - DNA, 20 bp, human
gtgatatctaatggttgtta

SEQ ID NO: 30591 - DNA, 20 bp, human
gtgattgcctatttactctc

SEQ ID NO: 30592 - DNA, 20 bp, human
gatctaatggttgttaggga

SEQ ID NO: 30593 - DNA, 20 bp, human
gctatgtatgtgatatctaa

SEQ ID NO: 30594 - DNA, 20 bp, human
gttgagtctgtgaggctctg

SEQ ID NO: 30595 - DNA, 20 bp, human
ggagataccagagagtaaat

SEQ ID NO: 30596 - DNA, 20 bp, human
gcggggcatggagcagatct

SEQ ID NO: 30597 - DNA, 20 bp, human
gaaagacacggtgccttacg

SEQ ID NO: 30598 - DNA, 20 bp, human
gtgagcctctctgggtctac

SEQ ID NO: 30599 - DNA, 20 bp, human
gatctgctccatgccccgta

SEQ ID NO: 30600 - DNA, 20 bp, human
gcctcgtgttccgagactgt

SEQ ID NO: 30601 - DNA, 20 bp, human
gcagctgcactcgcccggct

SEQ ID NO: 30602 - DNA, 20 bp, human
ggctgtgctgtggctcagac

SEQ ID NO: 30603 - DNA, 20 bp, human
ggcagggccgctgctttggg

SEQ ID NO: 30604 - DNA, 20 bp, human
ggaacatggccgggcctccg

SEQ ID NO: 30605 - DNA, 20 bp, human
gacagcccccaggaagcggg

SEQ ID NO: 30606 - DNA, 20 bp, human
gggcaggctggtcccctgac

SEQ ID NO: 30607 - DNA, 20 bp, human
gtagcgcaggaggggcgatg

SEQ ID NO: 30608 - DNA, 20 bp, human
gaccaggctgcccggtgtag

SEQ ID NO: 30609 - DNA, 20 bp, human
ggcgctggatgcacaccacg

SEQ ID NO: 30610 - DNA, 20 bp, human
gggtgcggcgcaggccctat

SEQ ID NO: 30611 - DNA, 20 bp, human
gcccgcaggacgcacccata

SEQ ID NO: 30612 - DNA, 20 bp, human
ggaatgagatgggtacaaag

SEQ ID NO: 30613 - DNA, 20 bp, human
gtcaccccaagtgactcgag

SEQ ID NO: 30614 - DNA, 20 bp, human
gtacagggagatcccgggat

SEQ ID NO: 30615 - DNA, 20 bp, human
gagcagcccgaaccctcctc

SEQ ID NO: 30616 - DNA, 20 bp, human
gtgacagggaagacgagtgg

SEQ ID NO: 30617 - DNA, 20 bp, human
gacagagacgagaggggcaa

SEQ ID NO: 30618 - DNA, 20 bp, human
ggtaaacggacagagacgag

SEQ ID NO: 30619 - DNA, 20 bp, human
gcaagtgcccgcagtcctag

SEQ ID NO: 30620 - DNA, 20 bp, human
gtaagccgtgcagtcacaga

SEQ ID NO: 30621 - DNA, 20 bp, human
gagggaggacagtggatgac

SEQ ID NO: 30622 - DNA, 20 bp, human
gcacagagcctagttgtaaa

SEQ ID NO: 30623 - DNA, 20 bp, human
gagtggggatgcaggatcaa

SEQ ID NO: 30624 - DNA, 20 bp, human
gagggcacccctaggactgc

SEQ ID NO: 30625 - DNA, 20 bp, human
gcggttaggacagggtaagg

SEQ ID NO: 30626 - DNA, 20 bp, human
gcgtcagggaccagaccctg

SEQ ID NO: 30627 - DNA, 20 bp, human
gacgcttcggggccacccca

SEQ ID NO: 30628 - DNA, 20 bp, human
gccactagggaagtacctgg

SEQ ID NO: 30629 - DNA, 20 bp, human
gtgcgttccgcgaacttggg

SEQ ID NO: 30630 - DNA, 20 bp, human
gacttgggaggcgactgctg

SEQ ID NO: 30631 - DNA, 20 bp, human
gagtccactagggaagtacc

SEQ ID NO: 30632 - DNA, 20 bp, human
gccctgacgacgcgcagtga

SEQ ID NO: 30633 - DNA, 20 bp, human
ggtacctggaggtggagacg

SEQ ID NO: 30634 - DNA, 20 bp, human
gtgctacgccggtgagggaa

SEQ ID NO: 30635 - DNA, 20 bp, human
ggtcgatcagctagagggtg

SEQ ID NO: 30636 - DNA, 20 bp, human
gcgcgctggtcatccatgac

SEQ ID NO: 30637 - DNA, 20 bp, human
ggaagatcagaagccagtca

SEQ ID NO: 30638 - DNA, 20 bp, human
ggtcagggtcccagatgcac

SEQ ID NO: 30639 - DNA, 20 bp, human
gcagggcgccggcccagcat

SEQ ID NO: 30640 - DNA, 20 bp, human
gcatagcatgtgaaactcta

SEQ ID NO: 30641 - DNA, 20 bp, human
gatgtgtgagcaccaggaaa

SEQ ID NO: 30642 - DNA, 20 bp, human
gttcacagcccagctttagt

SEQ ID NO: 30643 - DNA, 20 bp, human
gagcaccggccaggagtcac

SEQ ID NO: 30644 - DNA, 20 bp, human
gatctgggaccctgaccccc

SEQ ID NO: 30645 - DNA, 20 bp, human
gagtttcacatgctatgcag

SEQ ID NO: 30646 - DNA, 20 bp, human
gactgggagaagatgcctgg

SEQ ID NO: 30647 - DNA, 20 bp, human
gctcaaactaaccaacccac

SEQ ID NO: 30648 - DNA, 20 bp, human
ggcatcttctcccagtgggt

SEQ ID NO: 30649 - DNA, 20 bp, human
gaagaggaggcagaggatag

SEQ ID NO: 30650 - DNA, 20 bp, human
gttgagttgcagcagtccca

SEQ ID NO: 30651 - DNA, 20 bp, human
gggggcaggaaggggactta

SEQ ID NO: 30652 - DNA, 20 bp, human
gagcattcagcgtctgtcaa

SEQ ID NO: 30653 - DNA, 20 bp, human
gtccacagtctcacacaggg

SEQ ID NO: 30654 - DNA, 20 bp, human
ggccccaccttggcccatct

SEQ ID NO: 30655 - DNA, 20 bp, human
ggcgtccacagtctcacaca

SEQ ID NO: 30656 - DNA, 20 bp, human
ggagcctcggacgttgtcac

SEQ ID NO: 30657 - DNA, 20 bp, human
ggacaacgtccgaggctcct

SEQ ID NO: 30658 - DNA, 20 bp, human
gccgtggaagaactaggctc

SEQ ID NO: 30659 - DNA, 20 bp, human
gcagcaacgccaccatccag

SEQ ID NO: 30660 - DNA, 20 bp, human
gaaacccgtgacaacgtccg

SEQ ID NO: 30661 - DNA, 20 bp, human
ggagttagcaaccaggaccg

SEQ ID NO: 30662 - DNA, 20 bp, human
gggaaaacgtgtaactgcac

SEQ ID NO: 30663 - DNA, 20 bp, human
gcatcttccagggtccggtt

SEQ ID NO: 30664 - DNA, 20 bp, human
ggacaacgccagcctggcca

SEQ ID NO: 30665 - DNA, 20 bp, human
gaacgtccgaggctccttgg

SEQ ID NO: 30666 - DNA, 20 bp, human
gaagtaacagaagttagaag

SEQ ID NO: 30667 - DNA, 20 bp, human
gtgtgggaatgagaccctaa

SEQ ID NO: 30668 - DNA, 20 bp, human
ggggcaagcctggatccagg

SEQ ID NO: 30669 - DNA, 20 bp, human
gggcttgagaaattcaaata

SEQ ID NO: 30670 - DNA, 20 bp, human
gcagtgccaggagttggaca

SEQ ID NO: 30671 - DNA, 20 bp, human
gaacttctgttactttacag

SEQ ID NO: 30672 - DNA, 20 bp, human
gtgagggcaagcctggatcc

SEQ ID NO: 30673 - DNA, 20 bp, human
gtacctctgctaccacctcc

SEQ ID NO: 30674 - DNA, 20 bp, human
gatcttactatgggatagct

SEQ ID NO: 30675 - DNA, 20 bp, human
ggtaaaattctagtgaaagt

SEQ ID NO: 30676 - DNA, 20 bp, human
ggagagcgagcgcgcaacgg

SEQ ID NO: 30677 - DNA, 20 bp, human
gccagagagcgagcgcgcaa

SEQ ID NO: 30678 - DNA, 20 bp, human
gggcctggcaggatgcgcgg

SEQ ID NO: 30679 - DNA, 20 bp, human
gcgcgggccgcgaagttgtg

SEQ ID NO: 30680 - DNA, 20 bp, human
gcctcagccccaatgtcggg

SEQ ID NO: 30681 - DNA, 20 bp, human
gtgggctccaggagcggggt

SEQ ID NO: 30682 - DNA, 20 bp, human
ggcagcgtgctaggccccgc

SEQ ID NO: 30683 - DNA, 20 bp, human
gcaggcacacactccacgtt

SEQ ID NO: 30684 - DNA, 20 bp, human
gggcgcgggccggtcctggg

SEQ ID NO: 30685 - DNA, 20 bp, human
gaggtggccccacaacttcg

SEQ ID NO: 30686 - DNA, 20 bp, human
gaggctccctgagaagggtg

SEQ ID NO: 30687 - DNA, 20 bp, human
gtcccagctccagatacagg

SEQ ID NO: 30688 - DNA, 20 bp, human
ggtctcccagctccagatac

SEQ ID NO: 30689 - DNA, 20 bp, human
gagctccagatacaggaggt

SEQ ID NO: 30690 - DNA, 20 bp, human
ggtgcactcacctacataga

SEQ ID NO: 30691 - DNA, 20 bp, human
gtcacctacatagaaggtgt

SEQ ID NO: 30692 - DNA, 20 bp, human
gtggctggaggcgtgatcct

SEQ ID NO: 30693 - DNA, 20 bp, human
gggtggtctgcgggtcatgg

SEQ ID NO: 30694 - DNA, 20 bp, human
gaagggatggaacccagtga

SEQ ID NO: 30695 - DNA, 20 bp, human
ggagccacagggccacaccc

SEQ ID NO: 30696 - DNA, 20 bp, human
gacgccgactgaggcacgag

SEQ ID NO: 30697 - DNA, 20 bp, human
gtgcagtccgacgccgactg

SEQ ID NO: 30698 - DNA, 20 bp, human
gcggccgagtgtgagaactg

SEQ ID NO: 30699 - DNA, 20 bp, human
gctgcagagggcaacgcgat

SEQ ID NO: 30700 - DNA, 20 bp, human
gggcacgagcgggtgacgct

SEQ ID NO: 30701 - DNA, 20 bp, human
gctgcccccttgctcacctg

SEQ ID NO: 30702 - DNA, 20 bp, human
gtagcctgccggacaaccat

SEQ ID NO: 30703 - DNA, 20 bp, human
gcacccgctcgtgcctcagt

SEQ ID NO: 30704 - DNA, 20 bp, human
gcgtcggactgcacagcccg

SEQ ID NO: 30705 - DNA, 20 bp, human
gcggaactagtgacaggtcg

SEQ ID NO: 30706 - DNA, 20 bp, human
gctaggctggcgaccctctg

SEQ ID NO: 30707 - DNA, 20 bp, human
gtaggtgctgcgatacccac

SEQ ID NO: 30708 - DNA, 20 bp, human
gagctggaggccgcgcgaca

SEQ ID NO: 30709 - DNA, 20 bp, human
gtgacccaggagaccgtgta

SEQ ID NO: 30710 - DNA, 20 bp, human
gggaggcgcgacgggaggct

SEQ ID NO: 30711 - DNA, 20 bp, human
gcctgtacctggatgcggat

SEQ ID NO: 30712 - DNA, 20 bp, human
gagaccgtgtagggaacctg

SEQ ID NO: 30713 - DNA, 20 bp, human
gcggtctcctgggtcaaggt

SEQ ID NO: 30714 - DNA, 20 bp, human
gggaggccgcgcgacatggc

SEQ ID NO: 30715 - DNA, 20 bp, human
ggcgagccctaccgcagctc

SEQ ID NO: 30716 - DNA, 20 bp, human
gggttagaccctgaaagaga

SEQ ID NO: 30717 - DNA, 20 bp, human
ggcaaaggagcaagatccat

SEQ ID NO: 30718 - DNA, 20 bp, human
gaaggagcaagatccatagg

SEQ ID NO: 30719 - DNA, 20 bp, human
gtgaggcaaatccttctcag

SEQ ID NO: 30720 - DNA, 20 bp, human
gttcagggtctaaccttctg

SEQ ID NO: 30721 - DNA, 20 bp, human
gactaggaggcgatcagcaa

SEQ ID NO: 30722 - DNA, 20 bp, human
gcagtagatactgagaccca

SEQ ID NO: 30723 - DNA, 20 bp, human
gaagctgaacctaaacactt

SEQ ID NO: 30724 - DNA, 20 bp, human
gtaaacccacccaaaaagcc

SEQ ID NO: 30725 - DNA, 20 bp, human
gaaatgtcgttataaaaagg

SEQ ID NO: 30726 - DNA, 20 bp, human
ggccgaggaaggcttgcaca

SEQ ID NO: 30727 - DNA, 20 bp, human
gatacagtcattgccgagga

SEQ ID NO: 30728 - DNA, 20 bp, human
gagggactagcacagacaca

SEQ ID NO: 30729 - DNA, 20 bp, human
gcctcagaccaaactgaccc

SEQ ID NO: 30730 - DNA, 20 bp, human
gacagacacacggatgagtg

SEQ ID NO: 30731 - DNA, 20 bp, human
gaggtatacagtcattgccg

SEQ ID NO: 30732 - DNA, 20 bp, human
gaccctgtgcaagccttcct

SEQ ID NO: 30733 - DNA, 20 bp, human
gtgactgcagtgaaaggctg

SEQ ID NO: 30734 - DNA, 20 bp, human
gttgtctaccagggtcagtt

SEQ ID NO: 30735 - DNA, 20 bp, human
ggagttgtgactgcagtgaa

SEQ ID NO: 30736 - DNA, 20 bp, human
gcaaggagccttaggaggta

SEQ ID NO: 30737 - DNA, 20 bp, human
gggctcagacgcctagggag

SEQ ID NO: 30738 - DNA, 20 bp, human
ggaaataatgccaggactga

SEQ ID NO: 30739 - DNA, 20 bp, human
gtgagttctaccgtcagtcc

SEQ ID NO: 30740 - DNA, 20 bp, human
ggtgccacttaccaaataat

SEQ ID NO: 30741 - DNA, 20 bp, human
gtctctctacaaggagcctt

SEQ ID NO: 30742 - DNA, 20 bp, human
ggtggaggctcagacgccta

SEQ ID NO: 30743 - DNA, 20 bp, human
ggctcacgaaaaacagatga

SEQ ID NO: 30744 - DNA, 20 bp, human
gaaagctgcaagctgcatct

SEQ ID NO: 30745 - DNA, 20 bp, human
gagaacagctgccaattatt

SEQ ID NO: 30746 - DNA, 20 bp, human
gacttccgccgagagaacga

SEQ ID NO: 30747 - DNA, 20 bp, human
gctcgaagctcgggcgcgag

SEQ ID NO: 30748 - DNA, 20 bp, human
ggcggaagtcgctcagggtg

SEQ ID NO: 30749 - DNA, 20 bp, human
gggttctcgggcaagaggtt

SEQ ID NO: 30750 - DNA, 20 bp, human
gtcccccctcggcgccccac

SEQ ID NO: 30751 - DNA, 20 bp, human
gcgagccaagcagcgtcctg

SEQ ID NO: 30752 - DNA, 20 bp, human
ggcaggagcaaggcggtcac

SEQ ID NO: 30753 - DNA, 20 bp, human
gtctcggcggaagtcgctca

SEQ ID NO: 30754 - DNA, 20 bp, human
gaggctccgggccggccgaa

SEQ ID NO: 30755 - DNA, 20 bp, human
gagcaaggcggtcactggta

SEQ ID NO: 30756 - DNA, 20 bp, human
gcccgggagcgcagaccctt

SEQ ID NO: 30757 - DNA, 20 bp, human
gcggcgcgcgggctacccaa

SEQ ID NO: 30758 - DNA, 20 bp, human
gggaggtggcctcagtccag

SEQ ID NO: 30759 - DNA, 20 bp, human
gacccaagggtctgcgctcc

SEQ ID NO: 30760 - DNA, 20 bp, human
gcctcagtccaggggctctc

SEQ ID NO: 30761 - DNA, 20 bp, human
gtcccgggcgcgccacgatg

SEQ ID NO: 30762 - DNA, 20 bp, human
gtgtcagctgcgcggccaag

SEQ ID NO: 30763 - DNA, 20 bp, human
gggaaggttggccaggccat

SEQ ID NO: 30764 - DNA, 20 bp, human
gtgagcggggaggtgataag

SEQ ID NO: 30765 - DNA, 20 bp, human
ggtccacaggacccatggcc

SEQ ID NO: 30766 - DNA, 20 bp, human
gtggcgctggatacagatgc

SEQ ID NO: 30767 - DNA, 20 bp, human
ggggcgcgcgcagctgggac

SEQ ID NO: 30768 - DNA, 20 bp, human
gcgctggatacagatgcagg

SEQ ID NO: 30769 - DNA, 20 bp, human
ggccgggccctcttgagatg

SEQ ID NO: 30770 - DNA, 20 bp, human
ggatgcaggcggctgtaggc

SEQ ID NO: 30771 - DNA, 20 bp, human
gcgaacaggtgggccctgag

SEQ ID NO: 30772 - DNA, 20 bp, human
gcgaacgggtgcgggactgg

SEQ ID NO: 30773 - DNA, 20 bp, human
ggactggcgggacctggcgc

SEQ ID NO: 30774 - DNA, 20 bp, human
gcgacgggcgcattcgggtg

SEQ ID NO: 30775 - DNA, 20 bp, human
gtgagatgaggcgtgcggga

SEQ ID NO: 30776 - DNA, 20 bp, human
gcgggaggcgagaagcccag

SEQ ID NO: 30777 - DNA, 20 bp, human
ggcccttcagcggcagacta

SEQ ID NO: 30778 - DNA, 20 bp, human
gttgggctccagcgagagaa

SEQ ID NO: 30779 - DNA, 20 bp, human
ggtccttctctgcgccggag

SEQ ID NO: 30780 - DNA, 20 bp, human
gcagcggcagactagggtcc

SEQ ID NO: 30781 - DNA, 20 bp, human
gacgggagctgacacggagg

SEQ ID NO: 30782 - DNA, 20 bp, human
gccgggatggccacctccat

SEQ ID NO: 30783 - DNA, 20 bp, human
ggggacgggagctgacacgg

SEQ ID NO: 30784 - DNA, 20 bp, human
gagccactccggcgcagaga

SEQ ID NO: 30785 - DNA, 20 bp, human
gaccctagtctgccgctgaa

SEQ ID NO: 30786 - DNA, 20 bp, human
gatggtagccaaaacaactg

SEQ ID NO: 30787 - DNA, 20 bp, human
gacaggatctctggagtaat

SEQ ID NO: 30788 - DNA, 20 bp, human
gtccgacaagaagggacaac

SEQ ID NO: 30789 - DNA, 20 bp, human
ggatcctgttagaaaggaaa

SEQ ID NO: 30790 - DNA, 20 bp, human
gttttttagcacgaagtggg

SEQ ID NO: 30791 - DNA, 20 bp, human
ggcggcccatccgacaagaa

SEQ ID NO: 30792 - DNA, 20 bp, human
gggcgtgtgtggtagagttc

SEQ ID NO: 30793 - DNA, 20 bp, human
gggatgggccgctttagggg

SEQ ID NO: 30794 - DNA, 20 bp, human
ggggttttttagcacgaagt

SEQ ID NO: 30795 - DNA, 20 bp, human
gaaggatctctgagcgttga

SEQ ID NO: 30796 - DNA, 20 bp, human
gagacgcggcctcccatggt

SEQ ID NO: 30797 - DNA, 20 bp, human
gtgggaggccgcgtctttct

SEQ ID NO: 30798 - DNA, 20 bp, human
gtctgtggggcctgcgatag

SEQ ID NO: 30799 - DNA, 20 bp, human
gtgccggcagctccaaccat

SEQ ID NO: 30800 - DNA, 20 bp, human
gcggcagctccaaccatggg

SEQ ID NO: 30801 - DNA, 20 bp, human
gctgcctagcctgtggagac

SEQ ID NO: 30802 - DNA, 20 bp, human
gataacgcatagaaggacat

SEQ ID NO: 30803 - DNA, 20 bp, human
gttaagcacagcggctctca

SEQ ID NO: 30804 - DNA, 20 bp, human
ggtacttaccgagaaagacg

SEQ ID NO: 30805 - DNA, 20 bp, human
gtagggagcagatgccagac

SEQ ID NO: 30806 - DNA, 20 bp, human
ggagcgcgcagggacggtcc

SEQ ID NO: 30807 - DNA, 20 bp, human
gaccctgggggtagataacg

SEQ ID NO: 30808 - DNA, 20 bp, human
gtccgctcgctcacccgggg

SEQ ID NO: 30809 - DNA, 20 bp, human
ggacgcaggtccccaaaccc

SEQ ID NO: 30810 - DNA, 20 bp, human
gtaagaaggtcccctagatt

SEQ ID NO: 30811 - DNA, 20 bp, human
ggcgcgcggcctgaagacgc

SEQ ID NO: 30812 - DNA, 20 bp, human
gctgggggtagataacgggg

SEQ ID NO: 30813 - DNA, 20 bp, human
ggggagagagatctgtaaga

SEQ ID NO: 30814 - DNA, 20 bp, human
gatcggacgcacctctccca

SEQ ID NO: 30815 - DNA, 20 bp, human
ggtcccggagtgcagggcgt

SEQ ID NO: 30816 - DNA, 20 bp, human
gggacagctgttgtcaccag

SEQ ID NO: 30817 - DNA, 20 bp, human
ggcgagagcgcccgaagggg

SEQ ID NO: 30818 - DNA, 20 bp, human
ggaacgagcaggtgtaccac

SEQ ID NO: 30819 - DNA, 20 bp, human
gagcgcgagagcgcccgaag

SEQ ID NO: 30820 - DNA, 20 bp, human
gcagccaccgcaggcccgag

SEQ ID NO: 30821 - DNA, 20 bp, human
gcgctaactgtgctcctccg

SEQ ID NO: 30822 - DNA, 20 bp, human
gggtggccaaggagaaagcg

SEQ ID NO: 30823 - DNA, 20 bp, human
gggccaccatggctgggagc

SEQ ID NO: 30824 - DNA, 20 bp, human
ggggtcgctctgcgcatgag

SEQ ID NO: 30825 - DNA, 20 bp, human
gagcgacccctgggcccaca

SEQ ID NO: 30826 - DNA, 20 bp, human
gcacaggaaagtgactgtag

SEQ ID NO: 30827 - DNA, 20 bp, human
ggctgcagggacacacccaa

SEQ ID NO: 30828 - DNA, 20 bp, human
gtgggccatgttggtacccc

SEQ ID NO: 30829 - DNA, 20 bp, human
gcccagaccgcgctcaaatg

SEQ ID NO: 30830 - DNA, 20 bp, human
gaaggtgccagacatatccg

SEQ ID NO: 30831 - DNA, 20 bp, human
gcaaatgtggcttaaatcca

SEQ ID NO: 30832 - DNA, 20 bp, human
gacattccagcggagactgg

SEQ ID NO: 30833 - DNA, 20 bp, human
gcagggacacacccaagggg

SEQ ID NO: 30834 - DNA, 20 bp, human
gcagcgggaaacaggagctc

SEQ ID NO: 30835 - DNA, 20 bp, human
gcaggagctccggccagcct

SEQ ID NO: 30836 - DNA, 20 bp, human
gtcaatgacgggagacgcac

SEQ ID NO: 30837 - DNA, 20 bp, human
gagagcgaaaggtagggtgg

SEQ ID NO: 30838 - DNA, 20 bp, human
gacgcacagggcagagcgaa

SEQ ID NO: 30839 - DNA, 20 bp, human
gcagggcagagcgaaaggta

SEQ ID NO: 30840 - DNA, 20 bp, human
gggcagagcgaaaggtaggg

SEQ ID NO: 30841 - DNA, 20 bp, human
ggccgagatcatgtctgact

SEQ ID NO: 30842 - DNA, 20 bp, human
ggttgctgagaggaggcgag

SEQ ID NO: 30843 - DNA, 20 bp, human
gcctcctctcagcaactgta

SEQ ID NO: 30844 - DNA, 20 bp, human
gcccagactggcagcatgac

SEQ ID NO: 30845 - DNA, 20 bp, human
gagcatgaccggtgagtgtc

SEQ ID NO: 30846 - DNA, 20 bp, human
gccacccgaggcgcgcccta

SEQ ID NO: 30847 - DNA, 20 bp, human
gcgctctggggcgactgcgc

SEQ ID NO: 30848 - DNA, 20 bp, human
gcagagcgccccgaccggga

SEQ ID NO: 30849 - DNA, 20 bp, human
gctgctgcgagaagaggtgt

SEQ ID NO: 30850 - DNA, 20 bp, human
ggtcggtcgcagccgtcgtg

SEQ ID NO: 30851 - DNA, 20 bp, human
gcgcagcagcgactccaaaa

SEQ ID NO: 30852 - DNA, 20 bp, human
ggggcccctgcgggaggacg

SEQ ID NO: 30853 - DNA, 20 bp, human
gagcgccccgaccgggatgg

SEQ ID NO: 30854 - DNA, 20 bp, human
ggccccagagcgccccgacc

SEQ ID NO: 30855 - DNA, 20 bp, human
gggccgagtgcactccaact

SEQ ID NO: 30856 - DNA, 20 bp, human
gggcgcccagagttccggga

SEQ ID NO: 30857 - DNA, 20 bp, human
gtcggaggcgggaggaatag

SEQ ID NO: 30858 - DNA, 20 bp, human
gcgggtaccacgcggagaac

SEQ ID NO: 30859 - DNA, 20 bp, human
ggaagcggaggagaatcccg

SEQ ID NO: 30860 - DNA, 20 bp, human
gggccttctagcgactgcat

SEQ ID NO: 30861 - DNA, 20 bp, human
gcagagttccgggagggtgc

SEQ ID NO: 30862 - DNA, 20 bp, human
gtaattctccgagtgcactt

SEQ ID NO: 30863 - DNA, 20 bp, human
gaccccagaggatggagatt

SEQ ID NO: 30864 - DNA, 20 bp, human
gttctagcgactgcatggga

SEQ ID NO: 30865 - DNA, 20 bp, human
gagctcggcgggcacttccg

SEQ ID NO: 30866 - DNA, 20 bp, human
ggcgcccgtggctactcgag

SEQ ID NO: 30867 - DNA, 20 bp, human
gggaggacttcagtgcccgc

SEQ ID NO: 30868 - DNA, 20 bp, human
gtactcgagcggcagccggg

SEQ ID NO: 30869 - DNA, 20 bp, human
gaagagtaactgctgaaagg

SEQ ID NO: 30870 - DNA, 20 bp, human
ggacttcagtgcccgcgggc

SEQ ID NO: 30871 - DNA, 20 bp, human
gtgaagtcactcgcccccgg

SEQ ID NO: 30872 - DNA, 20 bp, human
gagtaactgctgaaaggagg

SEQ ID NO: 30873 - DNA, 20 bp, human
gctgccgctcgagtagccac

SEQ ID NO: 30874 - DNA, 20 bp, human
gaggaagagtaactgctgaa

SEQ ID NO: 30875 - DNA, 20 bp, human
ggagtcaggggaactaatcg

SEQ ID NO: 30876 - DNA, 20 bp, human
gggagccaggctcctaaagg

SEQ ID NO: 30877 - DNA, 20 bp, human
gaggccccgggcagcccggt

SEQ ID NO: 30878 - DNA, 20 bp, human
gccacgcagctagaaactcg

SEQ ID NO: 30879 - DNA, 20 bp, human
gccccaggagggctgttccg

SEQ ID NO: 30880 - DNA, 20 bp, human
ggccggggcacagcaggacg

SEQ ID NO: 30881 - DNA, 20 bp, human
ggcggccggggcgtttaagg

SEQ ID NO: 30882 - DNA, 20 bp, human
ggcggtcgcgcaggagccgg

SEQ ID NO: 30883 - DNA, 20 bp, human
ggcgcgcggagggccccgga

SEQ ID NO: 30884 - DNA, 20 bp, human
ggggcacgcacggttacccc

SEQ ID NO: 30885 - DNA, 20 bp, human
gtcaggagccaggctcctaa

SEQ ID NO: 30886 - DNA, 20 bp, human
gagccgctctaggttcatgg

SEQ ID NO: 30887 - DNA, 20 bp, human
ggtccggcagtacctcgacc

SEQ ID NO: 30888 - DNA, 20 bp, human
gccgcgccaggtgcagaacg

SEQ ID NO: 30889 - DNA, 20 bp, human
gcggccttcgagtcctgggg

SEQ ID NO: 30890 - DNA, 20 bp, human
gcgaggctcagacccgactg

SEQ ID NO: 30891 - DNA, 20 bp, human
gggcagtacctcgaccaggt

SEQ ID NO: 30892 - DNA, 20 bp, human
gtcgaaggccgcggactcga

SEQ ID NO: 30893 - DNA, 20 bp, human
gcctgcggccttcgagtccg

SEQ ID NO: 30894 - DNA, 20 bp, human
ggtctccgcctcgcccagaa

SEQ ID NO: 30895 - DNA, 20 bp, human
gcgcacggggcgcctcagtc

SEQ ID NO: 30896 - DNA, 20 bp, human
gccggtcggaactgctccgg

SEQ ID NO: 30897 - DNA, 20 bp, human
gcctggaggaaaggaggcga

SEQ ID NO: 30898 - DNA, 20 bp, human
gcggagggcacggtgagagg

SEQ ID NO: 30899 - DNA, 20 bp, human
gctccggagggcacggtgag

SEQ ID NO: 30900 - DNA, 20 bp, human
gcaggcgtgttaaagccggt

SEQ ID NO: 30901 - DNA, 20 bp, human
gctggtcagtgaggtgccaa

SEQ ID NO: 30902 - DNA, 20 bp, human
gaagccggtcggaactgctc

SEQ ID NO: 30903 - DNA, 20 bp, human
ggccgaactcctggtcagtg

SEQ ID NO: 30904 - DNA, 20 bp, human
gagccaataggcgctcggag

SEQ ID NO: 30905 - DNA, 20 bp, human
gtgctctcactcagttcctt

SEQ ID NO: 30906 - DNA, 20 bp, human
gcctggggaacaccttgcag

SEQ ID NO: 30907 - DNA, 20 bp, human
gctgggggacgggactccag

SEQ ID NO: 30908 - DNA, 20 bp, human
ggcgcctcggagggtccgca

SEQ ID NO: 30909 - DNA, 20 bp, human
gcttccgtgcggaccctccg

SEQ ID NO: 30910 - DNA, 20 bp, human
gaacaccttgcagcggcggt

SEQ ID NO: 30911 - DNA, 20 bp, human
gggtacgaaactctaagccc

SEQ ID NO: 30912 - DNA, 20 bp, human
ggtgaaatagaatggtcctg

SEQ ID NO: 30913 - DNA, 20 bp, human
gagaggccaaacgccaggca

SEQ ID NO: 30914 - DNA, 20 bp, human
gggggaacaccttgcagcgg

SEQ ID NO: 30915 - DNA, 20 bp, human
gagcagagaggccaaacgcc

SEQ ID NO: 30916 - DNA, 20 bp, human
gggccactccagccaatcat

SEQ ID NO: 30917 - DNA, 20 bp, human
gtgttccaggtcggcggagt

SEQ ID NO: 30918 - DNA, 20 bp, human
gacagccaccgggaccatgg

SEQ ID NO: 30919 - DNA, 20 bp, human
gccagtgacagggcactcag

SEQ ID NO: 30920 - DNA, 20 bp, human
gagtacctccatggtcccgg

SEQ ID NO: 30921 - DNA, 20 bp, human
ggcgctccccatcaacccag

SEQ ID NO: 30922 - DNA, 20 bp, human
ggtggcccgagtcgggaaaa

SEQ ID NO: 30923 - DNA, 20 bp, human
gatggctgcgagtacctcca

SEQ ID NO: 30924 - DNA, 20 bp, human
ggcgagtacctccatggtcc

SEQ ID NO: 30925 - DNA, 20 bp, human
gctgccgccgtcacagccac

SEQ ID NO: 30926 - DNA, 20 bp, human
gctgggtaagaggtgtaggt

SEQ ID NO: 30927 - DNA, 20 bp, human
gctgcgacagcctgggtaag

SEQ ID NO: 30928 - DNA, 20 bp, human
gggccgtcgggaccttccag

SEQ ID NO: 30929 - DNA, 20 bp, human
gggcgccagccaccagccac

SEQ ID NO: 30930 - DNA, 20 bp, human
gcggcctttcgcggtaatag

SEQ ID NO: 30931 - DNA, 20 bp, human
ggcgcggccgaggccggtgt

SEQ ID NO: 30932 - DNA, 20 bp, human
gagggagcgggagctctgcg

SEQ ID NO: 30933 - DNA, 20 bp, human
gcggtaatagcggctcagtg

SEQ ID NO: 30934 - DNA, 20 bp, human
gcggagctgggcaagcgggt

SEQ ID NO: 30935 - DNA, 20 bp, human
gtgggcaggtaaggagagac

SEQ ID NO: 30936 - DNA, 20 bp, human
gccaggcgcgagggaggaga

SEQ ID NO: 30937 - DNA, 20 bp, human
gcgggctcaggcaccagcca

SEQ ID NO: 30938 - DNA, 20 bp, human
gcggcaggtaggacacccca

SEQ ID NO: 30939 - DNA, 20 bp, human
gctgcaactagaggcttccc

SEQ ID NO: 30940 - DNA, 20 bp, human
gaagtggcagctgcaactag

SEQ ID NO: 30941 - DNA, 20 bp, human
gccaaggaggctgcatatgg

SEQ ID NO: 30942 - DNA, 20 bp, human
gcaggtaggacaccccaagg

SEQ ID NO: 30943 - DNA, 20 bp, human
gtggagctccacactcccaa

SEQ ID NO: 30944 - DNA, 20 bp, human
ggcctccgcaggaccccccg

SEQ ID NO: 30945 - DNA, 20 bp, human
gtcacctgggatcaccgcta

SEQ ID NO: 30946 - DNA, 20 bp, human
gcgactgggtaggccaacgt

SEQ ID NO: 30947 - DNA, 20 bp, human
ggagcagaaggccaaagtta

SEQ ID NO: 30948 - DNA, 20 bp, human
gtgctcagaggccgtaactt

SEQ ID NO: 30949 - DNA, 20 bp, human
ggcagctctgccttccgact

SEQ ID NO: 30950 - DNA, 20 bp, human
gaccgacgagaggcaacctt

SEQ ID NO: 30951 - DNA, 20 bp, human
ggaagaggggcaaccccgaa

SEQ ID NO: 30952 - DNA, 20 bp, human
gtcctaaggttgcctctcgt

SEQ ID NO: 30953 - DNA, 20 bp, human
gacctgaattcaccgacgag

SEQ ID NO: 30954 - DNA, 20 bp, human
gcgtctccgccacggaatca

SEQ ID NO: 30955 - DNA, 20 bp, human
gctctgccttccgactgggt

SEQ ID NO: 30956 - DNA, 20 bp, human
gggggtcaccgcccccggag

SEQ ID NO: 30957 - DNA, 20 bp, human
ggtaggtgagtcgactcgcg

SEQ ID NO: 30958 - DNA, 20 bp, human
ggagccatcaagctcagagg

SEQ ID NO: 30959 - DNA, 20 bp, human
ggccgagccatcaagctcag

SEQ ID NO: 30960 - DNA, 20 bp, human
gggtacaggcctggagctag

SEQ ID NO: 30961 - DNA, 20 bp, human
gggccggcttgaaaagaggt

SEQ ID NO: 30962 - DNA, 20 bp, human
gatggcgtcgtggcattgag

SEQ ID NO: 30963 - DNA, 20 bp, human
ggaagacttccggaccatgg

SEQ ID NO: 30964 - DNA, 20 bp, human
gtacctcggagcccaggcaa

SEQ ID NO: 30965 - DNA, 20 bp, human
ggcatgatggaagtcgtagt

SEQ ID NO: 30966 - DNA, 20 bp, human
ggccactccgcggcctggtg

SEQ ID NO: 30967 - DNA, 20 bp, human
gacgttggctcggacgggaa

SEQ ID NO: 30968 - DNA, 20 bp, human
ggcagcgtagggccactccg

SEQ ID NO: 30969 - DNA, 20 bp, human
ggtcgggaagcagcagcgta

SEQ ID NO: 30970 - DNA, 20 bp, human
gcctcaggccccccctgtag

SEQ ID NO: 30971 - DNA, 20 bp, human
gctccgaactgactaaagat

SEQ ID NO: 30972 - DNA, 20 bp, human
gcaccagcgaccgttaccgg

SEQ ID NO: 30973 - DNA, 20 bp, human
gctcccccatcccccggtaa

SEQ ID NO: 30974 - DNA, 20 bp, human
gggccggagccgctacaggg

SEQ ID NO: 30975 - DNA, 20 bp, human
ggaccgttaccgggggatgg

SEQ ID NO: 30976 - DNA, 20 bp, human
gtggagcgctcggggtcccc

SEQ ID NO: 30977 - DNA, 20 bp, human
gggagcccacgagcgacctc

SEQ ID NO: 30978 - DNA, 20 bp, human
ggccaaggcaagcgccggtg

SEQ ID NO: 30979 - DNA, 20 bp, human
gcaacagcgctaggaccgcg

SEQ ID NO: 30980 - DNA, 20 bp, human
gcagagctgctggagcgctc

SEQ ID NO: 30981 - DNA, 20 bp, human
gtctgcgagctgggcactag

SEQ ID NO: 30982 - DNA, 20 bp, human
ggctgctgctggagctcaag

SEQ ID NO: 30983 - DNA, 20 bp, human
gggcgcccgaggtcgctcgt

SEQ ID NO: 30984 - DNA, 20 bp, human
gccaacacctactacgaggg

SEQ ID NO: 30985 - DNA, 20 bp, human
ggaaccagctccctgccccg

SEQ ID NO: 30986 - DNA, 20 bp, human
ggcgcccatcccatccacgg

SEQ ID NO: 30987 - DNA, 20 bp, human
ggaagccatgagcatcaagg

SEQ ID NO: 30988 - DNA, 20 bp, human
gctctgtggtagggtgagag

SEQ ID NO: 30989 - DNA, 20 bp, human
ggcacccaatgcctggtcag

SEQ ID NO: 30990 - DNA, 20 bp, human
gatcaaggtggcgggagcgt

SEQ ID NO: 30991 - DNA, 20 bp, human
gatcagaggaggggaccggt

SEQ ID NO: 30992 - DNA, 20 bp, human
gcaccacctccgccgtggat

SEQ ID NO: 30993 - DNA, 20 bp, human
gcccatcccatccacggcgg

SEQ ID NO: 30994 - DNA, 20 bp, human
gatcccatccacggcggagg

SEQ ID NO: 30995 - DNA, 20 bp, human
ggtggtgtagttgaagagtg

SEQ ID NO: 30996 - DNA, 20 bp, human
gcggcgtcgcggccagtaga

SEQ ID NO: 30997 - DNA, 20 bp, human
gcggccagtagagggattct

SEQ ID NO: 30998 - DNA, 20 bp, human
gcgggtgtgcagcggcgtcg

SEQ ID NO: 30999 - DNA, 20 bp, human
ggtgaggtgggcgtagaaaa

SEQ ID NO: 31000 - DNA, 20 bp, human
gggacggcggaagaaatagt

SEQ ID NO: 31001 - DNA, 20 bp, human
gcatcttcggagggcagacg

SEQ ID NO: 31002 - DNA, 20 bp, human
gacagcctgggcctcgccac

SEQ ID NO: 31003 - DNA, 20 bp, human
ggcggcgcccaggtgagaag

SEQ ID NO: 31004 - DNA, 20 bp, human
ggtagagggattctgggtaa

SEQ ID NO: 31005 - DNA, 20 bp, human
ggggagacgcggcattccag

SEQ ID NO: 31006 - DNA, 20 bp, human
gtaacccggtacctaacaag

SEQ ID NO: 31007 - DNA, 20 bp, human
gttaccttaactgccacctc

SEQ ID NO: 31008 - DNA, 20 bp, human
ggaccctgaacccgaaccat

SEQ ID NO: 31009 - DNA, 20 bp, human
gttctgatggcgggaggcaa

SEQ ID NO: 31010 - DNA, 20 bp, human
gcagctctggccgcttccta

SEQ ID NO: 31011 - DNA, 20 bp, human
gttctgcggagaccctgcca

SEQ ID NO: 31012 - DNA, 20 bp, human
ggcaatcgcagccgacatga

SEQ ID NO: 31013 - DNA, 20 bp, human
ggaacccgaaccataggaag

SEQ ID NO: 31014 - DNA, 20 bp, human
gaagggcagagagcatcgga

SEQ ID NO: 31015 - DNA, 20 bp, human
gccacatgcatcctcgggag

SEQ ID NO: 31016 - DNA, 20 bp, human
gtagggtggcagctcccgcg

SEQ ID NO: 31017 - DNA, 20 bp, human
gagctcccgcggggaacctc

SEQ ID NO: 31018 - DNA, 20 bp, human
gcggcccggcgggctcctaa

SEQ ID NO: 31019 - DNA, 20 bp, human
gcccggcgggctcctaaggg

SEQ ID NO: 31020 - DNA, 20 bp, human
gagtgctgccaacgccccgg

SEQ ID NO: 31021 - DNA, 20 bp, human
gtcgcgctgcgtcctccggg

SEQ ID NO: 31022 - DNA, 20 bp, human
gcgcagtgctgccaacgccc

SEQ ID NO: 31023 - DNA, 20 bp, human
gctcctcggctgccggacag

SEQ ID NO: 31024 - DNA, 20 bp, human
ggagcccgggcgcccaggat

SEQ ID NO: 31025 - DNA, 20 bp, human
gagcgggaccgggctgtcac

SEQ ID NO: 31026 - DNA, 20 bp, human
gccgcggctgaggagactag

SEQ ID NO: 31027 - DNA, 20 bp, human
gctctgtgcggcgggactgg

SEQ ID NO: 31028 - DNA, 20 bp, human
ggcaagcctccgcctctgtg

SEQ ID NO: 31029 - DNA, 20 bp, human
gccacgagcgaccaccgaca

SEQ ID NO: 31030 - DNA, 20 bp, human
ggcgcgagcgcgagaggaga

SEQ ID NO: 31031 - DNA, 20 bp, human
gcgagcccactccatgtcgg

SEQ ID NO: 31032 - DNA, 20 bp, human
ggacgagtctggatccaata

SEQ ID NO: 31033 - DNA, 20 bp, human
gcgcctctgtgcggcgggac

SEQ ID NO: 31034 - DNA, 20 bp, human
gggaggcttgcggacgagtc

SEQ ID NO: 31035 - DNA, 20 bp, human
gtcctcccggcttcacccta

SEQ ID NO: 31036 - DNA, 20 bp, human
gcgccgccgcagactaggag

SEQ ID NO: 31037 - DNA, 20 bp, human
gcctcgccgctcctagtctg

SEQ ID NO: 31038 - DNA, 20 bp, human
gcaccatgtcggccaaggtg

SEQ ID NO: 31039 - DNA, 20 bp, human
gcccgacggcgcagagtctg

SEQ ID NO: 31040 - DNA, 20 bp, human
gcgccgctcctagtctgcgg

SEQ ID NO: 31041 - DNA, 20 bp, human
ggtggctgcactcggtgtac

SEQ ID NO: 31042 - DNA, 20 bp, human
gcggcctaggccgacatctt

SEQ ID NO: 31043 - DNA, 20 bp, human
ggttgcgccagggcccgtcc

SEQ ID NO: 31044 - DNA, 20 bp, human
gagccgcaccttggccgaca

SEQ ID NO: 31045 - DNA, 20 bp, human
ggcagccgccgagcccccga

SEQ ID NO: 31046 - DNA, 20 bp, human
ggacagagcctcagacggtt

SEQ ID NO: 31047 - DNA, 20 bp, human
gtcgctgctcggctacagtc

SEQ ID NO: 31048 - DNA, 20 bp, human
ggcgcggacagagcctcaga

SEQ ID NO: 31049 - DNA, 20 bp, human
gtccggccgcagccatggag

SEQ ID NO: 31050 - DNA, 20 bp, human
gggtccggtggtacgcgtca

SEQ ID NO: 31051 - DNA, 20 bp, human
gcagcagcggccccctacgg

SEQ ID NO: 31052 - DNA, 20 bp, human
ggacggacggcccgacaggc

SEQ ID NO: 31053 - DNA, 20 bp, human
gtgtgtcggggtctgtgaga

SEQ ID NO: 31054 - DNA, 20 bp, human
gctgcgagggaagcccgtgg

SEQ ID NO: 31055 - DNA, 20 bp, human
gtggccctgacgcgtaccac

SEQ ID NO: 31056 - DNA, 20 bp, human
gcggccccgggagcctagta

SEQ ID NO: 31057 - DNA, 20 bp, human
ggactcgtcgtctgcagcgg

SEQ ID NO: 31058 - DNA, 20 bp, human
ggcggactcgtcgtctgcag

SEQ ID NO: 31059 - DNA, 20 bp, human
gctctccgcgtgggcctcgg

SEQ ID NO: 31060 - DNA, 20 bp, human
gccttcctgtgggcacccgg

SEQ ID NO: 31061 - DNA, 20 bp, human
ggcagcccgggagagtcgct

SEQ ID NO: 31062 - DNA, 20 bp, human
ggccaaaatgcgcgaggagg

SEQ ID NO: 31063 - DNA, 20 bp, human
ggggcgggcagcgggcgacg

SEQ ID NO: 31064 - DNA, 20 bp, human
ggcgcgcccgggctgttacc

SEQ ID NO: 31065 - DNA, 20 bp, human
gtagggtgcagagtccccgc

SEQ ID NO: 31066 - DNA, 20 bp, human
gaggcgcgcagacggcagac

SEQ ID NO: 31067 - DNA, 20 bp, human
gcgcgcagacggcagaccgg

SEQ ID NO: 31068 - DNA, 20 bp, human
gccagcccgaactcaccgtg

SEQ ID NO: 31069 - DNA, 20 bp, human
gcggcggacagcaaggtctc

SEQ ID NO: 31070 - DNA, 20 bp, human
gtaggagaacaactcactat

SEQ ID NO: 31071 - DNA, 20 bp, human
gcgggaacccagatgcgggt

SEQ ID NO: 31072 - DNA, 20 bp, human
gggccgcgaatgtcctgaaa

SEQ ID NO: 31073 - DNA, 20 bp, human
gggcagaccggcggacagca

SEQ ID NO: 31074 - DNA, 20 bp, human
gcgcggcggccggacccgac

SEQ ID NO: 31075 - DNA, 20 bp, human
gggcccggacacaaaatgga

SEQ ID NO: 31076 - DNA, 20 bp, human
gcagcggctgggatcctcag

SEQ ID NO: 31077 - DNA, 20 bp, human
gaagccaggagggggtccgg

SEQ ID NO: 31078 - DNA, 20 bp, human
gcagggagtcgggataccca

SEQ ID NO: 31079 - DNA, 20 bp, human
ggtagagaggaaggagccct

SEQ ID NO: 31080 - DNA, 20 bp, human
gccccaccctgaaaagtagt

SEQ ID NO: 31081 - DNA, 20 bp, human
gcataaagcaagccaggagg

SEQ ID NO: 31082 - DNA, 20 bp, human
ggactcacagacaggtagag

SEQ ID NO: 31083 - DNA, 20 bp, human
gtagctcggagggtgcaatg

SEQ ID NO: 31084 - DNA, 20 bp, human
gaagtagtgggcacaaatgg

SEQ ID NO: 31085 - DNA, 20 bp, human
gagtgtccaacggaacgaag

SEQ ID NO: 31086 - DNA, 20 bp, human
gcggcccccaaccccctcag

SEQ ID NO: 31087 - DNA, 20 bp, human
ggccgcgcggagcccacgaa

SEQ ID NO: 31088 - DNA, 20 bp, human
gcaaacgccggcgctgacag

SEQ ID NO: 31089 - DNA, 20 bp, human
ggccagagggaaacaaacgc

SEQ ID NO: 31090 - DNA, 20 bp, human
ggctgcgctgtccccttcgt

SEQ ID NO: 31091 - DNA, 20 bp, human
gaggcggctaccacagacag

SEQ ID NO: 31092 - DNA, 20 bp, human
ggcaggagcgcagcaatcgg

SEQ ID NO: 31093 - DNA, 20 bp, human
gcgcgagcgccgagaagtgg

SEQ ID NO: 31094 - DNA, 20 bp, human
gaactcccggccctggccaa

SEQ ID NO: 31095 - DNA, 20 bp, human
gagggccgggagttccagcg

SEQ ID NO: 31096 - DNA, 20 bp, human
ggaaaagctgaggcccctct

SEQ ID NO: 31097 - DNA, 20 bp, human
ggcccccacactccgcccag

SEQ ID NO: 31098 - DNA, 20 bp, human
gtagctcccggtgcaggtaa

SEQ ID NO: 31099 - DNA, 20 bp, human
gttatgccagggcttgccag

SEQ ID NO: 31100 - DNA, 20 bp, human
ggcccctctgggcggagtgt

SEQ ID NO: 31101 - DNA, 20 bp, human
ggccaggactaagtgtgcag

SEQ ID NO: 31102 - DNA, 20 bp, human
gaagtgtcagcccctctcgg

SEQ ID NO: 31103 - DNA, 20 bp, human
ggtttgcctctaggagttaa

SEQ ID NO: 31104 - DNA, 20 bp, human
gctagtcctttaactcctag

SEQ ID NO: 31105 - DNA, 20 bp, human
gccccctgcacacttagtcc

SEQ ID NO: 31106 - DNA, 20 bp, human
ggctccgtggccgccagtgt

SEQ ID NO: 31107 - DNA, 20 bp, human
gtagctctgcggcgaggtgg

SEQ ID NO: 31108 - DNA, 20 bp, human
gctcgccgcagagctagccc

SEQ ID NO: 31109 - DNA, 20 bp, human
gcccgggaagcccacactgg

SEQ ID NO: 31110 - DNA, 20 bp, human
ggcttcccgggctagctctg

SEQ ID NO: 31111 - DNA, 20 bp, human
ggtacgagccggcagaggtg

SEQ ID NO: 31112 - DNA, 20 bp, human
gaagcccacactggcggcca

SEQ ID NO: 31113 - DNA, 20 bp, human
ggggggagccgagtacgagc

SEQ ID NO: 31114 - DNA, 20 bp, human
gtagtggggggagacagata

SEQ ID NO: 31115 - DNA, 20 bp, human
gcgttcagctacagctggtg

SEQ ID NO: 31116 - DNA, 20 bp, human
gcacggcaggcggacagctg

SEQ ID NO: 31117 - DNA, 20 bp, human
gtcacgtctggaagtcggga

SEQ ID NO: 31118 - DNA, 20 bp, human
gccagacgtgaaaagttggg

SEQ ID NO: 31119 - DNA, 20 bp, human
gcgcctgatgtaaaatggaa

SEQ ID NO: 31120 - DNA, 20 bp, human
gcccgcccaagggaccgaga

SEQ ID NO: 31121 - DNA, 20 bp, human
ggcggctgagacaaaggcga

SEQ ID NO: 31122 - DNA, 20 bp, human
gcgcggagccggcgctgaga

SEQ ID NO: 31123 - DNA, 20 bp, human
gcgtctggaagtcgggaggg

SEQ ID NO: 31124 - DNA, 20 bp, human
ggagcgcagctgcaggcgtt

SEQ ID NO: 31125 - DNA, 20 bp, human
ggcgtgtaaccattcctcag

SEQ ID NO: 31126 - DNA, 20 bp, human
ggacacgaacatagccacgg

SEQ ID NO: 31127 - DNA, 20 bp, human
gtcggacacgaacatagcca

SEQ ID NO: 31128 - DNA, 20 bp, human
gcagccatcgaggactcggg

SEQ ID NO: 31129 - DNA, 20 bp, human
gtcctcgatggctgaagcag

SEQ ID NO: 31130 - DNA, 20 bp, human
ggttccgcccgagtcctcga

SEQ ID NO: 31131 - DNA, 20 bp, human
gagagaaggaccctctatcg

SEQ ID NO: 31132 - DNA, 20 bp, human
gacgcctggcgctcgcgctg

SEQ ID NO: 31133 - DNA, 20 bp, human
gtgatccctggaccaatcgg

SEQ ID NO: 31134 - DNA, 20 bp, human
gctatcggggaagagcagac

SEQ ID NO: 31135 - DNA, 20 bp, human
ggcagggcgggcagagtgtc

SEQ ID NO: 31136 - DNA, 20 bp, human
gtaaggcgctttggccagag

SEQ ID NO: 31137 - DNA, 20 bp, human
ggtaacagcgattgggccac

SEQ ID NO: 31138 - DNA, 20 bp, human
gaggtcgcgcttggaggaag

SEQ ID NO: 31139 - DNA, 20 bp, human
gagaagtagtaacagcgatt

SEQ ID NO: 31140 - DNA, 20 bp, human
gggctctcgcgagatagcgg

SEQ ID NO: 31141 - DNA, 20 bp, human
gacgcgcgcggaggtcgggg

SEQ ID NO: 31142 - DNA, 20 bp, human
gggcgacgaggagaccctgt

SEQ ID NO: 31143 - DNA, 20 bp, human
gtgccccgggggaccaactc

SEQ ID NO: 31144 - DNA, 20 bp, human
gtgcgagcgccagtaggaca

SEQ ID NO: 31145 - DNA, 20 bp, human
gggaccgtgatgtcaccacc

SEQ ID NO: 31146 - DNA, 20 bp, human
gggccacgaccactgaacgg

SEQ ID NO: 31147 - DNA, 20 bp, human
gaagacgcgcgattgcggca

SEQ ID NO: 31148 - DNA, 20 bp, human
gccctgaacaaactgcacag

SEQ ID NO: 31149 - DNA, 20 bp, human
ggaaggatcctgcactgagg

SEQ ID NO: 31150 - DNA, 20 bp, human
gtgaggactgagtgcagggg

SEQ ID NO: 31151 - DNA, 20 bp, human
gtgagaaggatcctgcactg

SEQ ID NO: 31152 - DNA, 20 bp, human
gtctctcacacgcagcctct

SEQ ID NO: 31153 - DNA, 20 bp, human
gtgagctcgctggaggtctg

SEQ ID NO: 31154 - DNA, 20 bp, human
gactgctagaactaccccga

SEQ ID NO: 31155 - DNA, 20 bp, human
ggcgggaggtgggaacgctg

SEQ ID NO: 31156 - DNA, 20 bp, human
gtctctggcccgagggaagc

SEQ ID NO: 31157 - DNA, 20 bp, human
ggagggatccgaaggggggc

SEQ ID NO: 31158 - DNA, 20 bp, human
gtaagggagtacgacttctg

SEQ ID NO: 31159 - DNA, 20 bp, human
gcctggccacgagtactggg

SEQ ID NO: 31160 - DNA, 20 bp, human
gcgcatccgatcgactcggt

SEQ ID NO: 31161 - DNA, 20 bp, human
gtccgatcgactcggtaggt

SEQ ID NO: 31162 - DNA, 20 bp, human
gtgtggctccccagatgcct

SEQ ID NO: 31163 - DNA, 20 bp, human
ggaccctggccacgagtact

SEQ ID NO: 31164 - DNA, 20 bp, human
ggtcggagggatccgaaggg

SEQ ID NO: 31165 - DNA, 20 bp, human
ggcgccaggaggctcgtcca

SEQ ID NO: 31166 - DNA, 20 bp, human
gccgaggaccccgcgctgta

SEQ ID NO: 31167 - DNA, 20 bp, human
gggccttgccttacagcgcg

SEQ ID NO: 31168 - DNA, 20 bp, human
gtcgcctacgacagcagcag

SEQ ID NO: 31169 - DNA, 20 bp, human
ggcgaggcgacaagagaaga

SEQ ID NO: 31170 - DNA, 20 bp, human
gtaagaaagaggtcgcctgg

SEQ ID NO: 31171 - DNA, 20 bp, human
gccatccccaggggaaacgg

SEQ ID NO: 31172 - DNA, 20 bp, human
gccgagccggcggaggcgag

SEQ ID NO: 31173 - DNA, 20 bp, human
gctgctgtcgtaggcgagga

SEQ ID NO: 31174 - DNA, 20 bp, human
gcccaaaggaaaggtaccgt

SEQ ID NO: 31175 - DNA, 20 bp, human
gggcagagttgggcgccccc

SEQ ID NO: 31176 - DNA, 20 bp, human
gggtcagccgtcgggacctc

SEQ ID NO: 31177 - DNA, 20 bp, human
gtagagctgcgtcttgagag

SEQ ID NO: 31178 - DNA, 20 bp, human
ggcgaaaacctgaatcataa

SEQ ID NO: 31179 - DNA, 20 bp, human
ggcaccaaagcagaccccaa

SEQ ID NO: 31180 - DNA, 20 bp, human
gcgcaggccaggatcagcgc

SEQ ID NO: 31181 - DNA, 20 bp, human
ggtgagtccaggtcagccgt

SEQ ID NO: 31182 - DNA, 20 bp, human
ggggctccgggttcgaagag

SEQ ID NO: 31183 - DNA, 20 bp, human
gcaggtgcggcgtgagaggt

SEQ ID NO: 31184 - DNA, 20 bp, human
ggaccccaaaggataagcca

SEQ ID NO: 31185 - DNA, 20 bp, human
gcgctacggttgaaaagcca

SEQ ID NO: 31186 - DNA, 20 bp, human
gccttaggagcgcttctcat

SEQ ID NO: 31187 - DNA, 20 bp, human
gggcgcatgcccctaacgag

SEQ ID NO: 31188 - DNA, 20 bp, human
gcgagctgttgtgcatccag

SEQ ID NO: 31189 - DNA, 20 bp, human
ggcacgtagagcagctaggt

SEQ ID NO: 31190 - DNA, 20 bp, human
gtccgacgtggaagagataa

SEQ ID NO: 31191 - DNA, 20 bp, human
gcgggccccaattccacctc

SEQ ID NO: 31192 - DNA, 20 bp, human
gtggcccagagtacctggat

SEQ ID NO: 31193 - DNA, 20 bp, human
ggctgttgtgcatccagagg

SEQ ID NO: 31194 - DNA, 20 bp, human
gagtgaggcggagcttgagg

SEQ ID NO: 31195 - DNA, 20 bp, human
gacgtgcgctcccgccctgg

SEQ ID NO: 31196 - DNA, 20 bp, human
gcagccgggccctcgtgaag

SEQ ID NO: 31197 - DNA, 20 bp, human
gtccgctgcaactagagccg

SEQ ID NO: 31198 - DNA, 20 bp, human
gcgcgggagccgcttcacga

SEQ ID NO: 31199 - DNA, 20 bp, human
ggcgcccgggaccaccgctg

SEQ ID NO: 31200 - DNA, 20 bp, human
gacctcggctctagttgcag

SEQ ID NO: 31201 - DNA, 20 bp, human
gccgcaaggaacgcagacgg

SEQ ID NO: 31202 - DNA, 20 bp, human
ggcaactagagccgaggtac

SEQ ID NO: 31203 - DNA, 20 bp, human
gacatccgcggccctctccg

SEQ ID NO: 31204 - DNA, 20 bp, human
gcggccgggctccgacagag

SEQ ID NO: 31205 - DNA, 20 bp, human
ggtgaagcggctcccgcgtg

SEQ ID NO: 31206 - DNA, 20 bp, human
gtccgctgggacctccgcag

SEQ ID NO: 31207 - DNA, 20 bp, human
ggggcgcgcgccaaccggga

SEQ ID NO: 31208 - DNA, 20 bp, human
gggaggtcccagcggaaatc

SEQ ID NO: 31209 - DNA, 20 bp, human
ggccgcacccggaagagacg

SEQ ID NO: 31210 - DNA, 20 bp, human
gactggggtctgtagagaag

SEQ ID NO: 31211 - DNA, 20 bp, human
gccccgggcgcgcgccaacc

SEQ ID NO: 31212 - DNA, 20 bp, human
gagcgagtggccttcccggt

SEQ ID NO: 31213 - DNA, 20 bp, human
gacctccgcagaggcttagt

SEQ ID NO: 31214 - DNA, 20 bp, human
gggaggaggcgcccttaaaa

SEQ ID NO: 31215 - DNA, 20 bp, human
gcttcggccagatttcaggg

SEQ ID NO: 31216 - DNA, 20 bp, human
gagcctagcgctgccttaac

SEQ ID NO: 31217 - DNA, 20 bp, human
gggagcagccgcgcggtcag

SEQ ID NO: 31218 - DNA, 20 bp, human
gctaggcaggccaccagtta

SEQ ID NO: 31219 - DNA, 20 bp, human
gtgcgggacaacctcccagg

SEQ ID NO: 31220 - DNA, 20 bp, human
gcccaggtgcacaaaatcag

SEQ ID NO: 31221 - DNA, 20 bp, human
gccgctccaagcgccgatct

SEQ ID NO: 31222 - DNA, 20 bp, human
gtggtggcgggtgcccagat

SEQ ID NO: 31223 - DNA, 20 bp, human
gctgcctggcaggcaaaatc

SEQ ID NO: 31224 - DNA, 20 bp, human
gaggcacgtgcgtccgccaa

SEQ ID NO: 31225 - DNA, 20 bp, human
gtgtgggaccgctgaccgcg

SEQ ID NO: 31226 - DNA, 20 bp, human
gtgcagccctcgtgagacgg

SEQ ID NO: 31227 - DNA, 20 bp, human
gcggagcgcgctagctgctc

SEQ ID NO: 31228 - DNA, 20 bp, human
gtggtgagtccgggctcccg

SEQ ID NO: 31229 - DNA, 20 bp, human
gcaattcccggagaaagtgt

SEQ ID NO: 31230 - DNA, 20 bp, human
gcaaggccagcaggaccggg

SEQ ID NO: 31231 - DNA, 20 bp, human
ggcccggactcaccacggcc

SEQ ID NO: 31232 - DNA, 20 bp, human
gtgtgctacgcggaccacag

SEQ ID NO: 31233 - DNA, 20 bp, human
gcgctctgctcagtctcggg

SEQ ID NO: 31234 - DNA, 20 bp, human
gcgccgggccgtggtgagtc

SEQ ID NO: 31235 - DNA, 20 bp, human
gctgcagggcgcgcccactc

SEQ ID NO: 31236 - DNA, 20 bp, human
ggagccatggcgctcggcgg

SEQ ID NO: 31237 - DNA, 20 bp, human
gacctgcggtcccgagacaa

SEQ ID NO: 31238 - DNA, 20 bp, human
gtagagccgctctctctcac

SEQ ID NO: 31239 - DNA, 20 bp, human
ggtcgccaggcacgtacctg

SEQ ID NO: 31240 - DNA, 20 bp, human
gggcagagccgacaggacac

SEQ ID NO: 31241 - DNA, 20 bp, human
ggttatccacctccttgagg

SEQ ID NO: 31242 - DNA, 20 bp, human
gggctctgcgcgagatgaac

SEQ ID NO: 31243 - DNA, 20 bp, human
ggcgagcttccgcctccgta

SEQ ID NO: 31244 - DNA, 20 bp, human
gccgacaggacacgggtcac

SEQ ID NO: 31245 - DNA, 20 bp, human
gcaagcaaattgagtcagac

SEQ ID NO: 31246 - DNA, 20 bp, human
gcgcgcaggtgagtgagcca

SEQ ID NO: 31247 - DNA, 20 bp, human
gggcaaggttgactccagga

SEQ ID NO: 31248 - DNA, 20 bp, human
ggcctcggtggggaaaacga

SEQ ID NO: 31249 - DNA, 20 bp, human
gcgagggcaaggttgactcc

SEQ ID NO: 31250 - DNA, 20 bp, human
gctcatcctcccggaccggg

SEQ ID NO: 31251 - DNA, 20 bp, human
gggacactctcacgtgccga

SEQ ID NO: 31252 - DNA, 20 bp, human
gaaacgacggtggggagcgg

SEQ ID NO: 31253 - DNA, 20 bp, human
gccgggaggctccccgatcg

SEQ ID NO: 31254 - DNA, 20 bp, human
ggtgagagtgtccccgatcg

SEQ ID NO: 31255 - DNA, 20 bp, human
gcaggaaccgaacagtccgg

SEQ ID NO: 31256 - DNA, 20 bp, human
ggatgagaagacccagacca

SEQ ID NO: 31257 - DNA, 20 bp, human
ggctgaacagccccactgga

SEQ ID NO: 31258 - DNA, 20 bp, human
gcggagctgaacagccccac

SEQ ID NO: 31259 - DNA, 20 bp, human
ggttggacacaaagtccccg

SEQ ID NO: 31260 - DNA, 20 bp, human
ggaaagagcccgcttcctgt

SEQ ID NO: 31261 - DNA, 20 bp, human
gcaaggcttgggatcaataa

SEQ ID NO: 31262 - DNA, 20 bp, human
ggctgttcagctccgaccca

SEQ ID NO: 31263 - DNA, 20 bp, human
gatgtgccaggccccgcaca

SEQ ID NO: 31264 - DNA, 20 bp, human
gcgatgttcaagcaaggctt

SEQ ID NO: 31265 - DNA, 20 bp, human
ggtcttctcatccatccagt

SEQ ID NO: 31266 - DNA, 20 bp, human
ggccacgcaccccctctcag

SEQ ID NO: 31267 - DNA, 20 bp, human
gttccgacgccactgagagg

SEQ ID NO: 31268 - DNA, 20 bp, human
gcctccagcgcagaccgagg

SEQ ID NO: 31269 - DNA, 20 bp, human
gggcgtgaagcggggtgtag

SEQ ID NO: 31270 - DNA, 20 bp, human
ggcaggcgccgggtgcggtc

SEQ ID NO: 31271 - DNA, 20 bp, human
ggaagcggtgacgacgggag

SEQ ID NO: 31272 - DNA, 20 bp, human
gctgacttccgcaagctcac

SEQ ID NO: 31273 - DNA, 20 bp, human
gtcgcaagtcaggggatccg

SEQ ID NO: 31274 - DNA, 20 bp, human
gcaccccctctcagtggcgt

SEQ ID NO: 31275 - DNA, 20 bp, human
ggaagggaagcggtgacgac

SEQ ID NO: 31276 - DNA, 20 bp, human
gtgcagcactcgccatggga

SEQ ID NO: 31277 - DNA, 20 bp, human
ggagctgcagcactcgccat

SEQ ID NO: 31278 - DNA, 20 bp, human
gagggaaccgaagaaaacgg

SEQ ID NO: 31279 - DNA, 20 bp, human
gagaagctgataaaaaaggt

SEQ ID NO: 31280 - DNA, 20 bp, human
ggagggcgcatccgagagga

SEQ ID NO: 31281 - DNA, 20 bp, human
gttagagactgtggaagtgc

SEQ ID NO: 31282 - DNA, 20 bp, human
gaggggagggcgcatccgag

SEQ ID NO: 31283 - DNA, 20 bp, human
gatatattcctccacttgag

SEQ ID NO: 31284 - DNA, 20 bp, human
gggaatatataataccttaa

SEQ ID NO: 31285 - DNA, 20 bp, human
gattcctccacttgaggggt

SEQ ID NO: 31286 - DNA, 20 bp, human
gccggagccagggagagtcg

SEQ ID NO: 31287 - DNA, 20 bp, human
gcgctcggcggctcattccg

SEQ ID NO: 31288 - DNA, 20 bp, human
gggtcccattcacaagtcag

SEQ ID NO: 31289 - DNA, 20 bp, human
gcagctgaggggagcgtcgc

SEQ ID NO: 31290 - DNA, 20 bp, human
gcccattcacaagtcagcgg

SEQ ID NO: 31291 - DNA, 20 bp, human
gccccgcggcatctgctcct

SEQ ID NO: 31292 - DNA, 20 bp, human
gctggctccggcctcctgtg

SEQ ID NO: 31293 - DNA, 20 bp, human
gggccgaggagcagatgccg

SEQ ID NO: 31294 - DNA, 20 bp, human
ggcaggaatgagaaaccggg

SEQ ID NO: 31295 - DNA, 20 bp, human
gctgccactagcgcgctcgg

SEQ ID NO: 31296 - DNA, 20 bp, human
gacgaagctgcacacagatc

SEQ ID NO: 31297 - DNA, 20 bp, human
gggctggagctcaactgcag

SEQ ID NO: 31298 - DNA, 20 bp, human
gcagatctggcagctgaatt

SEQ ID NO: 31299 - DNA, 20 bp, human
gctggtcctcagaccgtgag

SEQ ID NO: 31300 - DNA, 20 bp, human
gccttacctgatggcagaaa

SEQ ID NO: 31301 - DNA, 20 bp, human
gatcaataatgctctcggag

SEQ ID NO: 31302 - DNA, 20 bp, human
gtgaattaggagcttgtgcg

SEQ ID NO: 31303 - DNA, 20 bp, human
gctctcttctcagaaaagcc

SEQ ID NO: 31304 - DNA, 20 bp, human
ggcgagcggcgagccaatgg

SEQ ID NO: 31305 - DNA, 20 bp, human
gagcaccgacggccgcagca

SEQ ID NO: 31306 - DNA, 20 bp, human
gtccgactagaagcgcccgg

SEQ ID NO: 31307 - DNA, 20 bp, human
gctgctagcaaaaaaggact

SEQ ID NO: 31308 - DNA, 20 bp, human
ggacagatcggggctcggta

SEQ ID NO: 31309 - DNA, 20 bp, human
gcggcggcgaagacagatcg

SEQ ID NO: 31310 - DNA, 20 bp, human
gtgtcccaggtagggaagag

SEQ ID NO: 31311 - DNA, 20 bp, human
ggcaccgagcctccggagga

SEQ ID NO: 31312 - DNA, 20 bp, human
gcggcacgggcagggtgagg

SEQ ID NO: 31313 - DNA, 20 bp, human
gtacgttcgttaacgggagg

SEQ ID NO: 31314 - DNA, 20 bp, human
gcacacacgcacgccagagt

SEQ ID NO: 31315 - DNA, 20 bp, human
gctaggcaccccccacacac

SEQ ID NO: 31316 - DNA, 20 bp, human
gaggaacgcggcgtccatcg

SEQ ID NO: 31317 - DNA, 20 bp, human
gtcgggtcgcgggtgcactc

SEQ ID NO: 31318 - DNA, 20 bp, human
gagagagggcacggctacct

SEQ ID NO: 31319 - DNA, 20 bp, human
gtgtcccgcagcgtcgaggg

SEQ ID NO: 31320 - DNA, 20 bp, human
gtacctgggccaacagcccg

SEQ ID NO: 31321 - DNA, 20 bp, human
gtatagggactccctgcggt

SEQ ID NO: 31322 - DNA, 20 bp, human
gaggcccccaaaggcgacca

SEQ ID NO: 31323 - DNA, 20 bp, human
gcgtccatcggggccgaggc

SEQ ID NO: 31324 - DNA, 20 bp, human
ggagggcacggctacctggg

SEQ ID NO: 31325 - DNA, 20 bp, human
ggctcccgcctcggccccga

SEQ ID NO: 31326 - DNA, 20 bp, human
ggccagtcttgggcgctgga

SEQ ID NO: 31327 - DNA, 20 bp, human
gctgcccagctccatgacaa

SEQ ID NO: 31328 - DNA, 20 bp, human
gttgcttggcagctggacca

SEQ ID NO: 31329 - DNA, 20 bp, human
gaccctccagcgcccaagac

SEQ ID NO: 31330 - DNA, 20 bp, human
gcgcccaagactggctccct

SEQ ID NO: 31331 - DNA, 20 bp, human
gaggccttgcctgcaacaag

SEQ ID NO: 31332 - DNA, 20 bp, human
gccagggcctcatcttagag

SEQ ID NO: 31333 - DNA, 20 bp, human
ggttctccttgtctagaagg

SEQ ID NO: 31334 - DNA, 20 bp, human
gttcccagatggcgaggaca

SEQ ID NO: 31335 - DNA, 20 bp, human
gaaggagctctcttcttgct

SEQ ID NO: 31336 - DNA, 20 bp, human
ggaagagggagtgttcccgg

SEQ ID NO: 31337 - DNA, 20 bp, human
gaagagtctcgaccactgaa

SEQ ID NO: 31338 - DNA, 20 bp, human
gctggtcttaagatgctcta

SEQ ID NO: 31339 - DNA, 20 bp, human
gcgactggagtatctccccc

SEQ ID NO: 31340 - DNA, 20 bp, human
ggtccttttcttccattcag

SEQ ID NO: 31341 - DNA, 20 bp, human
ggtgacttacagaaaggtaa

SEQ ID NO: 31342 - DNA, 20 bp, human
ggctatgcagatgcggagaa

SEQ ID NO: 31343 - DNA, 20 bp, human
gtcgagactcttgctacgac

SEQ ID NO: 31344 - DNA, 20 bp, human
gatgagtatataaaagtccc

SEQ ID NO: 31345 - DNA, 20 bp, human
ggctgcagtgaaatcaagct

SEQ ID NO: 31346 - DNA, 20 bp, human
ggccccaatcagacaagcgg

SEQ ID NO: 31347 - DNA, 20 bp, human
gctggccgcatagagccact

SEQ ID NO: 31348 - DNA, 20 bp, human
gggagccccaatcagacaag

SEQ ID NO: 31349 - DNA, 20 bp, human
gcaatcccagtggctctatg

SEQ ID NO: 31350 - DNA, 20 bp, human
gggctgcacgttggaaccaa

SEQ ID NO: 31351 - DNA, 20 bp, human
gcaatcagacaagcgggggt

SEQ ID NO: 31352 - DNA, 20 bp, human
gagtcaaatcacaatcccag

SEQ ID NO: 31353 - DNA, 20 bp, human
gtcttcacagcaacacggga

SEQ ID NO: 31354 - DNA, 20 bp, human
gagttgatcaatctgcttag

SEQ ID NO: 31355 - DNA, 20 bp, human
ggtacaggggttctcaacgc

SEQ ID NO: 31356 - DNA, 20 bp, human
gtcagggaagacaacagcac

SEQ ID NO: 31357 - DNA, 20 bp, human
gagtctgggctttccgagga

SEQ ID NO: 31358 - DNA, 20 bp, human
ggcggacttgccctaactgg

SEQ ID NO: 31359 - DNA, 20 bp, human
gatgggtttcacaggatcga

SEQ ID NO: 31360 - DNA, 20 bp, human
gcacagctgctcgccgtcct

SEQ ID NO: 31361 - DNA, 20 bp, human
gcttgccctaactggtggaa

SEQ ID NO: 31362 - DNA, 20 bp, human
ggggcaagtccgccaaggta

SEQ ID NO: 31363 - DNA, 20 bp, human
gcctgagtctgggctttccg

SEQ ID NO: 31364 - DNA, 20 bp, human
gaggcacattgcaataatga

SEQ ID NO: 31365 - DNA, 20 bp, human
gcacaggatcgagggctgag

SEQ ID NO: 31366 - DNA, 20 bp, human
gtggacacataaggaagagt

SEQ ID NO: 31367 - DNA, 20 bp, human
gcacaagcgtctgtaactct

SEQ ID NO: 31368 - DNA, 20 bp, human
gacttcgtgttggacacata

SEQ ID NO: 31369 - DNA, 20 bp, human
gtcagtacaagtacacatca

SEQ ID NO: 31370 - DNA, 20 bp, human
gcgtctgtaactctgggcaa

SEQ ID NO: 31371 - DNA, 20 bp, human
gtaatacagattgttggtgt

SEQ ID NO: 31372 - DNA, 20 bp, human
ggttttaaatatcctaacat

SEQ ID NO: 31373 - DNA, 20 bp, human
gtgaacagcaaacttcgtgt

SEQ ID NO: 31374 - DNA, 20 bp, human
gctagaagttgaagttacaa

SEQ ID NO: 31375 - DNA, 20 bp, human
gtacagattgttggtgttgg

SEQ ID NO: 31376 - DNA, 20 bp, human
gcaacagcggcgcggagaaa

SEQ ID NO: 31377 - DNA, 20 bp, human
ggggccgagcgaagagccgg

SEQ ID NO: 31378 - DNA, 20 bp, human
gcctagagccccgccaggaa

SEQ ID NO: 31379 - DNA, 20 bp, human
gcccgctatccggcacatgg

SEQ ID NO: 31380 - DNA, 20 bp, human
ggaggggccgagcgaagagc

SEQ ID NO: 31381 - DNA, 20 bp, human
gcgggctgcgcacccgggaa

SEQ ID NO: 31382 - DNA, 20 bp, human
ggctatccggcacatggagg

SEQ ID NO: 31383 - DNA, 20 bp, human
gaaaggcgcgagagacctac

SEQ ID NO: 31384 - DNA, 20 bp, human
ggtgaggcaggataactccc

SEQ ID NO: 31385 - DNA, 20 bp, human
gcggcacatggaggcggaga

SEQ ID NO: 31386 - DNA, 20 bp, human
gtaacgcagagggctcgggt

SEQ ID NO: 31387 - DNA, 20 bp, human
gggacggtgaccgcgaccag

SEQ ID NO: 31388 - DNA, 20 bp, human
ggccggtaggctcgtcgagg

SEQ ID NO: 31389 - DNA, 20 bp, human
gtagggaaggcgcgagggag

SEQ ID NO: 31390 - DNA, 20 bp, human
gcagccactcctgctaggga

SEQ ID NO: 31391 - DNA, 20 bp, human
gtccagtgagaagagccccc

SEQ ID NO: 31392 - DNA, 20 bp, human
ggcgccttccctagcaggag

SEQ ID NO: 31393 - DNA, 20 bp, human
ggtctccggagagtcgccgg

SEQ ID NO: 31394 - DNA, 20 bp, human
gcctctggggcgaaatcccc

SEQ ID NO: 31395 - DNA, 20 bp, human
ggaccgcgcgccacgctcgg

SEQ ID NO: 31396 - DNA, 20 bp, human
ggccgcccgcaggagccgga

SEQ ID NO: 31397 - DNA, 20 bp, human
gcgggcttcgggccgagagg

SEQ ID NO: 31398 - DNA, 20 bp, human
gcgaggttgtggggacgggt

SEQ ID NO: 31399 - DNA, 20 bp, human
gcccacgcagcgtcccgagg

SEQ ID NO: 31400 - DNA, 20 bp, human
gccctcccggccgagaggag

SEQ ID NO: 31401 - DNA, 20 bp, human
gctgcgggcttcgggccgag

SEQ ID NO: 31402 - DNA, 20 bp, human
gctccgcgccggggaaagtt

SEQ ID NO: 31403 - DNA, 20 bp, human
gggaggctgcccggcaggga

SEQ ID NO: 31404 - DNA, 20 bp, human
gcgcggcggacgaggttgtg

SEQ ID NO: 31405 - DNA, 20 bp, human
gccggatcgccgccgagggg

SEQ ID NO: 31406 - DNA, 20 bp, human
ggctcgggagagagggacgc

SEQ ID NO: 31407 - DNA, 20 bp, human
gtagaggacgcgtccgacgg

SEQ ID NO: 31408 - DNA, 20 bp, human
gcggcgcgaaggctcatccg

SEQ ID NO: 31409 - DNA, 20 bp, human
ggcgctgggaacaagtggtt

SEQ ID NO: 31410 - DNA, 20 bp, human
gagttgatcgcggacttgag

SEQ ID NO: 31411 - DNA, 20 bp, human
gggctagaggacgcgtccga

SEQ ID NO: 31412 - DNA, 20 bp, human
gaggcgcgatgcttggctag

SEQ ID NO: 31413 - DNA, 20 bp, human
gccggacgctgaggtggtcg

SEQ ID NO: 31414 - DNA, 20 bp, human
gagcaagggaaagttgatcg

SEQ ID NO: 31415 - DNA, 20 bp, human
ggcgcgcctgaagttgcgag

SEQ ID NO: 31416 - DNA, 20 bp, human
ggaatccgcggaggggtagg

SEQ ID NO: 31417 - DNA, 20 bp, human
gggctctgttcactggccct

SEQ ID NO: 31418 - DNA, 20 bp, human
gccccgtcgccgggtcccgg

SEQ ID NO: 31419 - DNA, 20 bp, human
ggcggccccggcgagaacaa

SEQ ID NO: 31420 - DNA, 20 bp, human
gccgcggcgcccgctccaat

SEQ ID NO: 31421 - DNA, 20 bp, human
gagccccgagccgattggag

SEQ ID NO: 31422 - DNA, 20 bp, human
ggcccgctccaatcggctcg

SEQ ID NO: 31423 - DNA, 20 bp, human
gtgcccccgggacccggcga

SEQ ID NO: 31424 - DNA, 20 bp, human
gcctcggcagtgccaggtaa

SEQ ID NO: 31425 - DNA, 20 bp, human
ggagacagagggaagggata

SEQ ID NO: 31426 - DNA, 20 bp, human
gtgtacgtgcaggaccatgg

SEQ ID NO: 31427 - DNA, 20 bp, human
gtagagttcctaggaagggt

SEQ ID NO: 31428 - DNA, 20 bp, human
gccctcccttagcctagaag

SEQ ID NO: 31429 - DNA, 20 bp, human
gtatggccatgagatccggg

SEQ ID NO: 31430 - DNA, 20 bp, human
gtgccacaagtagagttcct

SEQ ID NO: 31431 - DNA, 20 bp, human
gttgtgtacgtgcaggacca

SEQ ID NO: 31432 - DNA, 20 bp, human
gctggctggggtctgacctc

SEQ ID NO: 31433 - DNA, 20 bp, human
ggtagaaactaaagccacca

SEQ ID NO: 31434 - DNA, 20 bp, human
gagaatggcttaggtagcag

SEQ ID NO: 31435 - DNA, 20 bp, human
gccctgccccttctaggcta

SEQ ID NO: 31436 - DNA, 20 bp, human
ggaacaccggcccgccgtcg

SEQ ID NO: 31437 - DNA, 20 bp, human
gagacgcgagaggtccacga

SEQ ID NO: 31438 - DNA, 20 bp, human
gggggctgcggtgctcaaag

SEQ ID NO: 31439 - DNA, 20 bp, human
gtgccgggcggtcttcaggg

SEQ ID NO: 31440 - DNA, 20 bp, human
gtcctcagggtggaaccgca

SEQ ID NO: 31441 - DNA, 20 bp, human
gggtgaagcagctgccgcga

SEQ ID NO: 31442 - DNA, 20 bp, human
gaaaggtaagatcctcaggg

SEQ ID NO: 31443 - DNA, 20 bp, human
ggggaaaggtaagatcctca

SEQ ID NO: 31444 - DNA, 20 bp, human
gcaaaggggcaagagctgag

SEQ ID NO: 31445 - DNA, 20 bp, human
ggcccgagggcagagagtga

SEQ ID NO: 31446 - DNA, 20 bp, human
gctccgagcgcgcggaacag

SEQ ID NO: 31447 - DNA, 20 bp, human
gcacccggcggggctctccc

SEQ ID NO: 31448 - DNA, 20 bp, human
ggcgcgcggaacagaggcgc

SEQ ID NO: 31449 - DNA, 20 bp, human
gcgcggaacagaggcgcggg

SEQ ID NO: 31450 - DNA, 20 bp, human
ggcgaggccggcggacgcac

SEQ ID NO: 31451 - DNA, 20 bp, human
ggcggcgcgttccctcgggc

SEQ ID NO: 31452 - DNA, 20 bp, human
ggagccaggccaagtccggc

SEQ ID NO: 31453 - DNA, 20 bp, human
ggagcgccccgcgggatccg

SEQ ID NO: 31454 - DNA, 20 bp, human
ggcggcggcggcgatcggag

SEQ ID NO: 31455 - DNA, 20 bp, human
ggctgcccggggcttccgaa

SEQ ID NO: 31456 - DNA, 20 bp, human
gggacggacaggcagtccaa

SEQ ID NO: 31457 - DNA, 20 bp, human
gccggcatgctgggcaactg

SEQ ID NO: 31458 - DNA, 20 bp, human
gtgacagagaggctcctcga

SEQ ID NO: 31459 - DNA, 20 bp, human
gccccactcaccgtgcctgt

SEQ ID NO: 31460 - DNA, 20 bp, human
ggaaacatccctcagcccac

SEQ ID NO: 31461 - DNA, 20 bp, human
ggagcgtgagtggagctctg

SEQ ID NO: 31462 - DNA, 20 bp, human
gcagtaagggtaaggcaccg

SEQ ID NO: 31463 - DNA, 20 bp, human
gcacccagaggtagtgccaa

SEQ ID NO: 31464 - DNA, 20 bp, human
gcctgctctgagccacgagg

SEQ ID NO: 31465 - DNA, 20 bp, human
ggggtgccagtcctctgccc

SEQ ID NO: 31466 - DNA, 20 bp, human
gcctctgccggcgtagagaa

SEQ ID NO: 31467 - DNA, 20 bp, human
gtcagccgcgacagcaagaa

SEQ ID NO: 31468 - DNA, 20 bp, human
gaaggcagcgggttcttctg

SEQ ID NO: 31469 - DNA, 20 bp, human
gcggcgtcggtcctgagcag

SEQ ID NO: 31470 - DNA, 20 bp, human
gcggcgcggcacccaccggg

SEQ ID NO: 31471 - DNA, 20 bp, human
gacagcaagaacggcagagc

SEQ ID NO: 31472 - DNA, 20 bp, human
ggtaagaccgatccgccgtg

SEQ ID NO: 31473 - DNA, 20 bp, human
ggcggatcggtcttaccagg

SEQ ID NO: 31474 - DNA, 20 bp, human
gactccggcgcggcacccac

SEQ ID NO: 31475 - DNA, 20 bp, human
gcaggaaggcgagcagaggt

SEQ ID NO: 31476 - DNA, 20 bp, human
gcgcgcgcggggcagactgg

SEQ ID NO: 31477 - DNA, 20 bp, human
gcctcccagagacccggtgg

SEQ ID NO: 31478 - DNA, 20 bp, human
ggagcgcgcggccagagaga

SEQ ID NO: 31479 - DNA, 20 bp, human
gggaggcgccgaagtctcag

SEQ ID NO: 31480 - DNA, 20 bp, human
gtgcagcggcaaacatgggc

SEQ ID NO: 31481 - DNA, 20 bp, human
gggtggaggagggtgcgcga

SEQ ID NO: 31482 - DNA, 20 bp, human
ggccggggccgaagagggag

SEQ ID NO: 31483 - DNA, 20 bp, human
gggaagagggcgacgatggt

SEQ ID NO: 31484 - DNA, 20 bp, human
gtacagatccgccaggcggg

SEQ ID NO: 31485 - DNA, 20 bp, human
gcggggcagactggaggaac

SEQ ID NO: 31486 - DNA, 20 bp, human
ggcgcgcaaggtgtccgaag

SEQ ID NO: 31487 - DNA, 20 bp, human
gaggcatgaacggaatccgg

SEQ ID NO: 31488 - DNA, 20 bp, human
gcaagccctgtagctccgag

SEQ ID NO: 31489 - DNA, 20 bp, human
gtagctccgagaggcatgaa

SEQ ID NO: 31490 - DNA, 20 bp, human
gctggatagtcggaacatag

SEQ ID NO: 31491 - DNA, 20 bp, human
gctagcgagcgaggaccggt

SEQ ID NO: 31492 - DNA, 20 bp, human
gcatgcctctcggagctaca

SEQ ID NO: 31493 - DNA, 20 bp, human
gggaacatagaggaaaacgg

SEQ ID NO: 31494 - DNA, 20 bp, human
gccctcatccaccatctgag

SEQ ID NO: 31495 - DNA, 20 bp, human
gctgcctagcgagcgaggac

SEQ ID NO: 31496 - DNA, 20 bp, human
gaccgagacagaagcaacaa

SEQ ID NO: 31497 - DNA, 20 bp, human
ggaactgtcagtgcggagta

SEQ ID NO: 31498 - DNA, 20 bp, human
gctataaaaagagcttgagt

SEQ ID NO: 31499 - DNA, 20 bp, human
gctgtgaagatactataaaa

SEQ ID NO: 31500 - DNA, 20 bp, human
gaacaacggaactgtcagtg

SEQ ID NO: 31501 - DNA, 20 bp, human
gtccgttgttgcttctgtct

SEQ ID NO: 31502 - DNA, 20 bp, human
gagagcaaaatatagcaact

SEQ ID NO: 31503 - DNA, 20 bp, human
gaaattgtatcagttgattg

SEQ ID NO: 31504 - DNA, 20 bp, human
gcacttaccttgcttaacaa

SEQ ID NO: 31505 - DNA, 20 bp, human
gcatcacttttaactcagac

SEQ ID NO: 31506 - DNA, 20 bp, human
ggggcgctaagaggatgaca

SEQ ID NO: 31507 - DNA, 20 bp, human
ggcctgacgagaccaattag

SEQ ID NO: 31508 - DNA, 20 bp, human
gagggcagagaccacaatgg

SEQ ID NO: 31509 - DNA, 20 bp, human
gggagcggcgggtggcgtga

SEQ ID NO: 31510 - DNA, 20 bp, human
ggtccgggcgccaaaccctg

SEQ ID NO: 31511 - DNA, 20 bp, human
gccgccgagaccgggcgcag

SEQ ID NO: 31512 - DNA, 20 bp, human
gcacttccagagtgggactc

SEQ ID NO: 31513 - DNA, 20 bp, human
gtcgggctggtggacgggag

SEQ ID NO: 31514 - DNA, 20 bp, human
gccgcgccggcggagacatg

SEQ ID NO: 31515 - DNA, 20 bp, human
ggacatgaggcgctgccggt

SEQ ID NO: 31516 - DNA, 20 bp, human
gcacaggtgggcaccctctg

SEQ ID NO: 31517 - DNA, 20 bp, human
gcccttcataggatgctcag

SEQ ID NO: 31518 - DNA, 20 bp, human
gggcgaaggggacacaggta

SEQ ID NO: 31519 - DNA, 20 bp, human
gcggcaggcaggcgccggac

SEQ ID NO: 31520 - DNA, 20 bp, human
gaagtagcccaccaaggtca

SEQ ID NO: 31521 - DNA, 20 bp, human
gggaagtcacacgctagatg

SEQ ID NO: 31522 - DNA, 20 bp, human
gctgtgtgccagcgcctgtc

SEQ ID NO: 31523 - DNA, 20 bp, human
ggctccaccctgaccttggt

SEQ ID NO: 31524 - DNA, 20 bp, human
gaggacggggaagctgacct

SEQ ID NO: 31525 - DNA, 20 bp, human
ggtccccttcgccacggagg

SEQ ID NO: 31526 - DNA, 20 bp, human
gcactcctccaaggtcacgg

SEQ ID NO: 31527 - DNA, 20 bp, human
ggcagcctccgtgaccttgg

SEQ ID NO: 31528 - DNA, 20 bp, human
ggtcggccaggggtgcgtaa

SEQ ID NO: 31529 - DNA, 20 bp, human
ggcctaatgcgcccaggagg

SEQ ID NO: 31530 - DNA, 20 bp, human
gctggctggcatgcaggtgg

SEQ ID NO: 31531 - DNA, 20 bp, human
gctggcctaatgcgcccagg

SEQ ID NO: 31532 - DNA, 20 bp, human
gccgcagacttgaaaagtga

SEQ ID NO: 31533 - DNA, 20 bp, human
ggggcgcattaggccagcga

SEQ ID NO: 31534 - DNA, 20 bp, human
ggccaacctggaccagggca

SEQ ID NO: 31535 - DNA, 20 bp, human
ggattctctgaacgaccatg

SEQ ID NO: 31536 - DNA, 20 bp, human
gcaggctgtggctaatgtgc

SEQ ID NO: 31537 - DNA, 20 bp, human
gtgggtgtgagacgggattc

SEQ ID NO: 31538 - DNA, 20 bp, human
ggctcctacctggtccccca

SEQ ID NO: 31539 - DNA, 20 bp, human
gaggctcgtagggcaacttg

SEQ ID NO: 31540 - DNA, 20 bp, human
gaattgaacaagcctcccag

SEQ ID NO: 31541 - DNA, 20 bp, human
gaaaggaaattgcccctggg

SEQ ID NO: 31542 - DNA, 20 bp, human
gctctcctgggtgccatgtc

SEQ ID NO: 31543 - DNA, 20 bp, human
gccttttctggaggctcgta

SEQ ID NO: 31544 - DNA, 20 bp, human
gcagaaaggaaattgcccct

SEQ ID NO: 31545 - DNA, 20 bp, human
gcctgggtgccatgtcaggt

SEQ ID NO: 31546 - DNA, 20 bp, human
gagagaccaccggagcaaag

SEQ ID NO: 31547 - DNA, 20 bp, human
gggactccaagggaaaacta

SEQ ID NO: 31548 - DNA, 20 bp, human
ggggagtgagaacttgactg

SEQ ID NO: 31549 - DNA, 20 bp, human
ggctccggtggtctctggtg

SEQ ID NO: 31550 - DNA, 20 bp, human
gaaactgaaggactgtgcca

SEQ ID NO: 31551 - DNA, 20 bp, human
gggaagggtcaggactccaa

SEQ ID NO: 31552 - DNA, 20 bp, human
gagcaactgacctggcaaca

SEQ ID NO: 31553 - DNA, 20 bp, human
gcatggaggacagggattgg

SEQ ID NO: 31554 - DNA, 20 bp, human
gggtcatcatggtgctgctc

SEQ ID NO: 31555 - DNA, 20 bp, human
ggaggaggcttcagaaagct

SEQ ID NO: 31556 - DNA, 20 bp, human
gggtgacagccgccaagatg

SEQ ID NO: 31557 - DNA, 20 bp, human
ggcagcccggtgaacagcag

SEQ ID NO: 31558 - DNA, 20 bp, human
gccgcaggcatagaactcct

SEQ ID NO: 31559 - DNA, 20 bp, human
gaggagggtctgagcgggtc

SEQ ID NO: 31560 - DNA, 20 bp, human
ggcccggtgaacagcagggg

SEQ ID NO: 31561 - DNA, 20 bp, human
ggcaggcgggcgggatatgg

SEQ ID NO: 31562 - DNA, 20 bp, human
ggctggggcgaaggtcgctg

SEQ ID NO: 31563 - DNA, 20 bp, human
gcgggtctggcgtctaggac

SEQ ID NO: 31564 - DNA, 20 bp, human
gactcctgattacgaggtgt

SEQ ID NO: 31565 - DNA, 20 bp, human
ggggcgaaggtcgctgaggt

SEQ ID NO: 31566 - DNA, 20 bp, human
gacagcaggaccgaacgcct

SEQ ID NO: 31567 - DNA, 20 bp, human
ggaggggcccgggtccggac

SEQ ID NO: 31568 - DNA, 20 bp, human
gaggccggccgaaagcggag

SEQ ID NO: 31569 - DNA, 20 bp, human
ggtgcgactgccagctgccg

SEQ ID NO: 31570 - DNA, 20 bp, human
gtgttgcggccgctgcccca

SEQ ID NO: 31571 - DNA, 20 bp, human
ggcccgaggccggccgaaag

SEQ ID NO: 31572 - DNA, 20 bp, human
gtcgcacttctgtcacaagg

SEQ ID NO: 31573 - DNA, 20 bp, human
gtccagaagcccggtgcccg

SEQ ID NO: 31574 - DNA, 20 bp, human
gcacccgcggggctcggcag

SEQ ID NO: 31575 - DNA, 20 bp, human
gagtcctagaagcctctggg

SEQ ID NO: 31576 - DNA, 20 bp, human
gccacgcgcagctggagcag

SEQ ID NO: 31577 - DNA, 20 bp, human
gtgggcagcactcaccgatg

SEQ ID NO: 31578 - DNA, 20 bp, human
gatgatggcgaagacaatcc

SEQ ID NO: 31579 - DNA, 20 bp, human
gggccccgggccgaacgaga

SEQ ID NO: 31580 - DNA, 20 bp, human
gagcactcaccgatgaggtt

SEQ ID NO: 31581 - DNA, 20 bp, human
gcatctccagagcaggcccg

SEQ ID NO: 31582 - DNA, 20 bp, human
gaggatcagggagcccgcca

SEQ ID NO: 31583 - DNA, 20 bp, human
ggggctggcagaggcgaggg

SEQ ID NO: 31584 - DNA, 20 bp, human
gagccgtcgggagcatggac

SEQ ID NO: 31585 - DNA, 20 bp, human
gaagccgacaggccttaaag

SEQ ID NO: 31586 - DNA, 20 bp, human
gtacccggcttattattccg

SEQ ID NO: 31587 - DNA, 20 bp, human
ggacggccgagggcctcgga

SEQ ID NO: 31588 - DNA, 20 bp, human
gaattgagcggagagcgacg

SEQ ID NO: 31589 - DNA, 20 bp, human
gtcccacccccgaggcggga

SEQ ID NO: 31590 - DNA, 20 bp, human
gtgcagtcatgagtcgaggt

SEQ ID NO: 31591 - DNA, 20 bp, human
gccggcttattattccgcgg

SEQ ID NO: 31592 - DNA, 20 bp, human
gtggccgtgtgagccacact

SEQ ID NO: 31593 - DNA, 20 bp, human
gtcgcacttggcttcaaagc

SEQ ID NO: 31594 - DNA, 20 bp, human
gccctgccatcccgcctcgg

SEQ ID NO: 31595 - DNA, 20 bp, human
ggggatggcagggcgcgcag

SEQ ID NO: 31596 - DNA, 20 bp, human
gggcatggcggagccagatc

SEQ ID NO: 31597 - DNA, 20 bp, human
gtctgctcgcactccagatc

SEQ ID NO: 31598 - DNA, 20 bp, human
gaagctccgggatccagctc

SEQ ID NO: 31599 - DNA, 20 bp, human
ggggccagcgctcggcatgg

SEQ ID NO: 31600 - DNA, 20 bp, human
gcgcctgcgcgcaagagagg

SEQ ID NO: 31601 - DNA, 20 bp, human
gctcgcgcccgcggagagac

SEQ ID NO: 31602 - DNA, 20 bp, human
gcttgggaagagcaagctcc

SEQ ID NO: 31603 - DNA, 20 bp, human
gcgcgcaccctgtgttccgg

SEQ ID NO: 31604 - DNA, 20 bp, human
gcgtaaggagggcttcttca

SEQ ID NO: 31605 - DNA, 20 bp, human
gccctcagatctccagggac

SEQ ID NO: 31606 - DNA, 20 bp, human
gaccggccgcggccccgtag

SEQ ID NO: 31607 - DNA, 20 bp, human
gcaggaagtgaggatacttc

SEQ ID NO: 31608 - DNA, 20 bp, human
gggatacttctggcgagcgc

SEQ ID NO: 31609 - DNA, 20 bp, human
gcatcattaggcgtcaacac

SEQ ID NO: 31610 - DNA, 20 bp, human
gagtcggaactcacccctac

SEQ ID NO: 31611 - DNA, 20 bp, human
gccagaactcaagacgacag

SEQ ID NO: 31612 - DNA, 20 bp, human
gaagtcggaagtgcagctca

SEQ ID NO: 31613 - DNA, 20 bp, human
gactcacccctacggggccg

SEQ ID NO: 31614 - DNA, 20 bp, human
gcgacgagaactgcgcaccg

SEQ ID NO: 31615 - DNA, 20 bp, human
ggcagagcgacgccgacttt

SEQ ID NO: 31616 - DNA, 20 bp, human
ggccatattttttaagtaag

SEQ ID NO: 31617 - DNA, 20 bp, human
gaccacttacttaaaaaata

SEQ ID NO: 31618 - DNA, 20 bp, human
gaatttttagaatagatttt

SEQ ID NO: 31619 - DNA, 20 bp, human
gtcttcaggaaaagaaacga

SEQ ID NO: 31620 - DNA, 20 bp, human
gaaacgaaggaaggaacaag

SEQ ID NO: 31621 - DNA, 20 bp, human
ggggtgatgaaaaggactct

SEQ ID NO: 31622 - DNA, 20 bp, human
gactcaaatgggtgatgaaa

SEQ ID NO: 31623 - DNA, 20 bp, human
gtgggctcacctgcgacatt

SEQ ID NO: 31624 - DNA, 20 bp, human
ggcagtgttttaactcaaat

SEQ ID NO: 31625 - DNA, 20 bp, human
gtgttctaatggaaaaatga

SEQ ID NO: 31626 - DNA, 20 bp, human
ggatctttagcagcatcatt

SEQ ID NO: 31627 - DNA, 20 bp, human
gaatttttagaatagatttt

SEQ ID NO: 31628 - DNA, 20 bp, human
gagtgaagtgcaatacaaca

SEQ ID NO: 31629 - DNA, 20 bp, human
gttgggatgttagtgagtac

SEQ ID NO: 31630 - DNA, 20 bp, human
gaatattcagttgacattaa

SEQ ID NO: 31631 - DNA, 20 bp, human
gtgggctcacctgcgacatt

SEQ ID NO: 31632 - DNA, 20 bp, human
gtgtctagattgagcataca

SEQ ID NO: 31633 - DNA, 20 bp, human
gttgctacaaacctttaatt

SEQ ID NO: 31634 - DNA, 20 bp, human
gttgtacttccaaatgtcgc

SEQ ID NO: 31635 - DNA, 20 bp, human
gtttgcatggtaatgtactc

SEQ ID NO: 31636 - DNA, 20 bp, human
ggtgagaagccgacggcccg

SEQ ID NO: 31637 - DNA, 20 bp, human
gggcctgaggactggctcgg

SEQ ID NO: 31638 - DNA, 20 bp, human
gtggtgtggaggtgaaacgg

SEQ ID NO: 31639 - DNA, 20 bp, human
gacccttctacatgaggtgg

SEQ ID NO: 31640 - DNA, 20 bp, human
gccaggaagtgagaagccga

SEQ ID NO: 31641 - DNA, 20 bp, human
gcagtggagttgcgagacaa

SEQ ID NO: 31642 - DNA, 20 bp, human
gccaattcagagagacatgg

SEQ ID NO: 31643 - DNA, 20 bp, human
gcaccaaagcgccccgggaa

SEQ ID NO: 31644 - DNA, 20 bp, human
gtgctgaggcgtcgggaggg

SEQ ID NO: 31645 - DNA, 20 bp, human
gagaagggtgctgaggcgtc

SEQ ID NO: 31646 - DNA, 20 bp, human
gattatcgtggcgcttttcc

SEQ ID NO: 31647 - DNA, 20 bp, human
ggccacttccgaggcgcctg

SEQ ID NO: 31648 - DNA, 20 bp, human
gagggcgcgatggagtgaag

SEQ ID NO: 31649 - DNA, 20 bp, human
gagtgaagcggcgacgaagg

SEQ ID NO: 31650 - DNA, 20 bp, human
gtggagtgaagcggcgacga

SEQ ID NO: 31651 - DNA, 20 bp, human
gacgaggagcggagagggaa

SEQ ID NO: 31652 - DNA, 20 bp, human
gagctgggcggagaagaagt

SEQ ID NO: 31653 - DNA, 20 bp, human
gcggctcgggcagcgcaacg

SEQ ID NO: 31654 - DNA, 20 bp, human
ggctccccccctccacgagg

SEQ ID NO: 31655 - DNA, 20 bp, human
ggaacttgcacccaacgtca

SEQ ID NO: 31656 - DNA, 20 bp, human
ggcgacgcgcaggtctaggg

SEQ ID NO: 31657 - DNA, 20 bp, human
ggaagcgacgcgcaggtcta

SEQ ID NO: 31658 - DNA, 20 bp, human
gagggaggcgagcagcaggc

SEQ ID NO: 31659 - DNA, 20 bp, human
gcgttgtaggcggggatcga

SEQ ID NO: 31660 - DNA, 20 bp, human
ggcacagtgctagggacccg

SEQ ID NO: 31661 - DNA, 20 bp, human
gcgcagccggccgagaagat

SEQ ID NO: 31662 - DNA, 20 bp, human
gaggacggcaggctccgctc

SEQ ID NO: 31663 - DNA, 20 bp, human
ggtctagggaggcgagcagc

SEQ ID NO: 31664 - DNA, 20 bp, human
ggatcgagggcacagtgcta

SEQ ID NO: 31665 - DNA, 20 bp, human
gggggagggcaaggacgtaa

SEQ ID NO: 31666 - DNA, 20 bp, human
gagtcagcctgagaccacgg

SEQ ID NO: 31667 - DNA, 20 bp, human
gaggagtcagcctgagacca

SEQ ID NO: 31668 - DNA, 20 bp, human
ggctgtaggggaataatcta

SEQ ID NO: 31669 - DNA, 20 bp, human
gcattgttcagagggaggcg

SEQ ID NO: 31670 - DNA, 20 bp, human
gtgctgacctctggcaaaaa

SEQ ID NO: 31671 - DNA, 20 bp, human
gacgcagcctccgtggtctc

SEQ ID NO: 31672 - DNA, 20 bp, human
gggcaagctgcagtattagt

SEQ ID NO: 31673 - DNA, 20 bp, human
ggctaccattgttcagaggg

SEQ ID NO: 31674 - DNA, 20 bp, human
ggagaaagatgctctctcct

SEQ ID NO: 31675 - DNA, 20 bp, human
gtacagagctgaaacttaaa

SEQ ID NO: 31676 - DNA, 20 bp, human
ggcatgcgcacgcaggcgct

SEQ ID NO: 31677 - DNA, 20 bp, human
gtgaatccgagtgctcacgg

SEQ ID NO: 31678 - DNA, 20 bp, human
gggagtggcggcggatccca

SEQ ID NO: 31679 - DNA, 20 bp, human
gcccagggccgaacagccaa

SEQ ID NO: 31680 - DNA, 20 bp, human
gggcggctcgcggcacagag

SEQ ID NO: 31681 - DNA, 20 bp, human
gccccgcagcccagacccct

SEQ ID NO: 31682 - DNA, 20 bp, human
ggcacagagcggtctgatcg

SEQ ID NO: 31683 - DNA, 20 bp, human
ggagcggtctgatcgcggag

SEQ ID NO: 31684 - DNA, 20 bp, human
gccgaggtgggttctgaagg

SEQ ID NO: 31685 - DNA, 20 bp, human
gacggcaccagggagaactg

SEQ ID NO: 31686 - DNA, 20 bp, human
gcccgaggcgaggcgaagag

SEQ ID NO: 31687 - DNA, 20 bp, human
gatgcaagtccgggtctcag

SEQ ID NO: 31688 - DNA, 20 bp, human
gggcgaccggatgcaagtcc

SEQ ID NO: 31689 - DNA, 20 bp, human
ggcggccgacccgacaccag

SEQ ID NO: 31690 - DNA, 20 bp, human
gggggagctcaggagactgc

SEQ ID NO: 31691 - DNA, 20 bp, human
gtcagcggccggcagacgtg

SEQ ID NO: 31692 - DNA, 20 bp, human
gggcgaggcgaagagaggcg

SEQ ID NO: 31693 - DNA, 20 bp, human
gtcctccggggaacaggcgg

SEQ ID NO: 31694 - DNA, 20 bp, human
gcacacgcaaggagcgaacg

SEQ ID NO: 31695 - DNA, 20 bp, human
gctctcctccggggaacagg

SEQ ID NO: 31696 - DNA, 20 bp, human
gagatggagactccctaagg

SEQ ID NO: 31697 - DNA, 20 bp, human
gcccagatggagactcccta

SEQ ID NO: 31698 - DNA, 20 bp, human
gcaacctgagctggccgagg

SEQ ID NO: 31699 - DNA, 20 bp, human
gccgctccctcccgggcacg

SEQ ID NO: 31700 - DNA, 20 bp, human
gcgccgggtataaggagcaa

SEQ ID NO: 31701 - DNA, 20 bp, human
gtaagcggaacggctcttaa

SEQ ID NO: 31702 - DNA, 20 bp, human
gttggagggaaataccggag

SEQ ID NO: 31703 - DNA, 20 bp, human
gcagaccccgcgccccctta

SEQ ID NO: 31704 - DNA, 20 bp, human
gctcacagcgcgtgtcctgg

SEQ ID NO: 31705 - DNA, 20 bp, human
gggttcagacgggagcccag

SEQ ID NO: 31706 - DNA, 20 bp, human
gcaaggcgaggcggaaagat

SEQ ID NO: 31707 - DNA, 20 bp, human
ggccttgtagacgtgaccgt

SEQ ID NO: 31708 - DNA, 20 bp, human
gacctacggtcacgtctaca

SEQ ID NO: 31709 - DNA, 20 bp, human
gcccaccaggttccaaaaca

SEQ ID NO: 31710 - DNA, 20 bp, human
gaagggtgcaaagtgggacg

SEQ ID NO: 31711 - DNA, 20 bp, human
ggctcgaggaagccacggcg

SEQ ID NO: 31712 - DNA, 20 bp, human
gtccggacaccgactccgag

SEQ ID NO: 31713 - DNA, 20 bp, human
gtcacgtctacaaggcgagg

SEQ ID NO: 31714 - DNA, 20 bp, human
gaagtgggacgcggcaccta

SEQ ID NO: 31715 - DNA, 20 bp, human
gagtacgaagggtgcaaagt

SEQ ID NO: 31716 - DNA, 20 bp, human
gcggtcgggaactcggtggg

SEQ ID NO: 31717 - DNA, 20 bp, human
gtggcggtcgggaactcggt

SEQ ID NO: 31718 - DNA, 20 bp, human
gccgtggccccgggtcggga

SEQ ID NO: 31719 - DNA, 20 bp, human
gactccctggggagagtata

SEQ ID NO: 31720 - DNA, 20 bp, human
gtcgggaactcggtgggagg

SEQ ID NO: 31721 - DNA, 20 bp, human
ggaaacagggcccagtaccg

SEQ ID NO: 31722 - DNA, 20 bp, human
gtctttagaagtggagaggt

SEQ ID NO: 31723 - DNA, 20 bp, human
gtgggttgggggccagtaga

SEQ ID NO: 31724 - DNA, 20 bp, human
gccaaattgacaagagcgag

SEQ ID NO: 31725 - DNA, 20 bp, human
gcgacccggggccacggtac

SEQ ID NO: 31726 - DNA, 20 bp, human
ggcgagctcagatcagcgtg

SEQ ID NO: 31727 - DNA, 20 bp, human
ggtggagtttggaagttcag

SEQ ID NO: 31728 - DNA, 20 bp, human
gagctcagatcagcgtgggg

SEQ ID NO: 31729 - DNA, 20 bp, human
gggccagaggccctcctcgg

SEQ ID NO: 31730 - DNA, 20 bp, human
gagtcctagacccccgagga

SEQ ID NO: 31731 - DNA, 20 bp, human
ggcttggtcccctaccccag

SEQ ID NO: 31732 - DNA, 20 bp, human
gcgccagtctgcaggataga

SEQ ID NO: 31733 - DNA, 20 bp, human
ggcgcggcagctgaccactg

SEQ ID NO: 31734 - DNA, 20 bp, human
gggctagtcctagacccccg

SEQ ID NO: 31735 - DNA, 20 bp, human
gtagagcgttagccggaggg

SEQ ID NO: 31736 - DNA, 20 bp, human
ggcgggctcgggaatcatgg

SEQ ID NO: 31737 - DNA, 20 bp, human
gggctcgggaatcatggcgg

SEQ ID NO: 31738 - DNA, 20 bp, human
gggcgcgggctcgggaatca

SEQ ID NO: 31739 - DNA, 20 bp, human
gtcgcacgcggctcactcac

SEQ ID NO: 31740 - DNA, 20 bp, human
gcgggccgcgccggcaaata

SEQ ID NO: 31741 - DNA, 20 bp, human
gcgccgccgcagtctcaccc

SEQ ID NO: 31742 - DNA, 20 bp, human
gcgcccctgcgccgcacccg

SEQ ID NO: 31743 - DNA, 20 bp, human
ggcgcaccagagaactttcg

SEQ ID NO: 31744 - DNA, 20 bp, human
gtgtaagacatccccccggg

SEQ ID NO: 31745 - DNA, 20 bp, human
gcactcaccggcgttgaggg

SEQ ID NO: 31746 - DNA, 20 bp, human
gtcgcgccgaggggtcttcc

SEQ ID NO: 31747 - DNA, 20 bp, human
gccagccggccgctcctcgg

SEQ ID NO: 31748 - DNA, 20 bp, human
ggaagcgcgcaaggcaccgg

SEQ ID NO: 31749 - DNA, 20 bp, human
gggagaagcgcgcaaggcac

SEQ ID NO: 31750 - DNA, 20 bp, human
ggcagccaacccccgaggag

SEQ ID NO: 31751 - DNA, 20 bp, human
gcccctgctgggccgaaact

SEQ ID NO: 31752 - DNA, 20 bp, human
gagtgggcgtggtcacgtaa

SEQ ID NO: 31753 - DNA, 20 bp, human
gcaatcagagcgcggctgag

SEQ ID NO: 31754 - DNA, 20 bp, human
ggcacgcccctggtaaatag

SEQ ID NO: 31755 - DNA, 20 bp, human
gctgggggccgaaggacgca

SEQ ID NO: 31756 - DNA, 20 bp, human
gacagcggcccagacagagg

SEQ ID NO: 31757 - DNA, 20 bp, human
ggacatcgccccctctgtct

SEQ ID NO: 31758 - DNA, 20 bp, human
gaccggccccagccacgacg

SEQ ID NO: 31759 - DNA, 20 bp, human
gagggccacggagaaagaag

SEQ ID NO: 31760 - DNA, 20 bp, human
gtttggcgcgtgagtgacag

SEQ ID NO: 31761 - DNA, 20 bp, human
gctccgaaatgagagtggtc

SEQ ID NO: 31762 - DNA, 20 bp, human
gaggccgcggggtaagaggg

SEQ ID NO: 31763 - DNA, 20 bp, human
gtcatttcggagaggcctag

SEQ ID NO: 31764 - DNA, 20 bp, human
gggcctctccgaaatgagag

SEQ ID NO: 31765 - DNA, 20 bp, human
gggcgacgcctagaacaggt

SEQ ID NO: 31766 - DNA, 20 bp, human
gccggagcagctggacgcag

SEQ ID NO: 31767 - DNA, 20 bp, human
gcatacacccgagctcggtc

SEQ ID NO: 31768 - DNA, 20 bp, human
gcacaggccgcaagctagag

SEQ ID NO: 31769 - DNA, 20 bp, human
gagcttgcggcctgtgtcta

SEQ ID NO: 31770 - DNA, 20 bp, human
ggcggcctgtgtctatggtc

SEQ ID NO: 31771 - DNA, 20 bp, human
gtcgcgagctggttatggaa

SEQ ID NO: 31772 - DNA, 20 bp, human
gtctattgcagggcctcacg

SEQ ID NO: 31773 - DNA, 20 bp, human
gagggcctcacgtggctgga

SEQ ID NO: 31774 - DNA, 20 bp, human
ggccccggagccggttccta

SEQ ID NO: 31775 - DNA, 20 bp, human
ggctgctccggaccgagctc

SEQ ID NO: 31776 - DNA, 20 bp, human
gtaaaaccgagggcccgcag

SEQ ID NO: 31777 - DNA, 20 bp, human
gcaggctccgatctcagcag

SEQ ID NO: 31778 - DNA, 20 bp, human
gtgaaggcggtgctccggaa

SEQ ID NO: 31779 - DNA, 20 bp, human
gaggtctgcagcaagaaacg

SEQ ID NO: 31780 - DNA, 20 bp, human
ggccagagtcttaaaaccga

SEQ ID NO: 31781 - DNA, 20 bp, human
gggccccggcgttgcagagg

SEQ ID NO: 31782 - DNA, 20 bp, human
ggcggtgctccggaagggtc

SEQ ID NO: 31783 - DNA, 20 bp, human
gaaatagtgaggaggggtct

SEQ ID NO: 31784 - DNA, 20 bp, human
gtctggccccggcgttgcag

SEQ ID NO: 31785 - DNA, 20 bp, human
gaggggctgcagaaatattg

SEQ ID NO: 31786 - DNA, 20 bp, human
gtcggcagagttgggttgcg

SEQ ID NO: 31787 - DNA, 20 bp, human
ggcgggcgccgaggactctc

SEQ ID NO: 31788 - DNA, 20 bp, human
gggcgccgaggactctccgg

SEQ ID NO: 31789 - DNA, 20 bp, human
gccggccgccggagagtcct

SEQ ID NO: 31790 - DNA, 20 bp, human
ggccccgcgtcggcagagtt

SEQ ID NO: 31791 - DNA, 20 bp, human
gctcgagctgaggacaccaa

SEQ ID NO: 31792 - DNA, 20 bp, human
gcgcccagcgcaggcttacc

SEQ ID NO: 31793 - DNA, 20 bp, human
ggagcgggcggcgagctgtg

SEQ ID NO: 31794 - DNA, 20 bp, human
ggcacggtgcgggtaggacg

SEQ ID NO: 31795 - DNA, 20 bp, human
gtgcggtgcctgcagaacct

SEQ ID NO: 31796 - DNA, 20 bp, human
gggggaaggtggctgctagg

SEQ ID NO: 31797 - DNA, 20 bp, human
gctgcccgaggagaagaaga

SEQ ID NO: 31798 - DNA, 20 bp, human
gcacccaagccggcatccac

SEQ ID NO: 31799 - DNA, 20 bp, human
ggttgcgttgctggaccagg

SEQ ID NO: 31800 - DNA, 20 bp, human
gagggccgggatccccccga

SEQ ID NO: 31801 - DNA, 20 bp, human
gcccggggctgcagtagcag

SEQ ID NO: 31802 - DNA, 20 bp, human
gggcccgtggatgccggctt

SEQ ID NO: 31803 - DNA, 20 bp, human
ggccgggatccccccgacgg

SEQ ID NO: 31804 - DNA, 20 bp, human
ggcgagaaccttctccgcaa

SEQ ID NO: 31805 - DNA, 20 bp, human
ggtgagcgccgagatgagca

SEQ ID NO: 31806 - DNA, 20 bp, human
ggcaagtcggatcccctcac

SEQ ID NO: 31807 - DNA, 20 bp, human
gcgcttgtgtatgaacgcag

SEQ ID NO: 31808 - DNA, 20 bp, human
gcgcagcggcggacctgtga

SEQ ID NO: 31809 - DNA, 20 bp, human
gcccgcagcgtaagttctgc

SEQ ID NO: 31810 - DNA, 20 bp, human
ggtaagttctgccggcaagt

SEQ ID NO: 31811 - DNA, 20 bp, human
ggcagcagcaacagtgcccg

SEQ ID NO: 31812 - DNA, 20 bp, human
ggcctgaagtagcggcggaa

SEQ ID NO: 31813 - DNA, 20 bp, human
gacccggcctgaagtagcgg

SEQ ID NO: 31814 - DNA, 20 bp, human
ggccggcagaacttacgctg

SEQ ID NO: 31815 - DNA, 20 bp, human
gtggctggttacaatgcgtt

SEQ ID NO: 31816 - DNA, 20 bp, human
ggatacagcttagatcaaaa

SEQ ID NO: 31817 - DNA, 20 bp, human
gtccttaaataaaaattcat

SEQ ID NO: 31818 - DNA, 20 bp, human
ggtgtgtgtgtgtaaagact

SEQ ID NO: 31819 - DNA, 20 bp, human
gcacacacacacgggcaaca

SEQ ID NO: 31820 - DNA, 20 bp, human
gcacacacatgcacacacct

SEQ ID NO: 31821 - DNA, 20 bp, human
gcactgcaactcaaattcct

SEQ ID NO: 31822 - DNA, 20 bp, human
ggcctatgaatttttattta

SEQ ID NO: 31823 - DNA, 20 bp, human
gcacacacaaacacacacct

SEQ ID NO: 31824 - DNA, 20 bp, human
ggtttgtgtgtgtagagact

SEQ ID NO: 31825 - DNA, 20 bp, human
ggtgtgtgtgtgtagggact

SEQ ID NO: 31826 - DNA, 20 bp, human
ggaagcgccgggaaagatgg

SEQ ID NO: 31827 - DNA, 20 bp, human
ggaagaagcgccgggaaaga

SEQ ID NO: 31828 - DNA, 20 bp, human
ggctcttgttcagactctgg

SEQ ID NO: 31829 - DNA, 20 bp, human
gccagctcttgttcagactc

SEQ ID NO: 31830 - DNA, 20 bp, human
gagccctccagagtgtcagg

SEQ ID NO: 31831 - DNA, 20 bp, human
ggcaattgtggtgcaggtcg

SEQ ID NO: 31832 - DNA, 20 bp, human
gccaccacctgacactctgg

SEQ ID NO: 31833 - DNA, 20 bp, human
gttcccggcgcttcttccta

SEQ ID NO: 31834 - DNA, 20 bp, human
gcttcggagagggtctctgg

SEQ ID NO: 31835 - DNA, 20 bp, human
ggaccccgcctcgtttccgt

SEQ ID NO: 31836 - DNA, 20 bp, human
ggagtcgagatgctgaccac

SEQ ID NO: 31837 - DNA, 20 bp, human
gggagggagaccggagacac

SEQ ID NO: 31838 - DNA, 20 bp, human
gagcaggtctggccacagat

SEQ ID NO: 31839 - DNA, 20 bp, human
ggctatcagggaagcaggtc

SEQ ID NO: 31840 - DNA, 20 bp, human
gcctggcgggaaacacggtg

SEQ ID NO: 31841 - DNA, 20 bp, human
gctccacttccgcttcaggc

SEQ ID NO: 31842 - DNA, 20 bp, human
ggggcatagaacgaggccag

SEQ ID NO: 31843 - DNA, 20 bp, human
gcaagctgctcggtaggagg

SEQ ID NO: 31844 - DNA, 20 bp, human
gacagatggggcatagaacg

SEQ ID NO: 31845 - DNA, 20 bp, human
gagaccggagacacaggtta

SEQ ID NO: 31846 - DNA, 20 bp, human
ggggggctgcgagtgtcagt

SEQ ID NO: 31847 - DNA, 20 bp, human
gagcaggtaatcagactctg

SEQ ID NO: 31848 - DNA, 20 bp, human
ggcgaggccgcggacacgtg

SEQ ID NO: 31849 - DNA, 20 bp, human
gcgcgtcgggcctcccgagg

SEQ ID NO: 31850 - DNA, 20 bp, human
gccctcgccggagagagtgc

SEQ ID NO: 31851 - DNA, 20 bp, human
ggggtccgaggcagaactgt

SEQ ID NO: 31852 - DNA, 20 bp, human
gtgacactcgcagccccctc

SEQ ID NO: 31853 - DNA, 20 bp, human
gggctctccgcacgtgtccg

SEQ ID NO: 31854 - DNA, 20 bp, human
gtacctgctccgcgaggccg

SEQ ID NO: 31855 - DNA, 20 bp, human
gcgactgggcccctcaggtg

SEQ ID NO: 31856 - DNA, 20 bp, human
gtcgcgcggagaggttgcag

SEQ ID NO: 31857 - DNA, 20 bp, human
ggccgctcgctcatccccga

SEQ ID NO: 31858 - DNA, 20 bp, human
gcccctcggggatgagcgag

SEQ ID NO: 31859 - DNA, 20 bp, human
gaagccgtcttcgcgcggag

SEQ ID NO: 31860 - DNA, 20 bp, human
gggagtctggaggaaccccg

SEQ ID NO: 31861 - DNA, 20 bp, human
gagacggcttcagccctgca

SEQ ID NO: 31862 - DNA, 20 bp, human
ggaggttgcaggggcccctc

SEQ ID NO: 31863 - DNA, 20 bp, human
gggcgcgggacgcagtggaa

SEQ ID NO: 31864 - DNA, 20 bp, human
gggatggagagacctccccg

SEQ ID NO: 31865 - DNA, 20 bp, human
gtgcaggcggagtttcgcgg

SEQ ID NO: 31866 - DNA, 20 bp, human
gctctctggaaggacgggga

SEQ ID NO: 31867 - DNA, 20 bp, human
gggcggggatactaaagcga

SEQ ID NO: 31868 - DNA, 20 bp, human
ggcccgactccagccgaaaa

SEQ ID NO: 31869 - DNA, 20 bp, human
ggagcccggtggacggaagt

SEQ ID NO: 31870 - DNA, 20 bp, human
gttcctgagcagactcgcgg

SEQ ID NO: 31871 - DNA, 20 bp, human
gccgaaaagggcgagctccc

SEQ ID NO: 31872 - DNA, 20 bp, human
ggcggcggctggaaacgtgg

SEQ ID NO: 31873 - DNA, 20 bp, human
gtccacgggaaaacccgcaa

SEQ ID NO: 31874 - DNA, 20 bp, human
ggaggctctctggaaggacg

SEQ ID NO: 31875 - DNA, 20 bp, human
gagcgacggagcccggtgga

SEQ ID NO: 31876 - DNA, 20 bp, human
gaacgcgcggccggagagag

SEQ ID NO: 31877 - DNA, 20 bp, human
gggaggtaccggctgttgtg

SEQ ID NO: 31878 - DNA, 20 bp, human
ggtacctcctcaaagagagg

SEQ ID NO: 31879 - DNA, 20 bp, human
gcccatacactcaaacagaa

SEQ ID NO: 31880 - DNA, 20 bp, human
gggcagagccgcacaacagc

SEQ ID NO: 31881 - DNA, 20 bp, human
gagcaccagcccgactgatg

SEQ ID NO: 31882 - DNA, 20 bp, human
gaaggagagccgagggacga

SEQ ID NO: 31883 - DNA, 20 bp, human
gtagagcgggcgggttcccg

SEQ ID NO: 31884 - DNA, 20 bp, human
gcccggcgaaggagagccga

SEQ ID NO: 31885 - DNA, 20 bp, human
gcggcgggcgtagagcgggc

SEQ ID NO: 31886 - DNA, 20 bp, human
ggagatcccgctcccctcac

SEQ ID NO: 31887 - DNA, 20 bp, human
gtctcgggccgtctcctagt

SEQ ID NO: 31888 - DNA, 20 bp, human
ggggctgggctaggtaccca

SEQ ID NO: 31889 - DNA, 20 bp, human
ggcagagaggcgcccgtgag

SEQ ID NO: 31890 - DNA, 20 bp, human
gcggcggcagcagcgactgg

SEQ ID NO: 31891 - DNA, 20 bp, human
gggaagagccgactaggaga

SEQ ID NO: 31892 - DNA, 20 bp, human
gtccaagggacgcccaagtg

SEQ ID NO: 31893 - DNA, 20 bp, human
gagcctgaggcccgtggtgg

SEQ ID NO: 31894 - DNA, 20 bp, human
ggacggcccgagagcccagg

SEQ ID NO: 31895 - DNA, 20 bp, human
ggacgcccaagtgaggagaa

SEQ ID NO: 31896 - DNA, 20 bp, human
gtgcagcttccggagagtgg

SEQ ID NO: 31897 - DNA, 20 bp, human
gctgtgcagcttccggagag

SEQ ID NO: 31898 - DNA, 20 bp, human
gaaatcaacccgccactctc

SEQ ID NO: 31899 - DNA, 20 bp, human
ggcttccaggagcgaggata

SEQ ID NO: 31900 - DNA, 20 bp, human
ggccacccttacccagaagt

SEQ ID NO: 31901 - DNA, 20 bp, human
ggagcatgcgcaaataaacg

SEQ ID NO: 31902 - DNA, 20 bp, human
gattcactaaggtataaagt

SEQ ID NO: 31903 - DNA, 20 bp, human
gcatgcgcaaataaacgtgg

SEQ ID NO: 31904 - DNA, 20 bp, human
gaagctgcacagactttaga

SEQ ID NO: 31905 - DNA, 20 bp, human
gcaggtgccgctctccagtt

SEQ ID NO: 31906 - DNA, 20 bp, human
gcacgccgagccgagctggg

SEQ ID NO: 31907 - DNA, 20 bp, human
gcgccgcggcggtcagggac

SEQ ID NO: 31908 - DNA, 20 bp, human
gggcccgtccctgaccgccg

SEQ ID NO: 31909 - DNA, 20 bp, human
gcacggcgccgcggcggtca

SEQ ID NO: 31910 - DNA, 20 bp, human
gtgggcggaagaaggcgagg

SEQ ID NO: 31911 - DNA, 20 bp, human
gctcggcccgcgatccctat

SEQ ID NO: 31912 - DNA, 20 bp, human
ggcgggagccggttcccata

SEQ ID NO: 31913 - DNA, 20 bp, human
gccccgcccaggcagacccg

SEQ ID NO: 31914 - DNA, 20 bp, human
gactggaggcagctaactct

SEQ ID NO: 31915 - DNA, 20 bp, human
ggctggctggagtacgggga

SEQ ID NO: 31916 - DNA, 20 bp, human
gcgcccaggggtagttggag

SEQ ID NO: 31917 - DNA, 20 bp, human
gtcgtaaggcgcccagtacc

SEQ ID NO: 31918 - DNA, 20 bp, human
gcaccgctccaactacccct

SEQ ID NO: 31919 - DNA, 20 bp, human
gggccaacgccttcgcccag

SEQ ID NO: 31920 - DNA, 20 bp, human
gcgccttacgagctgggagg

SEQ ID NO: 31921 - DNA, 20 bp, human
gtcactctgtccccaaccat

SEQ ID NO: 31922 - DNA, 20 bp, human
gcaccacctcccagctcgta

SEQ ID NO: 31923 - DNA, 20 bp, human
gttcccaggctccaggtact

SEQ ID NO: 31924 - DNA, 20 bp, human
gtacccctgggcgaaggcgt

SEQ ID NO: 31925 - DNA, 20 bp, human
gttcgcatagaaagacccaa

SEQ ID NO: 31926 - DNA, 20 bp, human
gctgtgaagcgggtttaaga

SEQ ID NO: 31927 - DNA, 20 bp, human
gagcgggtttaagagggtga

SEQ ID NO: 31928 - DNA, 20 bp, human
gaatggtactcccccaccat

SEQ ID NO: 31929 - DNA, 20 bp, human
gcccaccataggcaagtccc

SEQ ID NO: 31930 - DNA, 20 bp, human
ggccactgaaccaaccagag

SEQ ID NO: 31931 - DNA, 20 bp, human
gtaaacccgcttcacagacc

SEQ ID NO: 31932 - DNA, 20 bp, human
gaggatcgcacgatcttcta

SEQ ID NO: 31933 - DNA, 20 bp, human
ggtcacgtgagcgcctcgcc

SEQ ID NO: 31934 - DNA, 20 bp, human
gtcccctctggttggttcag

SEQ ID NO: 31935 - DNA, 20 bp, human
gcctatgacgcgtttagaac

SEQ ID NO: 31936 - DNA, 20 bp, human
gtacatctccattttcaagc

SEQ ID NO: 31937 - DNA, 20 bp, human
gtaaaagcccagcttgaaaa

SEQ ID NO: 31938 - DNA, 20 bp, human
gtccgccggcgtttccatgg

SEQ ID NO: 31939 - DNA, 20 bp, human
ggtgcgcaagaccggaacat

SEQ ID NO: 31940 - DNA, 20 bp, human
gtagaacgcagcaactccgc

SEQ ID NO: 31941 - DNA, 20 bp, human
gcctaagttctggtgagagg

SEQ ID NO: 31942 - DNA, 20 bp, human
gcttgccaccatggaaacgc

SEQ ID NO: 31943 - DNA, 20 bp, human
gaagtggccggttccttgcg

SEQ ID NO: 31944 - DNA, 20 bp, human
gtgagtaaggtgtccttctg

SEQ ID NO: 31945 - DNA, 20 bp, human
ggccaccatggaaacgccgg

SEQ ID NO: 31946 - DNA, 20 bp, human
gactggagaagggtcttatg

SEQ ID NO: 31947 - DNA, 20 bp, human
gggggcgagcgtaaacactg

SEQ ID NO: 31948 - DNA, 20 bp, human
gtatttggagggatatccag

SEQ ID NO: 31949 - DNA, 20 bp, human
gacagctactacttgtccag

SEQ ID NO: 31950 - DNA, 20 bp, human
gattagctaagactggagaa

SEQ ID NO: 31951 - DNA, 20 bp, human
gttggagggatatccagagg

SEQ ID NO: 31952 - DNA, 20 bp, human
gcactggggtgagtggactt

SEQ ID NO: 31953 - DNA, 20 bp, human
gggaatttaagtccaatggg

SEQ ID NO: 31954 - DNA, 20 bp, human
gggtaggggaagtatttgga

SEQ ID NO: 31955 - DNA, 20 bp, human
gaatgcagaaacaaaacctc

SEQ ID NO: 31956 - DNA, 20 bp, human
ggccgctttaccttccccag

SEQ ID NO: 31957 - DNA, 20 bp, human
gggtcccctgctagaagtgg

SEQ ID NO: 31958 - DNA, 20 bp, human
gccgcggcacgagctccccg

SEQ ID NO: 31959 - DNA, 20 bp, human
gagtcccccacttctagcag

SEQ ID NO: 31960 - DNA, 20 bp, human
gggagctcgtgccgcgggag

SEQ ID NO: 31961 - DNA, 20 bp, human
gaagcggcgacggcgtcctc

SEQ ID NO: 31962 - DNA, 20 bp, human
gtcgggggaagcccttccag

SEQ ID NO: 31963 - DNA, 20 bp, human
gctagaagtgggggactcgg

SEQ ID NO: 31964 - DNA, 20 bp, human
gtacctcgccgcaagccccg

SEQ ID NO: 31965 - DNA, 20 bp, human
gtggggtcccctgctagaag

SEQ ID NO: 31966 - DNA, 20 bp, human
ggcaccgaggcactcagagg

SEQ ID NO: 31967 - DNA, 20 bp, human
ggcccagctccggctccaca

SEQ ID NO: 31968 - DNA, 20 bp, human
ggcgaatccgcgcccagctc

SEQ ID NO: 31969 - DNA, 20 bp, human
gctcagaggaggtgagagag

SEQ ID NO: 31970 - DNA, 20 bp, human
gtccttgtggagccggagct

SEQ ID NO: 31971 - DNA, 20 bp, human
gcggattcgccgaggcaccg

SEQ ID NO: 31972 - DNA, 20 bp, human
gtggagccaaccgcagccaa

SEQ ID NO: 31973 - DNA, 20 bp, human
ggagcggcggcagacaacag

SEQ ID NO: 31974 - DNA, 20 bp, human
ggcccctggaaacccagctg

SEQ ID NO: 31975 - DNA, 20 bp, human
gacccagctggggcgaggga

SEQ ID NO: 31976 - DNA, 20 bp, human
gcaatatggcggtggaaggg

SEQ ID NO: 31977 - DNA, 20 bp, human
gattgggccactaaaaaaag

SEQ ID NO: 31978 - DNA, 20 bp, human
ggcccaatatggcggtggaa

SEQ ID NO: 31979 - DNA, 20 bp, human
ggaggcggtcgtgcagaccc

SEQ ID NO: 31980 - DNA, 20 bp, human
ggtccatccgctccaggcta

SEQ ID NO: 31981 - DNA, 20 bp, human
gaggggttcgggctgcgtag

SEQ ID NO: 31982 - DNA, 20 bp, human
gcacccgcccagactcggac

SEQ ID NO: 31983 - DNA, 20 bp, human
gagtcgctgggcttccgaga

SEQ ID NO: 31984 - DNA, 20 bp, human
ggcaaagcccgtccgagtct

SEQ ID NO: 31985 - DNA, 20 bp, human
gtagtggcccaatatggcgg

SEQ ID NO: 31986 - DNA, 20 bp, human
ggggcccgcgcgtataaagg

SEQ ID NO: 31987 - DNA, 20 bp, human
gagctagccagcaggcatcg

SEQ ID NO: 31988 - DNA, 20 bp, human
gtagccagcaggcatcgagg

SEQ ID NO: 31989 - DNA, 20 bp, human
gcggctacctggctgtccgg

SEQ ID NO: 31990 - DNA, 20 bp, human
gctggaagtcgtaatcccag

SEQ ID NO: 31991 - DNA, 20 bp, human
gtcgcacacgcagagtcggg

SEQ ID NO: 31992 - DNA, 20 bp, human
gccaagtgcgctgtgctcga

SEQ ID NO: 31993 - DNA, 20 bp, human
ggctggtgcgcactagtact

SEQ ID NO: 31994 - DNA, 20 bp, human
gctggccgagctgaacgccg

SEQ ID NO: 31995 - DNA, 20 bp, human
gggcgggctgggcgttccac

SEQ ID NO: 31996 - DNA, 20 bp, human
gtctagcccaggctaggagg

SEQ ID NO: 31997 - DNA, 20 bp, human
ggagtggcgctgctcacctc

SEQ ID NO: 31998 - DNA, 20 bp, human
gcctggaggcggcgagaaca

SEQ ID NO: 31999 - DNA, 20 bp, human
ggtgccaaagggcggcgcag

SEQ ID NO: 32000 - DNA, 20 bp, human
gcgccgccctttggcaccag

SEQ ID NO: 32001 - DNA, 20 bp, human
gcggctgccgagctcggccc

SEQ ID NO: 32002 - DNA, 20 bp, human
gcagccgctgcgccgccctt

SEQ ID NO: 32003 - DNA, 20 bp, human
ggctcacctctggtgccaaa

SEQ ID NO: 32004 - DNA, 20 bp, human
ggcacgcgcgccgaatccgg

SEQ ID NO: 32005 - DNA, 20 bp, human
gagtcgttgtaacccgaatg

SEQ ID NO: 32006 - DNA, 20 bp, human
gtggccagccagtcagccga

SEQ ID NO: 32007 - DNA, 20 bp, human
ggctgagaagatctgaaggg

SEQ ID NO: 32008 - DNA, 20 bp, human
gccagggcgtcgccaggagg

SEQ ID NO: 32009 - DNA, 20 bp, human
ggtcggaggccgatccaggt

SEQ ID NO: 32010 - DNA, 20 bp, human
gggatggcgggcgactctgg

SEQ ID NO: 32011 - DNA, 20 bp, human
gctggctggtcaccagaggg

SEQ ID NO: 32012 - DNA, 20 bp, human
gtggaggacgaagtttgcag

SEQ ID NO: 32013 - DNA, 20 bp, human
ggtaatcacagacctcctcc

SEQ ID NO: 32014 - DNA, 20 bp, human
gggccgatccaggtgggtag

SEQ ID NO: 32015 - DNA, 20 bp, human
gcatggagccttcggctgac

SEQ ID NO: 32016 - DNA, 20 bp, human
gcctgcggaggggcgttatc

SEQ ID NO: 32017 - DNA, 20 bp, human
gcgagagcgggacccgaaac

SEQ ID NO: 32018 - DNA, 20 bp, human
ggggacgctgcctcactcac

SEQ ID NO: 32019 - DNA, 20 bp, human
ggcgagcggccctgtcactg

SEQ ID NO: 32020 - DNA, 20 bp, human
gggtctttaggcctgcggag

SEQ ID NO: 32021 - DNA, 20 bp, human
gggcgaaccacgtcttcctc

SEQ ID NO: 32022 - DNA, 20 bp, human
gcggcgagactgacaaacac

SEQ ID NO: 32023 - DNA, 20 bp, human
ggcggaagtgggcggttcgg

SEQ ID NO: 32024 - DNA, 20 bp, human
gcacagctgcaccgggagac

SEQ ID NO: 32025 - DNA, 20 bp, human
gtcactgcggcctgcacccg

SEQ ID NO: 32026 - DNA, 20 bp, human
gcggcgggcaccatggtcgg

SEQ ID NO: 32027 - DNA, 20 bp, human
gaccatggtcggtggcgagg

SEQ ID NO: 32028 - DNA, 20 bp, human
ggctatccggtcctcggctg

SEQ ID NO: 32029 - DNA, 20 bp, human
gtctttccaaggggcctcca

SEQ ID NO: 32030 - DNA, 20 bp, human
gtcggctgcggcgggcacca

SEQ ID NO: 32031 - DNA, 20 bp, human
gcagcctaggaagagatggt

SEQ ID NO: 32032 - DNA, 20 bp, human
gtgggcccgggttcagtctg

SEQ ID NO: 32033 - DNA, 20 bp, human
ggcagtgcgcgtcgggaagg

SEQ ID NO: 32034 - DNA, 20 bp, human
gggcgcagtgcgcgtcggga

SEQ ID NO: 32035 - DNA, 20 bp, human
gcggcgggctatccggtcct

SEQ ID NO: 32036 - DNA, 20 bp, human
ggaatgcgcgaggagaacaa

SEQ ID NO: 32037 - DNA, 20 bp, human
gacaagggcatgcccagtgg

SEQ ID NO: 32038 - DNA, 20 bp, human
gaagccggcgcggatcccaa

SEQ ID NO: 32039 - DNA, 20 bp, human
gactctgccagagcgaggcg

SEQ ID NO: 32040 - DNA, 20 bp, human
ggcgacgcgtccgcaccctg

SEQ ID NO: 32041 - DNA, 20 bp, human
gccgcaccctgcggccagag

SEQ ID NO: 32042 - DNA, 20 bp, human
gcaagccgcagaaggacgac

SEQ ID NO: 32043 - DNA, 20 bp, human
ggccgcggcgcggggactag

SEQ ID NO: 32044 - DNA, 20 bp, human
ggccgagctcaaagccgctc

SEQ ID NO: 32045 - DNA, 20 bp, human
ggtgggggcggcagcgatga

SEQ ID NO: 32046 - DNA, 20 bp, human
ggcagcctggttaggagcaa

SEQ ID NO: 32047 - DNA, 20 bp, human
gccaggctgcatgatggcat

SEQ ID NO: 32048 - DNA, 20 bp, human
ggccatcatgcagcctggtt

SEQ ID NO: 32049 - DNA, 20 bp, human
gcggagactgacagaaggac

SEQ ID NO: 32050 - DNA, 20 bp, human
gggcatcggagactgacaga

SEQ ID NO: 32051 - DNA, 20 bp, human
gtgcaggttggtattaagag

SEQ ID NO: 32052 - DNA, 20 bp, human
ggaaggactgcgctgcaggt

SEQ ID NO: 32053 - DNA, 20 bp, human
gctagaaacccgggtcacgt

SEQ ID NO: 32054 - DNA, 20 bp, human
gtcgtcaggaccctaaagaa

SEQ ID NO: 32055 - DNA, 20 bp, human
ggttggtattaagagaggtg

SEQ ID NO: 32056 - DNA, 20 bp, human
gaaccggcaccctctctgag

SEQ ID NO: 32057 - DNA, 20 bp, human
ggtaggccaagttctgagta

SEQ ID NO: 32058 - DNA, 20 bp, human
ggacacgcaagtgcctgtag

SEQ ID NO: 32059 - DNA, 20 bp, human
ggagagtcgccgcagttccg

SEQ ID NO: 32060 - DNA, 20 bp, human
ggcccccacaaaaccgggaa

SEQ ID NO: 32061 - DNA, 20 bp, human
gcagaggcccccacaaaacc

SEQ ID NO: 32062 - DNA, 20 bp, human
gccacaaaaccgggaaagga

SEQ ID NO: 32063 - DNA, 20 bp, human
gctgatgaggtcggaaaaaa

SEQ ID NO: 32064 - DNA, 20 bp, human
gagcagggaccggcgatcta

SEQ ID NO: 32065 - DNA, 20 bp, human
gtgtgggggcctctggagat

SEQ ID NO: 32066 - DNA, 20 bp, human
gcccctggcggctgcctcag

SEQ ID NO: 32067 - DNA, 20 bp, human
gcccgcgggcggccgagggt

SEQ ID NO: 32068 - DNA, 20 bp, human
gcagaccccgcccggcgagg

SEQ ID NO: 32069 - DNA, 20 bp, human
ggtcttgccgaagcggttga

SEQ ID NO: 32070 - DNA, 20 bp, human
gggaggagggagggtgagtt

SEQ ID NO: 32071 - DNA, 20 bp, human
ggggagacccggcccccaag

SEQ ID NO: 32072 - DNA, 20 bp, human
gagaccagagaggagctctg

SEQ ID NO: 32073 - DNA, 20 bp, human
gagcgcagccgggtgcaccg

SEQ ID NO: 32074 - DNA, 20 bp, human
gggcgaccggctgagtgggg

SEQ ID NO: 32075 - DNA, 20 bp, human
gagacccggcccccaagggg

SEQ ID NO: 32076 - DNA, 20 bp, human
gtgcagcgccggcgactcac

SEQ ID NO: 32077 - DNA, 20 bp, human
gcggcactggtctcgacgtg

SEQ ID NO: 32078 - DNA, 20 bp, human
gcggggcaccggtgagtcgc

SEQ ID NO: 32079 - DNA, 20 bp, human
ggcgataccccagccccgaa

SEQ ID NO: 32080 - DNA, 20 bp, human
gagcgcccggccacccttcg

SEQ ID NO: 32081 - DNA, 20 bp, human
gataccccagccccgaaggg

SEQ ID NO: 32082 - DNA, 20 bp, human
gcccagcacgtccgactcac

SEQ ID NO: 32083 - DNA, 20 bp, human
gtcgcactgctaccaggcta

SEQ ID NO: 32084 - DNA, 20 bp, human
gcggtttcctcggtacaacg

SEQ ID NO: 32085 - DNA, 20 bp, human
ggactcaccggcttcatcgc

SEQ ID NO: 32086 - DNA, 20 bp, human
gtcagttgcgtcatttgtcc

SEQ ID NO: 32087 - DNA, 20 bp, human
gtgtggtggccttttgcgcc

SEQ ID NO: 32088 - DNA, 20 bp, human
gctcgctttggcagcttggt

SEQ ID NO: 32089 - DNA, 20 bp, human
gtggcagcttggtgggcggt

SEQ ID NO: 32090 - DNA, 20 bp, human
gcgggcctggtggtaacgtg

SEQ ID NO: 32091 - DNA, 20 bp, human
gttcagcagtaaaagctggt

SEQ ID NO: 32092 - DNA, 20 bp, human
gggctcgcgcaccacatgct

SEQ ID NO: 32093 - DNA, 20 bp, human
ggcgagcccagttgctgtgg

SEQ ID NO: 32094 - DNA, 20 bp, human
gggaagcagcagaatcaatc

SEQ ID NO: 32095 - DNA, 20 bp, human
gcgatctaaaacgagggaca

SEQ ID NO: 32096 - DNA, 20 bp, human
ggagagcgaccccaccgagt

SEQ ID NO: 32097 - DNA, 20 bp, human
ggtacattgcccactcggtg

SEQ ID NO: 32098 - DNA, 20 bp, human
gcaggcccctggcagcgcag

SEQ ID NO: 32099 - DNA, 20 bp, human
gctggcagcgcagtggatcc

SEQ ID NO: 32100 - DNA, 20 bp, human
gctcctcagacggggcgagt

SEQ ID NO: 32101 - DNA, 20 bp, human
gtcggtggggtcgctctcgt

SEQ ID NO: 32102 - DNA, 20 bp, human
gggcgatgaggtcaatgtag

SEQ ID NO: 32103 - DNA, 20 bp, human
gcgcggtgcacacacaaatc

SEQ ID NO: 32104 - DNA, 20 bp, human
ggcagcgcgctcacctgtac

SEQ ID NO: 32105 - DNA, 20 bp, human
ggtccattcctcctcagacg

SEQ ID NO: 32106 - DNA, 20 bp, human
gggctaggtgcgaggagacc

SEQ ID NO: 32107 - DNA, 20 bp, human
gccgaggacgcggaacgccg

SEQ ID NO: 32108 - DNA, 20 bp, human
gcgttccctggagggcgtgg

SEQ ID NO: 32109 - DNA, 20 bp, human
gtcttgacgatggtcctcgg

SEQ ID NO: 32110 - DNA, 20 bp, human
gcgggccggcgttccctgga

SEQ ID NO: 32111 - DNA, 20 bp, human
gagcggcgcctcgcacgccg

SEQ ID NO: 32112 - DNA, 20 bp, human
gaggtgcctccgagcccccg

SEQ ID NO: 32113 - DNA, 20 bp, human
gctccgagcccccgaggacg

SEQ ID NO: 32114 - DNA, 20 bp, human
ggaggaccatcgtcaagaag

SEQ ID NO: 32115 - DNA, 20 bp, human
gccttggcttaggggacggg

SEQ ID NO: 32116 - DNA, 20 bp, human
gggcggcggtgagttcgagg

SEQ ID NO: 32117 - DNA, 20 bp, human
ggcgagcgggaggcaccctg

SEQ ID NO: 32118 - DNA, 20 bp, human
gcggagccgtgggacgaggg

SEQ ID NO: 32119 - DNA, 20 bp, human
gacgcggagccgtgggacga

SEQ ID NO: 32120 - DNA, 20 bp, human
gcctgaggcagcgcagggaa

SEQ ID NO: 32121 - DNA, 20 bp, human
gccggcgtgcagaagagaag

SEQ ID NO: 32122 - DNA, 20 bp, human
ggagggcggcggtgagttcg

SEQ ID NO: 32123 - DNA, 20 bp, human
ggccttggacgcggagccgt

SEQ ID NO: 32124 - DNA, 20 bp, human
gggcaccctgaggcagcgca

SEQ ID NO: 32125 - DNA, 20 bp, human
ggcgctgcccgaggtcaggg

SEQ ID NO: 32126 - DNA, 20 bp, human
gctggaagacgtggagatgt

SEQ ID NO: 32127 - DNA, 20 bp, human
gacagagatgctggaagacg

SEQ ID NO: 32128 - DNA, 20 bp, human
gagccagttgatggaagact

SEQ ID NO: 32129 - DNA, 20 bp, human
gttggaagacatgaagatgc

SEQ ID NO: 32130 - DNA, 20 bp, human
gctggagatgctggaagacc

SEQ ID NO: 32131 - DNA, 20 bp, human
gttggaagacgagcagatgc

SEQ ID NO: 32132 - DNA, 20 bp, human
gtacttgtgtcttccaacaa

SEQ ID NO: 32133 - DNA, 20 bp, human
gtcggaagctatggatttga

SEQ ID NO: 32134 - DNA, 20 bp, human
gtggaagacctggaggccat

SEQ ID NO: 32135 - DNA, 20 bp, human
gtggaagactgggtagttgt

SEQ ID NO: 32136 - DNA, 20 bp, human
ggcggcggcgtgaagactgg

SEQ ID NO: 32137 - DNA, 20 bp, human
gccggcggcggcgtgaagac

SEQ ID NO: 32138 - DNA, 20 bp, human
gagtgccacgttgggcccgg

SEQ ID NO: 32139 - DNA, 20 bp, human
gtggcggctgcgtgagactc

SEQ ID NO: 32140 - DNA, 20 bp, human
ggccgccgccgggcccaacg

SEQ ID NO: 32141 - DNA, 20 bp, human
gcgcctaccgacggccccaa

SEQ ID NO: 32142 - DNA, 20 bp, human
ggccacgttgggcccggcgg

SEQ ID NO: 32143 - DNA, 20 bp, human
gaccaccaggacctccagca

SEQ ID NO: 32144 - DNA, 20 bp, human
gaccgacggccccaacggcc

SEQ ID NO: 32145 - DNA, 20 bp, human
gcggcgcagcggagtctggg

SEQ ID NO: 32146 - DNA, 20 bp, human
ggagaagtcctccatcccgg

SEQ ID NO: 32147 - DNA, 20 bp, human
gctccgccaagatgcagcgg

SEQ ID NO: 32148 - DNA, 20 bp, human
gaccgggacgtggagagagg

SEQ ID NO: 32149 - DNA, 20 bp, human
ggcggagaagtcctccatcc

SEQ ID NO: 32150 - DNA, 20 bp, human
gagccgccgctgcatcttgg

SEQ ID NO: 32151 - DNA, 20 bp, human
gtggcccgcccggcgacaac

SEQ ID NO: 32152 - DNA, 20 bp, human
ggagaagacgcggaccggac

SEQ ID NO: 32153 - DNA, 20 bp, human
gatgcggagagccgccggga

SEQ ID NO: 32154 - DNA, 20 bp, human
ggctctccgcatggccccgc

SEQ ID NO: 32155 - DNA, 20 bp, human
gggcgctatcaccccgggag

SEQ ID NO: 32156 - DNA, 20 bp, human
ggatgaaagagatcttgtat

SEQ ID NO: 32157 - DNA, 20 bp, human
gaacaggactctgatcacat

SEQ ID NO: 32158 - DNA, 20 bp, human
ggtttgcgaacagcacccag

SEQ ID NO: 32159 - DNA, 20 bp, human
gaacagcacccagtggacca

SEQ ID NO: 32160 - DNA, 20 bp, human
ggcagcagtgagcagtaatt

SEQ ID NO: 32161 - DNA, 20 bp, human
gtaattcgccttggtccact

SEQ ID NO: 32162 - DNA, 20 bp, human
ggttctcctctctcagaaac

SEQ ID NO: 32163 - DNA, 20 bp, human
gagagtcctgtttctgagag

SEQ ID NO: 32164 - DNA, 20 bp, human
gaagagagtataattcgcct

SEQ ID NO: 32165 - DNA, 20 bp, human
gtactgttttatccaacatt

SEQ ID NO: 32166 - DNA, 20 bp, human
ggaggcacagacacttggtg

SEQ ID NO: 32167 - DNA, 20 bp, human
gttgcgggggcggtgatttt

SEQ ID NO: 32168 - DNA, 20 bp, human
ggcggagccagagccagcat

SEQ ID NO: 32169 - DNA, 20 bp, human
ggcgccgtaaacagctcact

SEQ ID NO: 32170 - DNA, 20 bp, human
gtgtgcagctgcagccccaa

SEQ ID NO: 32171 - DNA, 20 bp, human
ggagattcaggagctcattg

SEQ ID NO: 32172 - DNA, 20 bp, human
gccagagccagcatgggaag

SEQ ID NO: 32173 - DNA, 20 bp, human
gttacttctgcacatggacc

SEQ ID NO: 32174 - DNA, 20 bp, human
ggtgctcttacttctgcaca

SEQ ID NO: 32175 - DNA, 20 bp, human
gctcctgaatctcctggaca

SEQ ID NO: 32176 - DNA, 20 bp, human
gctatgtctgcgtacggacc

SEQ ID NO: 32177 - DNA, 20 bp, human
ggtcgagccaaagccagcat

SEQ ID NO: 32178 - DNA, 20 bp, human
ggagattcgggagcccatgg

SEQ ID NO: 32179 - DNA, 20 bp, human
ggtgcagaggcagccccgat

SEQ ID NO: 32180 - DNA, 20 bp, human
gcatgtgtctgtgcctccat

SEQ ID NO: 32181 - DNA, 20 bp, human
ggtgctgctatgtctgcgta

SEQ ID NO: 32182 - DNA, 20 bp, human
gccttgtccaggaggagatt

SEQ ID NO: 32183 - DNA, 20 bp, human
gccacaaagtgagctggtta

SEQ ID NO: 32184 - DNA, 20 bp, human
gatagcagcacttgcggcac

SEQ ID NO: 32185 - DNA, 20 bp, human
ggggctcccgaatctcctcc

SEQ ID NO: 32186 - DNA, 20 bp, human
gccccagagagggaagtcga

SEQ ID NO: 32187 - DNA, 20 bp, human
ggaagtgggattgagagcac

SEQ ID NO: 32188 - DNA, 20 bp, human
ggagcttgttggcaagggtt

SEQ ID NO: 32189 - DNA, 20 bp, human
gggattgggtgaccaggatt

SEQ ID NO: 32190 - DNA, 20 bp, human
gaaatcagaatcctaggaat

SEQ ID NO: 32191 - DNA, 20 bp, human
gacactgggtgtccccagag

SEQ ID NO: 32192 - DNA, 20 bp, human
gcagtctgggccagaacact

SEQ ID NO: 32193 - DNA, 20 bp, human
ggccagaagtcaggagtgaa

SEQ ID NO: 32194 - DNA, 20 bp, human
gacaagctcgtcccattcct

SEQ ID NO: 32195 - DNA, 20 bp, human
gcagccaagatagtgcagga

SEQ ID NO: 32196 - DNA, 20 bp, human
ggcaccagcgacaaagtaag

SEQ ID NO: 32197 - DNA, 20 bp, human
gacgcgcacctggcaaccgg

SEQ ID NO: 32198 - DNA, 20 bp, human
ggcgccggtcacctccaaaa

SEQ ID NO: 32199 - DNA, 20 bp, human
gaagtaagtggagccgagag

SEQ ID NO: 32200 - DNA, 20 bp, human
ggcgcgggagcggaagatgt

SEQ ID NO: 32201 - DNA, 20 bp, human
gcggcgacaccgcttccctg

SEQ ID NO: 32202 - DNA, 20 bp, human
gcggcggccgctctatggtg

SEQ ID NO: 32203 - DNA, 20 bp, human
gacgcggccccaccatagag

SEQ ID NO: 32204 - DNA, 20 bp, human
ggtgcttgaggaggccgcca

SEQ ID NO: 32205 - DNA, 20 bp, human
gggagccgcagccactaacg

SEQ ID NO: 32206 - DNA, 20 bp, human
ggaaagggcggtgacggcac

SEQ ID NO: 32207 - DNA, 20 bp, human
ggcgcaggaaggagcttctc

SEQ ID NO: 32208 - DNA, 20 bp, human
ggaaggcctcacggagttgg

SEQ ID NO: 32209 - DNA, 20 bp, human
ggactgaagtggctcccccg

SEQ ID NO: 32210 - DNA, 20 bp, human
gccacccgaggacaaggtag

SEQ ID NO: 32211 - DNA, 20 bp, human
ggagctagcagcgaagccgc

SEQ ID NO: 32212 - DNA, 20 bp, human
gggaggcgcgcggctctgag

SEQ ID NO: 32213 - DNA, 20 bp, human
ggctagctcgcggcgacgtc

SEQ ID NO: 32214 - DNA, 20 bp, human
ggcagcgaagccgccggagc

SEQ ID NO: 32215 - DNA, 20 bp, human
gatgcagagccttcttaggg

SEQ ID NO: 32216 - DNA, 20 bp, human
gaggccgtgcagtccgagat

SEQ ID NO: 32217 - DNA, 20 bp, human
gctggatggggcgtgtgggt

SEQ ID NO: 32218 - DNA, 20 bp, human
gtgcacggcctcctgactga

SEQ ID NO: 32219 - DNA, 20 bp, human
gtccgagatgggctcgtctc

SEQ ID NO: 32220 - DNA, 20 bp, human
gcaccctggatggggcgtgt

SEQ ID NO: 32221 - DNA, 20 bp, human
gcgtctcgggcaccctggat

SEQ ID NO: 32222 - DNA, 20 bp, human
gctgaggcgaccatacagtg

SEQ ID NO: 32223 - DNA, 20 bp, human
ggtgggtgggcacgggatga

SEQ ID NO: 32224 - DNA, 20 bp, human
gcagagtctagcatataaaa

SEQ ID NO: 32225 - DNA, 20 bp, human
ggcccgagacgagcccatct

SEQ ID NO: 32226 - DNA, 20 bp, human
gacgcggcgctgctccatgg

SEQ ID NO: 32227 - DNA, 20 bp, human
gcggcggcgcgcgaagaagt

SEQ ID NO: 32228 - DNA, 20 bp, human
gatgagcaggaggcactggg

SEQ ID NO: 32229 - DNA, 20 bp, human
gggcccagcgagcctgtcag

SEQ ID NO: 32230 - DNA, 20 bp, human
ggtgacgcggcgctgctcca

SEQ ID NO: 32231 - DNA, 20 bp, human
gccctggaaggagcagacct

SEQ ID NO: 32232 - DNA, 20 bp, human
gcgcgaagaagtcggtgacg

SEQ ID NO: 32233 - DNA, 20 bp, human
gacggggcgcagggaactct

SEQ ID NO: 32234 - DNA, 20 bp, human
gtgtcggtggacgaggtgag

SEQ ID NO: 32235 - DNA, 20 bp, human
gtccatggcggcggagtgcg

SEQ ID NO: 32236 - DNA, 20 bp, human
ggagagtgctcggctagcag

SEQ ID NO: 32237 - DNA, 20 bp, human
gcatggctgagacggaggag

SEQ ID NO: 32238 - DNA, 20 bp, human
gcggcctcctcgacccggat

SEQ ID NO: 32239 - DNA, 20 bp, human
ggaggccatggctgagacgg

SEQ ID NO: 32240 - DNA, 20 bp, human
ggcactctcgccagaacctc

SEQ ID NO: 32241 - DNA, 20 bp, human
gccacccatccgggtcgagg

SEQ ID NO: 32242 - DNA, 20 bp, human
ggcgtgcgcggcgagacggg

SEQ ID NO: 32243 - DNA, 20 bp, human
gaaaggcacgcgcgagccag

SEQ ID NO: 32244 - DNA, 20 bp, human
gtggcgagcccagcccgagg

SEQ ID NO: 32245 - DNA, 20 bp, human
gacgcgcgagccagaggttc

SEQ ID NO: 32246 - DNA, 20 bp, human
gtgcgccgcatccactcgta

SEQ ID NO: 32247 - DNA, 20 bp, human
ggagcggttgctcgtcgtcg

SEQ ID NO: 32248 - DNA, 20 bp, human
gccggcaccgggctaaagtc

SEQ ID NO: 32249 - DNA, 20 bp, human
ggtcctcgcccggagcgcag

SEQ ID NO: 32250 - DNA, 20 bp, human
ggaggccgacgccctacgag

SEQ ID NO: 32251 - DNA, 20 bp, human
gagaagtcggggtactgcgg

SEQ ID NO: 32252 - DNA, 20 bp, human
ggacgccctacgagtggatg

SEQ ID NO: 32253 - DNA, 20 bp, human
ggcgcccccgacggcctggg

SEQ ID NO: 32254 - DNA, 20 bp, human
gccggagcagaggtcagaca

SEQ ID NO: 32255 - DNA, 20 bp, human
gccccagggcgagagtggac

SEQ ID NO: 32256 - DNA, 20 bp, human
gcgcagtacccggactacgg

SEQ ID NO: 32257 - DNA, 20 bp, human
ggtagtccgggtactgcggg

SEQ ID NO: 32258 - DNA, 20 bp, human
gcactctggcggcctcaacc

SEQ ID NO: 32259 - DNA, 20 bp, human
gagagtggcgcacggagcta

SEQ ID NO: 32260 - DNA, 20 bp, human
gaagagccgcgaggagccag

SEQ ID NO: 32261 - DNA, 20 bp, human
gccttcccactaggctgcag

SEQ ID NO: 32262 - DNA, 20 bp, human
gaaaggggcgaggggactcg

SEQ ID NO: 32263 - DNA, 20 bp, human
gtacggcggttaccacgtgg

SEQ ID NO: 32264 - DNA, 20 bp, human
ggggggctgacgaagttctg

SEQ ID NO: 32265 - DNA, 20 bp, human
gtggctcacggcctcaacgg

SEQ ID NO: 32266 - DNA, 20 bp, human
gggccgtctctgggagtctg

SEQ ID NO: 32267 - DNA, 20 bp, human
gtgtatagataggccaccaa

SEQ ID NO: 32268 - DNA, 20 bp, human
gacgtcagcccagccattgg

SEQ ID NO: 32269 - DNA, 20 bp, human
gctgggccgtctagtacaat

SEQ ID NO: 32270 - DNA, 20 bp, human
gtgggatggagtagcctgag

SEQ ID NO: 32271 - DNA, 20 bp, human
gtacagggctgctagtcacc

SEQ ID NO: 32272 - DNA, 20 bp, human
ggccagtgaggatccatgct

SEQ ID NO: 32273 - DNA, 20 bp, human
gagactggagcgtgtatcct

SEQ ID NO: 32274 - DNA, 20 bp, human
gagataggccaccaatggct

SEQ ID NO: 32275 - DNA, 20 bp, human
gtggctgggctgacgtcaag

SEQ ID NO: 32276 - DNA, 20 bp, human
ggctcctcggaagccatggt

SEQ ID NO: 32277 - DNA, 20 bp, human
gtctgcactacaccggagag

SEQ ID NO: 32278 - DNA, 20 bp, human
ggcttccgaggagctgtacg

SEQ ID NO: 32279 - DNA, 20 bp, human
gggtacctcgtacagctcct

SEQ ID NO: 32280 - DNA, 20 bp, human
ggggcggcgcggccggatcg

SEQ ID NO: 32281 - DNA, 20 bp, human
gagggccgggcggccgcact

SEQ ID NO: 32282 - DNA, 20 bp, human
gaggttttttggtcgcaagt

SEQ ID NO: 32283 - DNA, 20 bp, human
gggcgggaggggcagggtcg

SEQ ID NO: 32284 - DNA, 20 bp, human
gtgggcggcggagttgcggg

SEQ ID NO: 32285 - DNA, 20 bp, human
gccccgcgctcactccccgg

SEQ ID NO: 32286 - DNA, 20 bp, human
ggttatcattctcccgagat

SEQ ID NO: 32287 - DNA, 20 bp, human
gccaaacaattgatcatcga

SEQ ID NO: 32288 - DNA, 20 bp, human
gactgtttcataaaaggtgg

SEQ ID NO: 32289 - DNA, 20 bp, human
gttatataaaaaagtgacgg

SEQ ID NO: 32290 - DNA, 20 bp, human
gacaacaacgggagcaggtc

SEQ ID NO: 32291 - DNA, 20 bp, human
gatcttcccggtgtgcttag

SEQ ID NO: 32292 - DNA, 20 bp, human
ggtttccatgaccacgtgtg

SEQ ID NO: 32293 - DNA, 20 bp, human
gttatgttggcctacaacaa

SEQ ID NO: 32294 - DNA, 20 bp, human
gataatagcacccacacacg

SEQ ID NO: 32295 - DNA, 20 bp, human
gtgtttatataaaaaagtga

SEQ ID NO: 32296 - DNA, 20 bp, human
gcggtggctgcagccggcaa

SEQ ID NO: 32297 - DNA, 20 bp, human
gacgaggtacggggacgcgg

SEQ ID NO: 32298 - DNA, 20 bp, human
ggtggcagcagcgtccgggc

SEQ ID NO: 32299 - DNA, 20 bp, human
gagcgagcagacgcgcacac

SEQ ID NO: 32300 - DNA, 20 bp, human
ggcgccgggcggcttcctgc

SEQ ID NO: 32301 - DNA, 20 bp, human
ggccggccccagtcagcggg

SEQ ID NO: 32302 - DNA, 20 bp, human
gcccccgcgacccggcgacc

SEQ ID NO: 32303 - DNA, 20 bp, human
gccgcgcgcacacgcacgga

SEQ ID NO: 32304 - DNA, 20 bp, human
ggcagaatcagagcgggcgg

SEQ ID NO: 32305 - DNA, 20 bp, human
gctggcgtaaccggcagcag

SEQ ID NO: 32306 - DNA, 20 bp, human
gcacctgtggaggagagctt

SEQ ID NO: 32307 - DNA, 20 bp, human
ggccagcaggagacaccatg

SEQ ID NO: 32308 - DNA, 20 bp, human
ggccctgtcttcacctgtgg

SEQ ID NO: 32309 - DNA, 20 bp, human
gtccaggaacgcttcgagca

SEQ ID NO: 32310 - DNA, 20 bp, human
ggaatggctagggtcctctg

SEQ ID NO: 32311 - DNA, 20 bp, human
gaaagagggcgcacagagaa

SEQ ID NO: 32312 - DNA, 20 bp, human
gggcgcacagagaatggcta

SEQ ID NO: 32313 - DNA, 20 bp, human
ggggaggatggagctctaag

SEQ ID NO: 32314 - DNA, 20 bp, human
gctcctccacaggtgaagac

SEQ ID NO: 32315 - DNA, 20 bp, human
gtaagtcagcgtgacaatta

SEQ ID NO: 32316 - DNA, 20 bp, human
gtgctacacggggctttctg

SEQ ID NO: 32317 - DNA, 20 bp, human
ggcatcaacactaagatctg

SEQ ID NO: 32318 - DNA, 20 bp, human
gagtactcctggcttatcaa

SEQ ID NO: 32319 - DNA, 20 bp, human
ggaagcagaaagggtcctca

SEQ ID NO: 32320 - DNA, 20 bp, human
gacattccaggctggaccta

SEQ ID NO: 32321 - DNA, 20 bp, human
ggaagcccctcctgctacac

SEQ ID NO: 32322 - DNA, 20 bp, human
ggaaagccccgtgtagcagg

SEQ ID NO: 32323 - DNA, 20 bp, human
gttattggcgtggcaggtat

SEQ ID NO: 32324 - DNA, 20 bp, human
gtcaagacgatcatagtcac

SEQ ID NO: 32325 - DNA, 20 bp, human
ggggttagaggctgcatagc

SEQ ID NO: 32326 - DNA, 20 bp, human
ggccgagccccaaccaggaa

SEQ ID NO: 32327 - DNA, 20 bp, human
gccagcgtgctagggaggga

SEQ ID NO: 32328 - DNA, 20 bp, human
gaaccgagtcttggagatgg

SEQ ID NO: 32329 - DNA, 20 bp, human
gggacccccagtctgagaga

SEQ ID NO: 32330 - DNA, 20 bp, human
ggaagagtttagcctcatca

SEQ ID NO: 32331 - DNA, 20 bp, human
gaggaagggagtccgagcac

SEQ ID NO: 32332 - DNA, 20 bp, human
gaagtccagcgtgctaggga

SEQ ID NO: 32333 - DNA, 20 bp, human
ggggcagccctgcttcacac

SEQ ID NO: 32334 - DNA, 20 bp, human
gtccgtctgccgcaggacct

SEQ ID NO: 32335 - DNA, 20 bp, human
gagctatggaagccttgatg

SEQ ID NO: 32336 - DNA, 20 bp, human
ggatgcagccgtgcacaaga

SEQ ID NO: 32337 - DNA, 20 bp, human
gcataaattgcccagggtcc

SEQ ID NO: 32338 - DNA, 20 bp, human
gaaaaaaaaagtataggctc

SEQ ID NO: 32339 - DNA, 20 bp, human
gatttactctgcgccagtcg

SEQ ID NO: 32340 - DNA, 20 bp, human
gatttcatccgtcttgtgca

SEQ ID NO: 32341 - DNA, 20 bp, human
gtcctggaggtaggaaacag

SEQ ID NO: 32342 - DNA, 20 bp, human
ggtacagtacttaccacgac

SEQ ID NO: 32343 - DNA, 20 bp, human
gacatcacagggctgttgaa

SEQ ID NO: 32344 - DNA, 20 bp, human
gcaatagtactcacatcaca

SEQ ID NO: 32345 - DNA, 20 bp, human
gagagtccataaattgccca

SEQ ID NO: 32346 - DNA, 20 bp, human
ggaaggctgggagacgagac

SEQ ID NO: 32347 - DNA, 20 bp, human
gaggagacacaggtcttgga

SEQ ID NO: 32348 - DNA, 20 bp, human
gtgggaccatccccatccac

SEQ ID NO: 32349 - DNA, 20 bp, human
gctgcacagacccacacatg

SEQ ID NO: 32350 - DNA, 20 bp, human
gcgtctcccagccttcaggg

SEQ ID NO: 32351 - DNA, 20 bp, human
gacccagatggagcctgtgg

SEQ ID NO: 32352 - DNA, 20 bp, human
gtctccccgacccctgctct

SEQ ID NO: 32353 - DNA, 20 bp, human
ggagggacccctcctcctgg

SEQ ID NO: 32354 - DNA, 20 bp, human
gggaggagggtcttcctcat

SEQ ID NO: 32355 - DNA, 20 bp, human
gctgtgcaggggtgtgtcta

SEQ ID NO: 32356 - DNA, 20 bp, human
gagccccagcggtgtctcta

SEQ ID NO: 32357 - DNA, 20 bp, human
gcccagcatgccctgtccat

SEQ ID NO: 32358 - DNA, 20 bp, human
gtgccttagagacaccgctg

SEQ ID NO: 32359 - DNA, 20 bp, human
gggccctggctgtctgaagt

SEQ ID NO: 32360 - DNA, 20 bp, human
gccatcccagggagtatagg

SEQ ID NO: 32361 - DNA, 20 bp, human
gctgaagtaggccagctcag

SEQ ID NO: 32362 - DNA, 20 bp, human
ggtgtctctaaggcacccct

SEQ ID NO: 32363 - DNA, 20 bp, human
gagattcccatggggaccca

SEQ ID NO: 32364 - DNA, 20 bp, human
gggctccacctatactccct

SEQ ID NO: 32365 - DNA, 20 bp, human
gcacgagctggacactaagg

SEQ ID NO: 32366 - DNA, 20 bp, human
gctcccaggacagacagggg

SEQ ID NO: 32367 - DNA, 20 bp, human
gctcgaggaaaaagagatgg

SEQ ID NO: 32368 - DNA, 20 bp, human
gcagatacagtcctcactcc

SEQ ID NO: 32369 - DNA, 20 bp, human
gtccttcagatgcgggagga

SEQ ID NO: 32370 - DNA, 20 bp, human
gtcaggtgccgggacccatg

SEQ ID NO: 32371 - DNA, 20 bp, human
gggcctggcacactgaagtc

SEQ ID NO: 32372 - DNA, 20 bp, human
gtgcttccttcagatgcggg

SEQ ID NO: 32373 - DNA, 20 bp, human
gcatggggacaccactggat

SEQ ID NO: 32374 - DNA, 20 bp, human
gtgtgtgtgagtttgtagca

SEQ ID NO: 32375 - DNA, 20 bp, human
gtatctgtgtgtgcaagccg

SEQ ID NO: 32376 - DNA, 20 bp, human
gaaggggtggctcaccagga

SEQ ID NO: 32377 - DNA, 20 bp, human
gcttgagcccaggaataagt

SEQ ID NO: 32378 - DNA, 20 bp, human
gacgacaatggactgtataa

SEQ ID NO: 32379 - DNA, 20 bp, human
gaaggaaataagcaagtcca

SEQ ID NO: 32380 - DNA, 20 bp, human
gtgtgatacaccctctcata

SEQ ID NO: 32381 - DNA, 20 bp, human
gcagcctccaacttattcct

SEQ ID NO: 32382 - DNA, 20 bp, human
gaataagaattcaacgacaa

SEQ ID NO: 32383 - DNA, 20 bp, human
gttgttatgttccctatgag

SEQ ID NO: 32384 - DNA, 20 bp, human
gcaattgtattgctgttatt

SEQ ID NO: 32385 - DNA, 20 bp, human
ggttgttgggttttttgatg

SEQ ID NO: 32386 - DNA, 20 bp, human
gtccaggaatgctgtagtca

SEQ ID NO: 32387 - DNA, 20 bp, human
gtggtggatgagttaaggag

SEQ ID NO: 32388 - DNA, 20 bp, human
gggaggatggggctctgata

SEQ ID NO: 32389 - DNA, 20 bp, human
gtacagcattcctggagccc

SEQ ID NO: 32390 - DNA, 20 bp, human
ggtggttggtggtcaaagac

SEQ ID NO: 32391 - DNA, 20 bp, human
ggtcagggctactgtgactt

SEQ ID NO: 32392 - DNA, 20 bp, human
ggtggaggattcctgggagt

SEQ ID NO: 32393 - DNA, 20 bp, human
gactgggattgataagaggg

SEQ ID NO: 32394 - DNA, 20 bp, human
gggatcacagagaatggctg

SEQ ID NO: 32395 - DNA, 20 bp, human
gaagaataagaattacatca

SEQ ID NO: 32396 - DNA, 20 bp, human
gctgtgactgtcggctgtcg

SEQ ID NO: 32397 - DNA, 20 bp, human
gtgactggggtctcttgggt

SEQ ID NO: 32398 - DNA, 20 bp, human
gcctcagccgctccccgtgg

SEQ ID NO: 32399 - DNA, 20 bp, human
gctcaagtgttctctcgtcc

SEQ ID NO: 32400 - DNA, 20 bp, human
gagggcctgtgccctccacg

SEQ ID NO: 32401 - DNA, 20 bp, human
ggagactgactggggtctct

SEQ ID NO: 32402 - DNA, 20 bp, human
gggaggggatagagggcttc

SEQ ID NO: 32403 - DNA, 20 bp, human
ggggatagagggcttctggc

SEQ ID NO: 32404 - DNA, 20 bp, human
gctggggtctcttgggtagg

SEQ ID NO: 32405 - DNA, 20 bp, human
gcgctccccgtggagggcac

SEQ ID NO: 32406 - DNA, 20 bp, human
gtgccctaggaagagactca

SEQ ID NO: 32407 - DNA, 20 bp, human
gcaaggctgctgtgactgtc

SEQ ID NO: 32408 - DNA, 20 bp, human
gacggacagagggctcctgt

SEQ ID NO: 32409 - DNA, 20 bp, human
gtgtccgcggtaggcggatg

SEQ ID NO: 32410 - DNA, 20 bp, human
gggggccgagggagactcca

SEQ ID NO: 32411 - DNA, 20 bp, human
gttccaggaacgttttgtca

SEQ ID NO: 32412 - DNA, 20 bp, human
ggggctgtgagacggacaga

SEQ ID NO: 32413 - DNA, 20 bp, human
gtgccctgagtctcttccta

SEQ ID NO: 32414 - DNA, 20 bp, human
gccacagatggtgcatcccc

SEQ ID NO: 32415 - DNA, 20 bp, human
gacattggaaaataagcccc

SEQ ID NO: 32416 - DNA, 20 bp, human
gtccaggaatgctctggtca

SEQ ID NO: 32417 - DNA, 20 bp, human
gacttctgattggtgagtaa

SEQ ID NO: 32418 - DNA, 20 bp, human
gaagctcctctacaaagagg

SEQ ID NO: 32419 - DNA, 20 bp, human
gctcaagctcctctacaaag

SEQ ID NO: 32420 - DNA, 20 bp, human
ggccctgaccagagcattcc

SEQ ID NO: 32421 - DNA, 20 bp, human
gtgcttctatccctgagagg

SEQ ID NO: 32422 - DNA, 20 bp, human
ggagcaggacctccttccag

SEQ ID NO: 32423 - DNA, 20 bp, human
gtctgtccacctctttgtag

SEQ ID NO: 32424 - DNA, 20 bp, human
gctgggattgataaaaaggg

SEQ ID NO: 32425 - DNA, 20 bp, human
gggaaacagaacaccagaga

SEQ ID NO: 32426 - DNA, 20 bp, human
gggccctccctccacatcct

SEQ ID NO: 32427 - DNA, 20 bp, human
ggtctggtgtcctctcccaa

SEQ ID NO: 32428 - DNA, 20 bp, human
gtgcctgaggttggtggcta

SEQ ID NO: 32429 - DNA, 20 bp, human
gatgcacactctgtatggac

SEQ ID NO: 32430 - DNA, 20 bp, human
gctgtatggacaggctgaag

SEQ ID NO: 32431 - DNA, 20 bp, human
gagggaatgcacactctgta

SEQ ID NO: 32432 - DNA, 20 bp, human
ggcattggaaaataaacccc

SEQ ID NO: 32433 - DNA, 20 bp, human
gattttccaatgcctgaggt

SEQ ID NO: 32434 - DNA, 20 bp, human
gggcttctgttgaagtcctt

SEQ ID NO: 32435 - DNA, 20 bp, human
ggggacaatgttttatgccc

SEQ ID NO: 32436 - DNA, 20 bp, human
ggatgcgccatctgcaggaa

SEQ ID NO: 32437 - DNA, 20 bp, human
gtctgttggagccttaatag

SEQ ID NO: 32438 - DNA, 20 bp, human
gacattggcaaataagcctc

SEQ ID NO: 32439 - DNA, 20 bp, human
gtgccaatgtctgacattgt

SEQ ID NO: 32440 - DNA, 20 bp, human
gagccaacaatgtcagacat

SEQ ID NO: 32441 - DNA, 20 bp, human
gcttcaaataaagcataacc

SEQ ID NO: 32442 - DNA, 20 bp, human
gaggagaggacacaagagag

SEQ ID NO: 32443 - DNA, 20 bp, human
gtggagccttaatagaggag

SEQ ID NO: 32444 - DNA, 20 bp, human
gaataagcctcaggaagcag

SEQ ID NO: 32445 - DNA, 20 bp, human
ggaggacacaagagagggga

SEQ ID NO: 32446 - DNA, 20 bp, human
gcggctgtgctggaacaggt

SEQ ID NO: 32447 - DNA, 20 bp, human
gaggcggccgtgggccccac

SEQ ID NO: 32448 - DNA, 20 bp, human
gcgcgggcgagcagggtctc

SEQ ID NO: 32449 - DNA, 20 bp, human
ggctcgcagatgccgcccag

SEQ ID NO: 32450 - DNA, 20 bp, human
gcgggccattcgcgacccgg

SEQ ID NO: 32451 - DNA, 20 bp, human
gccggcatggcgagcctcgg

SEQ ID NO: 32452 - DNA, 20 bp, human
gtcgcgacccggaggtgcgc

SEQ ID NO: 32453 - DNA, 20 bp, human
ggcccgcgcccgcgcacctc

SEQ ID NO: 32454 - DNA, 20 bp, human
gaagtcggccgactccatgg

SEQ ID NO: 32455 - DNA, 20 bp, human
gggccgggccattcgcgacc

SEQ ID NO: 32456 - DNA, 20 bp, human
ggtggccgctattagtgagg

SEQ ID NO: 32457 - DNA, 20 bp, human
ggcccagcggctccaggtac

SEQ ID NO: 32458 - DNA, 20 bp, human
gtagtcgtcggagaagaggt

SEQ ID NO: 32459 - DNA, 20 bp, human
gtggtggctggaccctcggg

SEQ ID NO: 32460 - DNA, 20 bp, human
ggcgagtcagagccgcgcac

SEQ ID NO: 32461 - DNA, 20 bp, human
ggggaaggggacccacccga

SEQ ID NO: 32462 - DNA, 20 bp, human
gccgcgcacgggactgggaa

SEQ ID NO: 32463 - DNA, 20 bp, human
gcagagccgcgcacgggact

SEQ ID NO: 32464 - DNA, 20 bp, human
gtcactaatagcggccaccc

SEQ ID NO: 32465 - DNA, 20 bp, human
gatagcggccaccccggcag

SEQ ID NO: 32466 - DNA, 20 bp, human
gaagagcgcggcgctcatgg

SEQ ID NO: 32467 - DNA, 20 bp, human
gccgtccaggctgaagagcg

SEQ ID NO: 32468 - DNA, 20 bp, human
gtcaagcgcgagcccgactg

SEQ ID NO: 32469 - DNA, 20 bp, human
ggcgcaggctccgcaggcca

SEQ ID NO: 32470 - DNA, 20 bp, human
ggcggccatggagtcgatgt

SEQ ID NO: 32471 - DNA, 20 bp, human
gcgtcgccgtcgccccagtc

SEQ ID NO: 32472 - DNA, 20 bp, human
gtcgtcgtggcacagctcca

SEQ ID NO: 32473 - DNA, 20 bp, human
ggccgcgtgcgcacagaccg

SEQ ID NO: 32474 - DNA, 20 bp, human
gcgggctctgcgtccaagcg

SEQ ID NO: 32475 - DNA, 20 bp, human
gcccggcccggttcgtagaa

SEQ ID NO: 32476 - DNA, 20 bp, human
gggccccctgagaactcgag

SEQ ID NO: 32477 - DNA, 20 bp, human
gatgtaggcggagaggtcaa

SEQ ID NO: 32478 - DNA, 20 bp, human
gagccactcgagttctcagg

SEQ ID NO: 32479 - DNA, 20 bp, human
gctgggccgaaggtatgtgg

SEQ ID NO: 32480 - DNA, 20 bp, human
gagctgggcccggggagcta

SEQ ID NO: 32481 - DNA, 20 bp, human
gacgagtgtgagccccgggg

SEQ ID NO: 32482 - DNA, 20 bp, human
ggccgggtgctgccagagtt

SEQ ID NO: 32483 - DNA, 20 bp, human
gccagggagctacgacccca

SEQ ID NO: 32484 - DNA, 20 bp, human
gactgcagagggcaggtcta

SEQ ID NO: 32485 - DNA, 20 bp, human
gtccccagactcgatgtagg

SEQ ID NO: 32486 - DNA, 20 bp, human
gaactctgtgagggacgccg

SEQ ID NO: 32487 - DNA, 20 bp, human
gggagcgacggttacgaaac

SEQ ID NO: 32488 - DNA, 20 bp, human
ggggcgccctgagaacgggg

SEQ ID NO: 32489 - DNA, 20 bp, human
gcagcgcgggggtcgacggg

SEQ ID NO: 32490 - DNA, 20 bp, human
ggggcagcgcgggggtcgac

SEQ ID NO: 32491 - DNA, 20 bp, human
gggcgagcaggggaagccgg

SEQ ID NO: 32492 - DNA, 20 bp, human
gacctgccggcaacacccgg

SEQ ID NO: 32493 - DNA, 20 bp, human
ggggcccgcacccagtcgag

SEQ ID NO: 32494 - DNA, 20 bp, human
gggcgtctgatgcaacctgc

SEQ ID NO: 32495 - DNA, 20 bp, human
gcgcgcggggccgctcggag

SEQ ID NO: 32496 - DNA, 20 bp, human
gcggccttggcgccccgagg

SEQ ID NO: 32497 - DNA, 20 bp, human
gcccgccatggccgcagtca

SEQ ID NO: 32498 - DNA, 20 bp, human
gtccaaaggctccttgactg

SEQ ID NO: 32499 - DNA, 20 bp, human
gtccttgactgcggccatgg

SEQ ID NO: 32500 - DNA, 20 bp, human
gccactggcagagcggaaat

SEQ ID NO: 32501 - DNA, 20 bp, human
gctcggaggcaccaaggtaa

SEQ ID NO: 32502 - DNA, 20 bp, human
ggcgtggagagttccgaagg

SEQ ID NO: 32503 - DNA, 20 bp, human
gcaggcgtggagagttccga

SEQ ID NO: 32504 - DNA, 20 bp, human
ggtagaagatccggacgagg

SEQ ID NO: 32505 - DNA, 20 bp, human
gacaccatcaggtcggagag

SEQ ID NO: 32506 - DNA, 20 bp, human
ggagctgttccgaggtaact

SEQ ID NO: 32507 - DNA, 20 bp, human
gcaacaggaagtgaaacagt

SEQ ID NO: 32508 - DNA, 20 bp, human
gggtctgagactctcagtgg

SEQ ID NO: 32509 - DNA, 20 bp, human
gcgaggtaactggggtcctt

SEQ ID NO: 32510 - DNA, 20 bp, human
gtgggatgatgaggttcagg

SEQ ID NO: 32511 - DNA, 20 bp, human
gctctcagtggaggagtaac

SEQ ID NO: 32512 - DNA, 20 bp, human
ggtggatcaagcccaagctc

SEQ ID NO: 32513 - DNA, 20 bp, human
gggcctactccactgtcacc

SEQ ID NO: 32514 - DNA, 20 bp, human
ggcaaacagccctcagtttc

SEQ ID NO: 32515 - DNA, 20 bp, human
gggcccaagggcatttactc

SEQ ID NO: 32516 - DNA, 20 bp, human
gggcggagacgggcagagtg

SEQ ID NO: 32517 - DNA, 20 bp, human
gcggaggtggagagacttgg

SEQ ID NO: 32518 - DNA, 20 bp, human
gatggaactgggctctggta

SEQ ID NO: 32519 - DNA, 20 bp, human
gctccttccagagccggagg

SEQ ID NO: 32520 - DNA, 20 bp, human
gcagcaccttctccaaaggt

SEQ ID NO: 32521 - DNA, 20 bp, human
gagagcccagttccattcca

SEQ ID NO: 32522 - DNA, 20 bp, human
gggaggggagatggattccc

SEQ ID NO: 32523 - DNA, 20 bp, human
gaagagaagggccagagcac

SEQ ID NO: 32524 - DNA, 20 bp, human
gtgggatcgccatttgaggt

SEQ ID NO: 32525 - DNA, 20 bp, human
gtagccacgcccacctcaaa

SEQ ID NO: 32526 - DNA, 20 bp, human
gctgaagcaggcaggcaatc

SEQ ID NO: 32527 - DNA, 20 bp, human
gcacgggacactgtagatgg

SEQ ID NO: 32528 - DNA, 20 bp, human
gtagcagccctgaagcaggc

SEQ ID NO: 32529 - DNA, 20 bp, human
gacgtcatctctgtgaagag

SEQ ID NO: 32530 - DNA, 20 bp, human
ggcttctaactcctgaggga

SEQ ID NO: 32531 - DNA, 20 bp, human
ggagcggcttctaactcctg

SEQ ID NO: 32532 - DNA, 20 bp, human
gcatcacgggacactgtaga

SEQ ID NO: 32533 - DNA, 20 bp, human
gaccgatcattaggcatcac

SEQ ID NO: 32534 - DNA, 20 bp, human
gtatccaagagtaagtgata

SEQ ID NO: 32535 - DNA, 20 bp, human
gatcggttctggtttgtcac

SEQ ID NO: 32536 - DNA, 20 bp, human
gaaactgccgggaagcgcag

SEQ ID NO: 32537 - DNA, 20 bp, human
gaagacgcgcagggaaaaca

SEQ ID NO: 32538 - DNA, 20 bp, human
gccgccagcgagtcagagga

SEQ ID NO: 32539 - DNA, 20 bp, human
gaggcccgcaccaaacccac

SEQ ID NO: 32540 - DNA, 20 bp, human
gccccgcctccggccctgag

SEQ ID NO: 32541 - DNA, 20 bp, human
ggacggccggatggctgcgt

SEQ ID NO: 32542 - DNA, 20 bp, human
ggcccacagcatagcacctg

SEQ ID NO: 32543 - DNA, 20 bp, human
gcccgcgggagagcgctcgt

SEQ ID NO: 32544 - DNA, 20 bp, human
ggacccaaacgtcctcatgg

SEQ ID NO: 32545 - DNA, 20 bp, human
gcagggacgcggaaactgcc

SEQ ID NO: 32546 - DNA, 20 bp, human
gcccggctcgcccagtccag

SEQ ID NO: 32547 - DNA, 20 bp, human
ggcggcggcgagatccggac

SEQ ID NO: 32548 - DNA, 20 bp, human
ggcgcggcgttgggcaccag

SEQ ID NO: 32549 - DNA, 20 bp, human
gcagtccagtggctccagtc

SEQ ID NO: 32550 - DNA, 20 bp, human
ggggcaggcggtgaaccgag

SEQ ID NO: 32551 - DNA, 20 bp, human
gagatccggactggagccac

SEQ ID NO: 32552 - DNA, 20 bp, human
ggccgggcggcggcgagatc

SEQ ID NO: 32553 - DNA, 20 bp, human
gagcggaccgcggtgaagac

SEQ ID NO: 32554 - DNA, 20 bp, human
gcgcggaggagaccgagcga

SEQ ID NO: 32555 - DNA, 20 bp, human
gtggcggggagggaacagct

SEQ ID NO: 32556 - DNA, 20 bp, human
gactctgtggacatcttcaa

SEQ ID NO: 32557 - DNA, 20 bp, human
ggcctggggccaagacaggg

SEQ ID NO: 32558 - DNA, 20 bp, human
gcttggtgggagctgcgaag

SEQ ID NO: 32559 - DNA, 20 bp, human
gcaagccaggagtagacccg

SEQ ID NO: 32560 - DNA, 20 bp, human
gtggctggcaaggtgggagt

SEQ ID NO: 32561 - DNA, 20 bp, human
gacctgctgcacagggacag

SEQ ID NO: 32562 - DNA, 20 bp, human
gccaggctgggcaacggcag

SEQ ID NO: 32563 - DNA, 20 bp, human
gtcacccaggacagcaccta

SEQ ID NO: 32564 - DNA, 20 bp, human
gcccaggcacctgctgcaca

SEQ ID NO: 32565 - DNA, 20 bp, human
gaggcagtcttcatccccgt

SEQ ID NO: 32566 - DNA, 20 bp, human
ggggcttggtccaagcaaga

SEQ ID NO: 32567 - DNA, 20 bp, human
ggctttggcaagattctcca

SEQ ID NO: 32568 - DNA, 20 bp, human
gcactgcaggccctgaaccc

SEQ ID NO: 32569 - DNA, 20 bp, human
gatcttgccaaagcattagg

SEQ ID NO: 32570 - DNA, 20 bp, human
gctattcaggcccctctggg

SEQ ID NO: 32571 - DNA, 20 bp, human
gcacttaccataaaggacca

SEQ ID NO: 32572 - DNA, 20 bp, human
ggaagtcctcctgtcaatgg

SEQ ID NO: 32573 - DNA, 20 bp, human
gatgtggcctgaggtctata

SEQ ID NO: 32574 - DNA, 20 bp, human
gtgggggtcaaagagtgggg

SEQ ID NO: 32575 - DNA, 20 bp, human
ggctggtgggggtcaaagag

SEQ ID NO: 32576 - DNA, 20 bp, human
gcaaccaccctagtcacata

SEQ ID NO: 32577 - DNA, 20 bp, human
gagcagcagcgtccttatca

SEQ ID NO: 32578 - DNA, 20 bp, human
gcaccctagtcacataaggt

SEQ ID NO: 32579 - DNA, 20 bp, human
gcacataaggtgggtaagtg

SEQ ID NO: 32580 - DNA, 20 bp, human
gtacccaccttatgtgacta

SEQ ID NO: 32581 - DNA, 20 bp, human
gcctataatcataagaacat

SEQ ID NO: 32582 - DNA, 20 bp, human
gaatcataagaacattggaa

SEQ ID NO: 32583 - DNA, 20 bp, human
gcaagggttttctatttggg

SEQ ID NO: 32584 - DNA, 20 bp, human
gaagaattggagcaaagagc

SEQ ID NO: 32585 - DNA, 20 bp, human
gggtaagtcctgttacccag

SEQ ID NO: 32586 - DNA, 20 bp, human
gagcagcagggtcctaatca

SEQ ID NO: 32587 - DNA, 20 bp, human
gcaagcatcctagacatatc

SEQ ID NO: 32588 - DNA, 20 bp, human
gttacgcgcctgatatgtct

SEQ ID NO: 32589 - DNA, 20 bp, human
ggagaaagggtcttgagtcc

SEQ ID NO: 32590 - DNA, 20 bp, human
gaatcataagaaaaccgaaa

SEQ ID NO: 32591 - DNA, 20 bp, human
gtgtgtgggtcgctgcttcc

SEQ ID NO: 32592 - DNA, 20 bp, human
gattctttgaaactccattt

SEQ ID NO: 32593 - DNA, 20 bp, human
gaagaattggagcaaacaga

SEQ ID NO: 32594 - DNA, 20 bp, human
gtcggttttcttatgattat

SEQ ID NO: 32595 - DNA, 20 bp, human
gggtaagtcctgtcacccag

SEQ ID NO: 32596 - DNA, 20 bp, human
gggagtggtaagtagaactg

SEQ ID NO: 32597 - DNA, 20 bp, human
gttcaaggattcctagtcca

SEQ ID NO: 32598 - DNA, 20 bp, human
gatggtgaaagacccccaaa

SEQ ID NO: 32599 - DNA, 20 bp, human
gtcatgggactcagagcgag

SEQ ID NO: 32600 - DNA, 20 bp, human
gaccaggcatagcatgtcat

SEQ ID NO: 32601 - DNA, 20 bp, human
gtcccatgacatgctatgcc

SEQ ID NO: 32602 - DNA, 20 bp, human
gttccaccacagccctttgg

SEQ ID NO: 32603 - DNA, 20 bp, human
gcctagtccagggcagccca

SEQ ID NO: 32604 - DNA, 20 bp, human
gcccgggggcatgactgtag

SEQ ID NO: 32605 - DNA, 20 bp, human
gagggagcacacagacaggt

SEQ ID NO: 32606 - DNA, 20 bp, human
gggagtggtaagcagaacag

SEQ ID NO: 32607 - DNA, 20 bp, human
gttcaaggattcctaatcta

SEQ ID NO: 32608 - DNA, 20 bp, human
gggcagaaggtaagcaaagg

SEQ ID NO: 32609 - DNA, 20 bp, human
gaccaggcatagggtgtcat

SEQ ID NO: 32610 - DNA, 20 bp, human
gccctgggctgccctagatt

SEQ ID NO: 32611 - DNA, 20 bp, human
gtggggtctttctccatcca

SEQ ID NO: 32612 - DNA, 20 bp, human
gtcatgggacttagagcaag

SEQ ID NO: 32613 - DNA, 20 bp, human
gtcccatgacaccctatgcc

SEQ ID NO: 32614 - DNA, 20 bp, human
ggtaagcaaagggggctgac

SEQ ID NO: 32615 - DNA, 20 bp, human
gcaggtagggggagtgtgag

SEQ ID NO: 32616 - DNA, 20 bp, human
gtgctgaggccgaatcccgg

SEQ ID NO: 32617 - DNA, 20 bp, human
gtgttctgctctggcggcag

SEQ ID NO: 32618 - DNA, 20 bp, human
ggcagaacaccccaaaatgg

SEQ ID NO: 32619 - DNA, 20 bp, human
gctctgagcctagagagtga

SEQ ID NO: 32620 - DNA, 20 bp, human
ggcctagagagtgaaggtaa

SEQ ID NO: 32621 - DNA, 20 bp, human
gcggagggccctgtgacccg

SEQ ID NO: 32622 - DNA, 20 bp, human
gttcggcctcagcagcgagg

SEQ ID NO: 32623 - DNA, 20 bp, human
gttggggtgttctgctctgg

SEQ ID NO: 32624 - DNA, 20 bp, human
ggggacgcggaggctccccc

SEQ ID NO: 32625 - DNA, 20 bp, human
gggaaaacggagctggccct

SEQ ID NO: 32626 - DNA, 20 bp, human
ggacatcttggaggctcggg

SEQ ID NO: 32627 - DNA, 20 bp, human
ggaaccgggagccagagtta

SEQ ID NO: 32628 - DNA, 20 bp, human
gtctggtagacggctccgta

SEQ ID NO: 32629 - DNA, 20 bp, human
gggtcgccaggcgtccaggt

SEQ ID NO: 32630 - DNA, 20 bp, human
gagccagggtagggctgata

SEQ ID NO: 32631 - DNA, 20 bp, human
ggagcgcagaggctcggtcc

SEQ ID NO: 32632 - DNA, 20 bp, human
gccgggagccagagttaggg

SEQ ID NO: 32633 - DNA, 20 bp, human
ggttccgtttttgacagtaa

SEQ ID NO: 32634 - DNA, 20 bp, human
ggccgggacaggttggaggc

SEQ ID NO: 32635 - DNA, 20 bp, human
ggccgccgaggagcaactca

SEQ ID NO: 32636 - DNA, 20 bp, human
gcaagacctggagggttagg

SEQ ID NO: 32637 - DNA, 20 bp, human
gggtgagtatggccaagacc

SEQ ID NO: 32638 - DNA, 20 bp, human
ggggggtgctagggcttaga

SEQ ID NO: 32639 - DNA, 20 bp, human
ggtggtagccgggggtgcta

SEQ ID NO: 32640 - DNA, 20 bp, human
gagggttaggtggtagccgg

SEQ ID NO: 32641 - DNA, 20 bp, human
ggagttgagatgagagctgg

SEQ ID NO: 32642 - DNA, 20 bp, human
ggcagaaggatccgccacag

SEQ ID NO: 32643 - DNA, 20 bp, human
gggcaaatgtcccaggatgg

SEQ ID NO: 32644 - DNA, 20 bp, human
ggcttagagggctgggaact

SEQ ID NO: 32645 - DNA, 20 bp, human
gcctgctttcccggtcacct

SEQ ID NO: 32646 - DNA, 20 bp, human
gaatggtcgacgggttcccc

SEQ ID NO: 32647 - DNA, 20 bp, human
gccttcatgggaatggtcga

SEQ ID NO: 32648 - DNA, 20 bp, human
gcgaggtgtagagaaaccga

SEQ ID NO: 32649 - DNA, 20 bp, human
gttctgaaggacaggttcac

SEQ ID NO: 32650 - DNA, 20 bp, human
gcgcgagcgagcgagagaag

SEQ ID NO: 32651 - DNA, 20 bp, human
gggttcacaggcatgcacaa

SEQ ID NO: 32652 - DNA, 20 bp, human
gccggccggcgactgacgag

SEQ ID NO: 32653 - DNA, 20 bp, human
gactcgggttctctccccct

SEQ ID NO: 32654 - DNA, 20 bp, human
gcctgctccccggcaaagtt

SEQ ID NO: 32655 - DNA, 20 bp, human
ggcagtgccgggcacatgaa

SEQ ID NO: 32656 - DNA, 20 bp, human
gcccgccatggcccgcctga

SEQ ID NO: 32657 - DNA, 20 bp, human
ggcgcgcctcgctctccgtc

SEQ ID NO: 32658 - DNA, 20 bp, human
gagaaccgatgctccggcag

SEQ ID NO: 32659 - DNA, 20 bp, human
gagccgcggccctcgcccgt

SEQ ID NO: 32660 - DNA, 20 bp, human
gtccgtcaggcgggccatgg

SEQ ID NO: 32661 - DNA, 20 bp, human
gaaacgggcaggaaagagtg

SEQ ID NO: 32662 - DNA, 20 bp, human
ggcccgcctgacggagagcg

SEQ ID NO: 32663 - DNA, 20 bp, human
gatgagaggtcgagggagat

SEQ ID NO: 32664 - DNA, 20 bp, human
gggccgaactgctcgaagag

SEQ ID NO: 32665 - DNA, 20 bp, human
gggggtaagaaccgatgctc

SEQ ID NO: 32666 - DNA, 20 bp, human
gaggtggcggctgaacgctg

SEQ ID NO: 32667 - DNA, 20 bp, human
gctggcttgaggtccccgtg

SEQ ID NO: 32668 - DNA, 20 bp, human
gtccccgtgcggctctctct

SEQ ID NO: 32669 - DNA, 20 bp, human
ggcccagagagagccgcacg

SEQ ID NO: 32670 - DNA, 20 bp, human
ggcggctgaacgctggggtc

SEQ ID NO: 32671 - DNA, 20 bp, human
gtcgccaccggtccagggag

SEQ ID NO: 32672 - DNA, 20 bp, human
gggctctgggagagctcggg

SEQ ID NO: 32673 - DNA, 20 bp, human
gaccggcgggagggctgaca

SEQ ID NO: 32674 - DNA, 20 bp, human
ggcatgagcgggctaaaccc

SEQ ID NO: 32675 - DNA, 20 bp, human
gctgacgtcaccaagcacgg

SEQ ID NO: 32676 - DNA, 20 bp, human
gctccgcgccgcgcagaccc

SEQ ID NO: 32677 - DNA, 20 bp, human
gtgagttcccggagcgggct

SEQ ID NO: 32678 - DNA, 20 bp, human
gcgggccaagcgcaccgccc

SEQ ID NO: 32679 - DNA, 20 bp, human
gtcctccgcgcgtcccggga

SEQ ID NO: 32680 - DNA, 20 bp, human
gggcgccgcgcatcaacctg

SEQ ID NO: 32681 - DNA, 20 bp, human
gcggcggccggctgctgcct

SEQ ID NO: 32682 - DNA, 20 bp, human
gcggacgggcgtgggaagcg

SEQ ID NO: 32683 - DNA, 20 bp, human
gcccatcgccggcagggcgg

SEQ ID NO: 32684 - DNA, 20 bp, human
gtcgcaaagtgctctcgaag

SEQ ID NO: 32685 - DNA, 20 bp, human
ggggtgcatggattgtgttc

SEQ ID NO: 32686 - DNA, 20 bp, human
ggagctctgcagagtcgcgg

SEQ ID NO: 32687 - DNA, 20 bp, human
gccagggcgccagtccccgg

SEQ ID NO: 32688 - DNA, 20 bp, human
gggcgagctctgcagagtcg

SEQ ID NO: 32689 - DNA, 20 bp, human
gcggcgacaggcagcagccg

SEQ ID NO: 32690 - DNA, 20 bp, human
gcaggtgggcgatcccatag

SEQ ID NO: 32691 - DNA, 20 bp, human
gccgcccgccggggaggcga

SEQ ID NO: 32692 - DNA, 20 bp, human
gctggcccgggcatgaggcg

SEQ ID NO: 32693 - DNA, 20 bp, human
gagtgggagcccgggctcgt

SEQ ID NO: 32694 - DNA, 20 bp, human
ggatcccataggggcggagg

SEQ ID NO: 32695 - DNA, 20 bp, human
gctgcgtctggatggctcgg

SEQ ID NO: 32696 - DNA, 20 bp, human
gcaggtatgctaaggatcca

SEQ ID NO: 32697 - DNA, 20 bp, human
gccataatcgaaggacagaa

SEQ ID NO: 32698 - DNA, 20 bp, human
ggtgcagaccatgcagccgg

SEQ ID NO: 32699 - DNA, 20 bp, human
gctctgctgcccataatcga

SEQ ID NO: 32700 - DNA, 20 bp, human
gcacctgagcaacataacag

SEQ ID NO: 32701 - DNA, 20 bp, human
gtcacccgcacaccctggga

SEQ ID NO: 32702 - DNA, 20 bp, human
gaacagtgggcggaatacct

SEQ ID NO: 32703 - DNA, 20 bp, human
gccaggctgttaaccccctc

SEQ ID NO: 32704 - DNA, 20 bp, human
gtgctaaggatccagggcaa

SEQ ID NO: 32705 - DNA, 20 bp, human
gcatggggagagcatcaacg

SEQ ID NO: 32706 - DNA, 20 bp, human
gggccaagggcgcatatcgg

SEQ ID NO: 32707 - DNA, 20 bp, human
gtgcgcccttggccccgtag

SEQ ID NO: 32708 - DNA, 20 bp, human
ggccgggagccatgttggag

SEQ ID NO: 32709 - DNA, 20 bp, human
ggactccggacaaagagcta

SEQ ID NO: 32710 - DNA, 20 bp, human
gcaagggcgcatatcggtgg

SEQ ID NO: 32711 - DNA, 20 bp, human
gcccggaccccggaagactc

SEQ ID NO: 32712 - DNA, 20 bp, human
ggcctcccgccgctccaaca

SEQ ID NO: 32713 - DNA, 20 bp, human
gcgtcggggatgctgtggtg

SEQ ID NO: 32714 - DNA, 20 bp, human
ggaggtggagcgaaccatcg

SEQ ID NO: 32715 - DNA, 20 bp, human
gctgggcaccatctactccg

SEQ ID NO: 32716 - DNA, 20 bp, human
gtagagggagcggaatggtg

SEQ ID NO: 32717 - DNA, 20 bp, human
gcggagcccacgaggtgcag

SEQ ID NO: 32718 - DNA, 20 bp, human
gggagcccagcgggagtgag

SEQ ID NO: 32719 - DNA, 20 bp, human
gtcggacggcgaaagggacc

SEQ ID NO: 32720 - DNA, 20 bp, human
gccgagcctctgcacctcgt

SEQ ID NO: 32721 - DNA, 20 bp, human
gccggccgggtgtcacttgt

SEQ ID NO: 32722 - DNA, 20 bp, human
gcgggctcggcccagcatcc

SEQ ID NO: 32723 - DNA, 20 bp, human
gagaggctcggacggcgaaa

SEQ ID NO: 32724 - DNA, 20 bp, human
ggatctgggtcttaaaccgc

SEQ ID NO: 32725 - DNA, 20 bp, human
gcccatagctgtagagggag

SEQ ID NO: 32726 - DNA, 20 bp, human
gggaggccggaggacgcgta

SEQ ID NO: 32727 - DNA, 20 bp, human
ggcgctcctccgcgggatga

SEQ ID NO: 32728 - DNA, 20 bp, human
gagccgccgtcatcccgcgg

SEQ ID NO: 32729 - DNA, 20 bp, human
gcgaacgcggaggagagctc

SEQ ID NO: 32730 - DNA, 20 bp, human
gggggctgcgcgctcctccg

SEQ ID NO: 32731 - DNA, 20 bp, human
gatgacggcggctgcgaacg

SEQ ID NO: 32732 - DNA, 20 bp, human
gcacactgaaggtcacccga

SEQ ID NO: 32733 - DNA, 20 bp, human
gggaggacgcgtaaggcggg

SEQ ID NO: 32734 - DNA, 20 bp, human
gatgagggcgtctccagaag

SEQ ID NO: 32735 - DNA, 20 bp, human
gggccggaggacgcgtaagg

SEQ ID NO: 32736 - DNA, 20 bp, human
gcatggtgggcggggcgtat

SEQ ID NO: 32737 - DNA, 20 bp, human
gggactgctggggaccgtgg

SEQ ID NO: 32738 - DNA, 20 bp, human
gaaactgtcctgagcccctc

SEQ ID NO: 32739 - DNA, 20 bp, human
gtgaagttctcacaggacca

SEQ ID NO: 32740 - DNA, 20 bp, human
gggaagatgaggctgccagt

SEQ ID NO: 32741 - DNA, 20 bp, human
ggcacctgccaagaagacct

SEQ ID NO: 32742 - DNA, 20 bp, human
gtcgcccctgggcattctat

SEQ ID NO: 32743 - DNA, 20 bp, human
gaggacagtttgtcgcccct

SEQ ID NO: 32744 - DNA, 20 bp, human
gttgttgagaagggcagggt

SEQ ID NO: 32745 - DNA, 20 bp, human
gaccagggacctcggccccc

SEQ ID NO: 32746 - DNA, 20 bp, human
gtggggttcgctccagttag

SEQ ID NO: 32747 - DNA, 20 bp, human
ggccatgtcggcggacgctg

SEQ ID NO: 32748 - DNA, 20 bp, human
gcgctcgcgcaggagacccc

SEQ ID NO: 32749 - DNA, 20 bp, human
gttggacgccagcactggaa

SEQ ID NO: 32750 - DNA, 20 bp, human
gcaggagaccccgggtgacg

SEQ ID NO: 32751 - DNA, 20 bp, human
ggacgtggaaacaggagcgg

SEQ ID NO: 32752 - DNA, 20 bp, human
gcactggaagggccgtggaa

SEQ ID NO: 32753 - DNA, 20 bp, human
gctcatgtgcacaagtccag

SEQ ID NO: 32754 - DNA, 20 bp, human
gcgccgggccccgtcacccg

SEQ ID NO: 32755 - DNA, 20 bp, human
ggtctctcccagctcgtgga

SEQ ID NO: 32756 - DNA, 20 bp, human
gccaagcaccggctcatgtg

SEQ ID NO: 32757 - DNA, 20 bp, human
gtcgcggcacagcgttctct

SEQ ID NO: 32758 - DNA, 20 bp, human
gccggctcatgtgaggctcg

SEQ ID NO: 32759 - DNA, 20 bp, human
gtgccgggtccgggagcgaa

SEQ ID NO: 32760 - DNA, 20 bp, human
ggcggacttctgccaagcac

SEQ ID NO: 32761 - DNA, 20 bp, human
gacgccggccgtgaagtggg

SEQ ID NO: 32762 - DNA, 20 bp, human
gggccgcggccggttaccta

SEQ ID NO: 32763 - DNA, 20 bp, human
ggcggttccgaaagcgggaa

SEQ ID NO: 32764 - DNA, 20 bp, human
gatcgggactcgggagatcc

SEQ ID NO: 32765 - DNA, 20 bp, human
gcatccgctccgggcacggg

SEQ ID NO: 32766 - DNA, 20 bp, human
ggcgtcggagcgcaagtacg

SEQ ID NO: 32767 - DNA, 20 bp, human
gtcggagcgcaagtacgggg

SEQ ID NO: 32768 - DNA, 20 bp, human
gagaatccggacctgcgcaa

SEQ ID NO: 32769 - DNA, 20 bp, human
gccgccggcctgccggtcaa

SEQ ID NO: 32770 - DNA, 20 bp, human
gcggccgcggtgccctcgga

SEQ ID NO: 32771 - DNA, 20 bp, human
gcggaaggcaggaagtgccg

SEQ ID NO: 32772 - DNA, 20 bp, human
gttgcgctccgacgccagga

SEQ ID NO: 32773 - DNA, 20 bp, human
ggcgcaagggcgagatcgcg

SEQ ID NO: 32774 - DNA, 20 bp, human
gctccctacgacaagctcga

SEQ ID NO: 32775 - DNA, 20 bp, human
gagccctcgagcttgtcgta

SEQ ID NO: 32776 - DNA, 20 bp, human
gccttagggcccagctgtct

SEQ ID NO: 32777 - DNA, 20 bp, human
ggacgtggacgggtccccat

SEQ ID NO: 32778 - DNA, 20 bp, human
gtggcgatcaaaccctcgaa

SEQ ID NO: 32779 - DNA, 20 bp, human
ggcagctgggctaggcagtg

SEQ ID NO: 32780 - DNA, 20 bp, human
gatcaaaccctcgaacggtc

SEQ ID NO: 32781 - DNA, 20 bp, human
gggcgtggacacccaagacg

SEQ ID NO: 32782 - DNA, 20 bp, human
gggcgctggctatcccctta

SEQ ID NO: 32783 - DNA, 20 bp, human
gccgtcgcctgaccgttcga

SEQ ID NO: 32784 - DNA, 20 bp, human
gactcggtcaacagaaaacg

SEQ ID NO: 32785 - DNA, 20 bp, human
gccaacacgcggacttcgag

SEQ ID NO: 32786 - DNA, 20 bp, human
gggcagtcgcctgagactta

SEQ ID NO: 32787 - DNA, 20 bp, human
gccagcgcaactgtctgagg

SEQ ID NO: 32788 - DNA, 20 bp, human
gtcgccggaataccaggccg

SEQ ID NO: 32789 - DNA, 20 bp, human
gcctctcaagagtaagacgt

SEQ ID NO: 32790 - DNA, 20 bp, human
ggagccagcgcaactgtctg

SEQ ID NO: 32791 - DNA, 20 bp, human
gaacgaatcgccggaatacc

SEQ ID NO: 32792 - DNA, 20 bp, human
gtggccgcggcctggtattc

SEQ ID NO: 32793 - DNA, 20 bp, human
ggcgagagctgcgatccgga

SEQ ID NO: 32794 - DNA, 20 bp, human
gaacatggctgcgtccggtc

SEQ ID NO: 32795 - DNA, 20 bp, human
gtatttggaggcctaggaac

SEQ ID NO: 32796 - DNA, 20 bp, human
gctgataggatggcggagga

SEQ ID NO: 32797 - DNA, 20 bp, human
gggcgccgccctgagccgga

SEQ ID NO: 32798 - DNA, 20 bp, human
gccagaccctctgaagacaa

SEQ ID NO: 32799 - DNA, 20 bp, human
gcagcctgataggatggcgg

SEQ ID NO: 32800 - DNA, 20 bp, human
gccagttcagcctgatagga

SEQ ID NO: 32801 - DNA, 20 bp, human
gccccctacctgctgttcag

SEQ ID NO: 32802 - DNA, 20 bp, human
ggggtctggagacagcagtt

SEQ ID NO: 32803 - DNA, 20 bp, human
gccgcctagagaagtcgtat

SEQ ID NO: 32804 - DNA, 20 bp, human
gaaatggccaggaccctccg

SEQ ID NO: 32805 - DNA, 20 bp, human
gctccgcggccggcacttca

SEQ ID NO: 32806 - DNA, 20 bp, human
gtgagcgtcctgactgggtc

SEQ ID NO: 32807 - DNA, 20 bp, human
gatcactctcccggccctgt

SEQ ID NO: 32808 - DNA, 20 bp, human
ggcgaattgggcaccggtgg

SEQ ID NO: 32809 - DNA, 20 bp, human
ggaccagaagcgggcgaatt

SEQ ID NO: 32810 - DNA, 20 bp, human
ggccgggagagtgatcccag

SEQ ID NO: 32811 - DNA, 20 bp, human
ggtgagtccgtgaccgagta

SEQ ID NO: 32812 - DNA, 20 bp, human
gcccgccggcaaaaagccag

SEQ ID NO: 32813 - DNA, 20 bp, human
gcgggcgaattgggcaccgg

SEQ ID NO: 32814 - DNA, 20 bp, human
gaagcgggcgaattgggcac

SEQ ID NO: 32815 - DNA, 20 bp, human
gctctcggagagtacagttc

SEQ ID NO: 32816 - DNA, 20 bp, human
gcgagcccgcggactccgga

SEQ ID NO: 32817 - DNA, 20 bp, human
gtcctccattgctggttgag

SEQ ID NO: 32818 - DNA, 20 bp, human
gccctggagagaggttacaa

SEQ ID NO: 32819 - DNA, 20 bp, human
gagcgcgtttgcctgttgag

SEQ ID NO: 32820 - DNA, 20 bp, human
gtcccctcaaccagcaatgg

SEQ ID NO: 32821 - DNA, 20 bp, human
gtacagcttctaagggcccg

SEQ ID NO: 32822 - DNA, 20 bp, human
gcgtcggcgtcttgcatctg

SEQ ID NO: 32823 - DNA, 20 bp, human
gggccaaagggaacaacctg

SEQ ID NO: 32824 - DNA, 20 bp, human
gggaaaggctaccactcaac

SEQ ID NO: 32825 - DNA, 20 bp, human
gtgtaaaccagagaggtagg

SEQ ID NO: 32826 - DNA, 20 bp, human
ggaattccggaggcggcatt

SEQ ID NO: 32827 - DNA, 20 bp, human
ggctgcaggtagagtgtctt

SEQ ID NO: 32828 - DNA, 20 bp, human
gttccggaggcggcattcgg

SEQ ID NO: 32829 - DNA, 20 bp, human
gggcggcattcggtggtcag

SEQ ID NO: 32830 - DNA, 20 bp, human
gtagagtgtcttaggtgagg

SEQ ID NO: 32831 - DNA, 20 bp, human
gtaagcaccgcgcgaaatgg

SEQ ID NO: 32832 - DNA, 20 bp, human
ggaccaccgaatgccgcctc

SEQ ID NO: 32833 - DNA, 20 bp, human
gactctacctgcagccgcac

SEQ ID NO: 32834 - DNA, 20 bp, human
ggcgctgggatggttcaact

SEQ ID NO: 32835 - DNA, 20 bp, human
gcagcttctttgaattccgg

SEQ ID NO: 32836 - DNA, 20 bp, human
gacagaggcggcgattgtgg

SEQ ID NO: 32837 - DNA, 20 bp, human
gggcccatttgtaaatgctg

SEQ ID NO: 32838 - DNA, 20 bp, human
ggccctgcgccggagatgga

SEQ ID NO: 32839 - DNA, 20 bp, human
ggcggaacttgagttcctgt

SEQ ID NO: 32840 - DNA, 20 bp, human
ggcgttgctggctgtcctaa

SEQ ID NO: 32841 - DNA, 20 bp, human
gctgcccaggcttcacggag

SEQ ID NO: 32842 - DNA, 20 bp, human
ggctgcggagattgaggtgt

SEQ ID NO: 32843 - DNA, 20 bp, human
gccccgtcccgaggtcctgt

SEQ ID NO: 32844 - DNA, 20 bp, human
ggcccaccgccgtccatctc

SEQ ID NO: 32845 - DNA, 20 bp, human
gccgacagaggcggcgattg

SEQ ID NO: 32846 - DNA, 20 bp, human
ggcgcagcgcctaggcgacc

SEQ ID NO: 32847 - DNA, 20 bp, human
gcacaaactccaggtcgcct

SEQ ID NO: 32848 - DNA, 20 bp, human
gcagcgcgcgcagaagtccg

SEQ ID NO: 32849 - DNA, 20 bp, human
gcgctgtgatggtaagacct

SEQ ID NO: 32850 - DNA, 20 bp, human
ggccggggaggttgatataa

SEQ ID NO: 32851 - DNA, 20 bp, human
ggcgcgcagaagtccggggc

SEQ ID NO: 32852 - DNA, 20 bp, human
gaaaagacctagggcagaac

SEQ ID NO: 32853 - DNA, 20 bp, human
gcgcttcctgcgcagcgcct

SEQ ID NO: 32854 - DNA, 20 bp, human
gggagtttgtgacgctgtga

SEQ ID NO: 32855 - DNA, 20 bp, human
gtgtggagctccagtcctga

SEQ ID NO: 32856 - DNA, 20 bp, human
gtctcttgtgaacccacttg

SEQ ID NO: 32857 - DNA, 20 bp, human
gagggcccgccccgcgtctg

SEQ ID NO: 32858 - DNA, 20 bp, human
gcggccagaaccggaaaaca

SEQ ID NO: 32859 - DNA, 20 bp, human
gtctcgagaagcgtggaaag

SEQ ID NO: 32860 - DNA, 20 bp, human
gaatcggcgaggcgccaagg

SEQ ID NO: 32861 - DNA, 20 bp, human
ggcttctcgagaggctcccg

SEQ ID NO: 32862 - DNA, 20 bp, human
gaagggcgcttggaccccag

SEQ ID NO: 32863 - DNA, 20 bp, human
gcggaatcggcgaggcgcca

SEQ ID NO: 32864 - DNA, 20 bp, human
gactagcgggcggagttgaa

SEQ ID NO: 32865 - DNA, 20 bp, human
gtggggccgcagagcgagtc

SEQ ID NO: 32866 - DNA, 20 bp, human
ggctctaggggctggactca

SEQ ID NO: 32867 - DNA, 20 bp, human
gccgcctgcacctaccaaga

SEQ ID NO: 32868 - DNA, 20 bp, human
ggcgcgcaccgcaggagcaa

SEQ ID NO: 32869 - DNA, 20 bp, human
gctaggggctggactcaggg

SEQ ID NO: 32870 - DNA, 20 bp, human
gaggccggcggtgggagcga

SEQ ID NO: 32871 - DNA, 20 bp, human
ggcaccgcaggagcaacggt

SEQ ID NO: 32872 - DNA, 20 bp, human
gaggtcaactgagctctctg

SEQ ID NO: 32873 - DNA, 20 bp, human
gggaccaaccgttgctcctg

SEQ ID NO: 32874 - DNA, 20 bp, human
gtagagagtgcggtgcccac

SEQ ID NO: 32875 - DNA, 20 bp, human
ggaggccagacccccagacg

SEQ ID NO: 32876 - DNA, 20 bp, human
gccggtaagagagccccggg

SEQ ID NO: 32877 - DNA, 20 bp, human
gcacaccgggagaactgaag

SEQ ID NO: 32878 - DNA, 20 bp, human
ggagcaacgcaagagggtac

SEQ ID NO: 32879 - DNA, 20 bp, human
gcggcgggaactgcaattgg

SEQ ID NO: 32880 - DNA, 20 bp, human
ggtacagggacaaaaaacga

SEQ ID NO: 32881 - DNA, 20 bp, human
gcgtgtggtcatgtgaccag

SEQ ID NO: 32882 - DNA, 20 bp, human
gggcgctcgctggaacacgc

SEQ ID NO: 32883 - DNA, 20 bp, human
gtgggccggtaagagagccc

SEQ ID NO: 32884 - DNA, 20 bp, human
ggggacctgaggaggaacaa

SEQ ID NO: 32885 - DNA, 20 bp, human
gacccgaaggccggctgcta

SEQ ID NO: 32886 - DNA, 20 bp, human
gaaagcacgccgggaccggt

SEQ ID NO: 32887 - DNA, 20 bp, human
gggaggtgctgagacatcga

SEQ ID NO: 32888 - DNA, 20 bp, human
gtggcctgggtgagctagaa

SEQ ID NO: 32889 - DNA, 20 bp, human
gacattggagtccctatcac

SEQ ID NO: 32890 - DNA, 20 bp, human
ggcgccgccatgcttttgta

SEQ ID NO: 32891 - DNA, 20 bp, human
ggttgcctagacaacttcat

SEQ ID NO: 32892 - DNA, 20 bp, human
gacgccgggaccggttggtt

SEQ ID NO: 32893 - DNA, 20 bp, human
gtcgcaaagcacgccgggac

SEQ ID NO: 32894 - DNA, 20 bp, human
gcagatggcgagtccaaagg

SEQ ID NO: 32895 - DNA, 20 bp, human
gatgcgcaaagtggtcctcg

SEQ ID NO: 32896 - DNA, 20 bp, human
ggccgcgtgcctcactaaag

SEQ ID NO: 32897 - DNA, 20 bp, human
gttgctgaccgcagccgggc

SEQ ID NO: 32898 - DNA, 20 bp, human
gtctgtgtggatgactgaca

SEQ ID NO: 32899 - DNA, 20 bp, human
gtccctggctgtctaagcag

SEQ ID NO: 32900 - DNA, 20 bp, human
gaggagaccgaggatgtctg

SEQ ID NO: 32901 - DNA, 20 bp, human
gggctgggagtaggagaccg

SEQ ID NO: 32902 - DNA, 20 bp, human
gaggcggaattatctagcta

SEQ ID NO: 32903 - DNA, 20 bp, human
gagatacttctgcatactgg

SEQ ID NO: 32904 - DNA, 20 bp, human
ggcgggtgaagcgcgcaggt

SEQ ID NO: 32905 - DNA, 20 bp, human
gcgagcgtgtgaggacccac

SEQ ID NO: 32906 - DNA, 20 bp, human
gagggtgcaagaagaatcag

SEQ ID NO: 32907 - DNA, 20 bp, human
gtctaagcgcggctctcaga

SEQ ID NO: 32908 - DNA, 20 bp, human
gtgtgggcacaagagtgagt

SEQ ID NO: 32909 - DNA, 20 bp, human
gaggagacccggaagtgggt

SEQ ID NO: 32910 - DNA, 20 bp, human
gcactcttgtgcccacatag

SEQ ID NO: 32911 - DNA, 20 bp, human
gcaagagtgagtaggactcc

SEQ ID NO: 32912 - DNA, 20 bp, human
gcccaaacattcgtaaacag

SEQ ID NO: 32913 - DNA, 20 bp, human
gttcgtaaacagaggagacc

SEQ ID NO: 32914 - DNA, 20 bp, human
gcacatagaggtctaaattg

SEQ ID NO: 32915 - DNA, 20 bp, human
ggcgcgaattactctaagcg

SEQ ID NO: 32916 - DNA, 20 bp, human
gttgtggtcagccatcgtct

SEQ ID NO: 32917 - DNA, 20 bp, human
gtcagccatcgtctcggccc

SEQ ID NO: 32918 - DNA, 20 bp, human
gcggcgtggagtcgctgtca

SEQ ID NO: 32919 - DNA, 20 bp, human
gtcaggctctgtggtcccga

SEQ ID NO: 32920 - DNA, 20 bp, human
gcagagacccgggatcagtc

SEQ ID NO: 32921 - DNA, 20 bp, human
ggggcccggggccgagacga

SEQ ID NO: 32922 - DNA, 20 bp, human
ggctggctgggcggttagga

SEQ ID NO: 32923 - DNA, 20 bp, human
gccactggagatggaggata

SEQ ID NO: 32924 - DNA, 20 bp, human
gcgacgcgtgctggatacag

SEQ ID NO: 32925 - DNA, 20 bp, human
gggagtcgctgtcagggttg

SEQ ID NO: 32926 - DNA, 20 bp, human
gagcttggcggcaccctcgg

SEQ ID NO: 32927 - DNA, 20 bp, human
gggcagaagcttacctccga

SEQ ID NO: 32928 - DNA, 20 bp, human
gctgggagacgttccagaag

SEQ ID NO: 32929 - DNA, 20 bp, human
gccggcccgccgcactcaca

SEQ ID NO: 32930 - DNA, 20 bp, human
ggggagccatgcggcgatcg

SEQ ID NO: 32931 - DNA, 20 bp, human
gttctgcccgcgcagcttgg

SEQ ID NO: 32932 - DNA, 20 bp, human
gaggagcttggcggcaccct

SEQ ID NO: 32933 - DNA, 20 bp, human
gtcagccgcggcttctccga

SEQ ID NO: 32934 - DNA, 20 bp, human
ggttgccacgcggaccccct

SEQ ID NO: 32935 - DNA, 20 bp, human
gtcgtcgccgcgggcccagg

SEQ ID NO: 32936 - DNA, 20 bp, human
gtaaagcggaaggctccccg

SEQ ID NO: 32937 - DNA, 20 bp, human
ggtccgtatgacgcttcttc

SEQ ID NO: 32938 - DNA, 20 bp, human
ggaactgacatgccagggtg

SEQ ID NO: 32939 - DNA, 20 bp, human
gtgggccagcgaaaacaatc

SEQ ID NO: 32940 - DNA, 20 bp, human
gggcagttccaacaatgaca

SEQ ID NO: 32941 - DNA, 20 bp, human
gttggaactgccttaaacag

SEQ ID NO: 32942 - DNA, 20 bp, human
ggggaacgtatgccccaccc

SEQ ID NO: 32943 - DNA, 20 bp, human
ggctcggggcggaaaaacaa

SEQ ID NO: 32944 - DNA, 20 bp, human
gtggggcacgggagaggtaa

SEQ ID NO: 32945 - DNA, 20 bp, human
ggtatcgcacacaagctccg

SEQ ID NO: 32946 - DNA, 20 bp, human
gaggctgcggccggggctat

SEQ ID NO: 32947 - DNA, 20 bp, human
gggcttggttgtcatgagag

SEQ ID NO: 32948 - DNA, 20 bp, human
gtcgtacccagctcccaggt

SEQ ID NO: 32949 - DNA, 20 bp, human
gtcttcggcgacagcaaggc

SEQ ID NO: 32950 - DNA, 20 bp, human
gggagctgggtacgaagcct

SEQ ID NO: 32951 - DNA, 20 bp, human
gtagagggaagggccccgac

SEQ ID NO: 32952 - DNA, 20 bp, human
gggtgcaagcgcggacggtg

SEQ ID NO: 32953 - DNA, 20 bp, human
ggggggcgcggtccccacct

SEQ ID NO: 32954 - DNA, 20 bp, human
gaccctgagggccagagtag

SEQ ID NO: 32955 - DNA, 20 bp, human
gaagctgctgcggcagtgac

SEQ ID NO: 32956 - DNA, 20 bp, human
ggtccaagagtctgacccaa

SEQ ID NO: 32957 - DNA, 20 bp, human
gcaccgccgcccctgccaaa

SEQ ID NO: 32958 - DNA, 20 bp, human
gctcccagtcgcaaaccctt

SEQ ID NO: 32959 - DNA, 20 bp, human
ggacccaagggtttgcgact

SEQ ID NO: 32960 - DNA, 20 bp, human
gaggaagggactgccaggaa

SEQ ID NO: 32961 - DNA, 20 bp, human
gctgggcggcggcgacccag

SEQ ID NO: 32962 - DNA, 20 bp, human
gcctgccggggacaccacag

SEQ ID NO: 32963 - DNA, 20 bp, human
ggcaaggatttgaaaccgtt

SEQ ID NO: 32964 - DNA, 20 bp, human
gcagggtagcatcctacatg

SEQ ID NO: 32965 - DNA, 20 bp, human
gtgaaaccgtttggcagggg

SEQ ID NO: 32966 - DNA, 20 bp, human
gtagccggacgaggagaggc

SEQ ID NO: 32967 - DNA, 20 bp, human
gtaatgaaggcgtcctcctt

SEQ ID NO: 32968 - DNA, 20 bp, human
gggcgcgctgcagcagacgg

SEQ ID NO: 32969 - DNA, 20 bp, human
ggctaggcggaagctgggcg

SEQ ID NO: 32970 - DNA, 20 bp, human
gtccgggcatcagggaccgg

SEQ ID NO: 32971 - DNA, 20 bp, human
gtgcgggcctggttgctagg

SEQ ID NO: 32972 - DNA, 20 bp, human
gcaggcggcaaaaggtcctc

SEQ ID NO: 32973 - DNA, 20 bp, human
gcgcccgggcgtttgaaaag

SEQ ID NO: 32974 - DNA, 20 bp, human
gggaccgctcaccgcaacca

SEQ ID NO: 32975 - DNA, 20 bp, human
gtggttgctaggcggaagct

SEQ ID NO: 32976 - DNA, 20 bp, human
gagtctggggagagcacagt

SEQ ID NO: 32977 - DNA, 20 bp, human
gcggctaccagtgacccaga

SEQ ID NO: 32978 - DNA, 20 bp, human
gtagagcaagctgctcccaa

SEQ ID NO: 32979 - DNA, 20 bp, human
gctccccagactcgcagcta

SEQ ID NO: 32980 - DNA, 20 bp, human
gcagagcggcgcgggatctg

SEQ ID NO: 32981 - DNA, 20 bp, human
gtccccacccctgggacgag

SEQ ID NO: 32982 - DNA, 20 bp, human
gccctcggcaggggtgtccg

SEQ ID NO: 32983 - DNA, 20 bp, human
gaaagcttcacagatgctag

SEQ ID NO: 32984 - DNA, 20 bp, human
gggcctccctccctcggcag

SEQ ID NO: 32985 - DNA, 20 bp, human
ggcaagctgctcccaaagga

SEQ ID NO: 32986 - DNA, 20 bp, human
gcccgcgggtaccgcccaga

SEQ ID NO: 32987 - DNA, 20 bp, human
gggtaccgcccagaaggcga

SEQ ID NO: 32988 - DNA, 20 bp, human
gctcccacatccggactcac

SEQ ID NO: 32989 - DNA, 20 bp, human
ggttgccccggtaacgggag

SEQ ID NO: 32990 - DNA, 20 bp, human
gtggcgcggagggacgatcg

SEQ ID NO: 32991 - DNA, 20 bp, human
gacgcgcttggcgacgatgg

SEQ ID NO: 32992 - DNA, 20 bp, human
ggggagcggcggacgattag

SEQ ID NO: 32993 - DNA, 20 bp, human
gacgatcggggccgacacgg

SEQ ID NO: 32994 - DNA, 20 bp, human
gggccaggccgggtcagacc

SEQ ID NO: 32995 - DNA, 20 bp, human
gatcggggccgacacggagg

SEQ ID NO: 32996 - DNA, 20 bp, human
gcaggactagagtttcctcg

SEQ ID NO: 32997 - DNA, 20 bp, human
gcacggaggctgttaccgcg

SEQ ID NO: 32998 - DNA, 20 bp, human
gagctagtggactagagcca

SEQ ID NO: 32999 - DNA, 20 bp, human
gaaggggatctgctagaagt

SEQ ID NO: 33000 - DNA, 20 bp, human
gggactagagccagggtaag

SEQ ID NO: 33001 - DNA, 20 bp, human
ggtgactaggaaggagctag

SEQ ID NO: 33002 - DNA, 20 bp, human
gcgtgacgccagggtgacca

SEQ ID NO: 33003 - DNA, 20 bp, human
gaggcggggtccgcagagta

SEQ ID NO: 33004 - DNA, 20 bp, human
ggccctgagaccctactctg

SEQ ID NO: 33005 - DNA, 20 bp, human
gcacaaccgaactcacgggg

SEQ ID NO: 33006 - DNA, 20 bp, human
gtggagtgcgccgagtagaa

SEQ ID NO: 33007 - DNA, 20 bp, human
gccccccgggtccaaatccg

SEQ ID NO: 33008 - DNA, 20 bp, human
gggtgagtgagcagcgggtc

SEQ ID NO: 33009 - DNA, 20 bp, human
gtagttgaggacctcatcga

SEQ ID NO: 33010 - DNA, 20 bp, human
gaggtctggctggagtagtt

SEQ ID NO: 33011 - DNA, 20 bp, human
ggcttgctgggatacttctg

SEQ ID NO: 33012 - DNA, 20 bp, human
gcggctcctgagcgggccac

SEQ ID NO: 33013 - DNA, 20 bp, human
gagagcggtgccagaggtag

SEQ ID NO: 33014 - DNA, 20 bp, human
gtgagttaggagaacggaca

SEQ ID NO: 33015 - DNA, 20 bp, human
gtctgtggcaggcttccccc

SEQ ID NO: 33016 - DNA, 20 bp, human
ggcggcagcgacgacaacag

SEQ ID NO: 33017 - DNA, 20 bp, human
ggcaggactggagctccggg

SEQ ID NO: 33018 - DNA, 20 bp, human
gtcccaggcgggcagagggt

SEQ ID NO: 33019 - DNA, 20 bp, human
gtctgcccgcctgggacccg

SEQ ID NO: 33020 - DNA, 20 bp, human
gccccggagctcgaccgcag

SEQ ID NO: 33021 - DNA, 20 bp, human
gcggcgtgcgagagactcac

SEQ ID NO: 33022 - DNA, 20 bp, human
gacacacgccccacacatag

SEQ ID NO: 33023 - DNA, 20 bp, human
gcgtccggtccctctctcca

SEQ ID NO: 33024 - DNA, 20 bp, human
gttaccgtggagagagggac

SEQ ID NO: 33025 - DNA, 20 bp, human
ggccccacacatagcggtaa

SEQ ID NO: 33026 - DNA, 20 bp, human
gaggccgcgtagaaacgggg

SEQ ID NO: 33027 - DNA, 20 bp, human
gcgcaggccgcgtagaaacg

SEQ ID NO: 33028 - DNA, 20 bp, human
gcccggcctggcgcagacca

SEQ ID NO: 33029 - DNA, 20 bp, human
gtcgccgggcatgtcctagg

SEQ ID NO: 33030 - DNA, 20 bp, human
gaccagggccgcctccgcgg

SEQ ID NO: 33031 - DNA, 20 bp, human
gggcgaggcccgcacgctcg

SEQ ID NO: 33032 - DNA, 20 bp, human
gccgccgcctaggacatgcc

SEQ ID NO: 33033 - DNA, 20 bp, human
ggagcctcccgcagacgtca

SEQ ID NO: 33034 - DNA, 20 bp, human
gccggcggccgctctgccgt

SEQ ID NO: 33035 - DNA, 20 bp, human
gcgcacgctcgtggcagccc

SEQ ID NO: 33036 - DNA, 20 bp, human
ggtacagggattccaggtcc

SEQ ID NO: 33037 - DNA, 20 bp, human
ggaagccccacagcacctaa

SEQ ID NO: 33038 - DNA, 20 bp, human
gctcggcgtacagggattcc

SEQ ID NO: 33039 - DNA, 20 bp, human
gggtccaccggctcccacct

SEQ ID NO: 33040 - DNA, 20 bp, human
gggcttcctaacaagattgt

SEQ ID NO: 33041 - DNA, 20 bp, human
ggccagcgctcgccgggacc

SEQ ID NO: 33042 - DNA, 20 bp, human
gaatccctgtacgccgaggt

SEQ ID NO: 33043 - DNA, 20 bp, human
gactagtggagacgtgagta

SEQ ID NO: 33044 - DNA, 20 bp, human
ggctcccacctcggcgtaca

SEQ ID NO: 33045 - DNA, 20 bp, human
gtgtcgctgtggaaaccgct

SEQ ID NO: 33046 - DNA, 20 bp, human
gcaccggctggagcccggaa

SEQ ID NO: 33047 - DNA, 20 bp, human
ggaaagtccacggactgaag

SEQ ID NO: 33048 - DNA, 20 bp, human
gtgtgcagcgggaaagtcca

SEQ ID NO: 33049 - DNA, 20 bp, human
gcccgcgtccccgacttcgg

SEQ ID NO: 33050 - DNA, 20 bp, human
ggagcccgcgtccccgactt

SEQ ID NO: 33051 - DNA, 20 bp, human
gggaagtccccagacaagag

SEQ ID NO: 33052 - DNA, 20 bp, human
gtccagagggtagcacggag

SEQ ID NO: 33053 - DNA, 20 bp, human
gggcctcagggcgcgagcaa

SEQ ID NO: 33054 - DNA, 20 bp, human
gacactgccctccgaagtcg

SEQ ID NO: 33055 - DNA, 20 bp, human
gccctctccgtgctaccctc

SEQ ID NO: 33056 - DNA, 20 bp, human
gggctgccgcagctcaatcg

SEQ ID NO: 33057 - DNA, 20 bp, human
gccaggacacagggagcgag

SEQ ID NO: 33058 - DNA, 20 bp, human
gtgggagctccagagtcggg

SEQ ID NO: 33059 - DNA, 20 bp, human
gccggagacccgcccgtcta

SEQ ID NO: 33060 - DNA, 20 bp, human
ggcgggagccgagcgtggtg

SEQ ID NO: 33061 - DNA, 20 bp, human
gcgctgctaaggccctgcgg

SEQ ID NO: 33062 - DNA, 20 bp, human
ggagccgagcgtggtgaggt

SEQ ID NO: 33063 - DNA, 20 bp, human
ggcaactagccgggcgtctg

SEQ ID NO: 33064 - DNA, 20 bp, human
gccagagtcgggtggcgggt

SEQ ID NO: 33065 - DNA, 20 bp, human
gctcggctcccgcagacgcc

SEQ ID NO: 33066 - DNA, 20 bp, human
ggagcaagccaaagcggcag

SEQ ID NO: 33067 - DNA, 20 bp, human
gggtcccgagcaagccaaag

SEQ ID NO: 33068 - DNA, 20 bp, human
gtggcttgctcgggaccatt

SEQ ID NO: 33069 - DNA, 20 bp, human
gtggcaagcgcgagggtctg

SEQ ID NO: 33070 - DNA, 20 bp, human
ggggcggggtagctatgctg

SEQ ID NO: 33071 - DNA, 20 bp, human
gtctggccttggcggagttg

SEQ ID NO: 33072 - DNA, 20 bp, human
ggactctgggtccagccaaa

SEQ ID NO: 33073 - DNA, 20 bp, human
gaccatccccaactccgcca

SEQ ID NO: 33074 - DNA, 20 bp, human
gaggcagtattagggacccg

SEQ ID NO: 33075 - DNA, 20 bp, human
gctaatcctggcaagcgcga

SEQ ID NO: 33076 - DNA, 20 bp, human
ggtcagttgttgggctgtaa

SEQ ID NO: 33077 - DNA, 20 bp, human
gccctgacgaagtgactccc

SEQ ID NO: 33078 - DNA, 20 bp, human
gccgcggacagagacagttg

SEQ ID NO: 33079 - DNA, 20 bp, human
gagcccaacaactgacacgg

SEQ ID NO: 33080 - DNA, 20 bp, human
ggggcggaggcgacactctc

SEQ ID NO: 33081 - DNA, 20 bp, human
gccaacaactgacacggagg

SEQ ID NO: 33082 - DNA, 20 bp, human
gtccccggtggcggcaagag

SEQ ID NO: 33083 - DNA, 20 bp, human
gggtcccgggtccccggtgg

SEQ ID NO: 33084 - DNA, 20 bp, human
gtaggacctggctgggaccg

SEQ ID NO: 33085 - DNA, 20 bp, human
gggctccctgcagttctctc

SEQ ID NO: 33086 - DNA, 20 bp, human
gcggctgaacaaggttgtgg

SEQ ID NO: 33087 - DNA, 20 bp, human
ggttcccaatgtgcctccgg

SEQ ID NO: 33088 - DNA, 20 bp, human
gctagaaccccgaacgtggt

SEQ ID NO: 33089 - DNA, 20 bp, human
gatagggaggcggctgaaca

SEQ ID NO: 33090 - DNA, 20 bp, human
ggggttagaggcaacccgtg

SEQ ID NO: 33091 - DNA, 20 bp, human
gcaccggaaaaggctcatgt

SEQ ID NO: 33092 - DNA, 20 bp, human
ggaggctagaaccccgaacg

SEQ ID NO: 33093 - DNA, 20 bp, human
gaggaagcgctgcacactaa

SEQ ID NO: 33094 - DNA, 20 bp, human
gttcggggttctagcctcac

SEQ ID NO: 33095 - DNA, 20 bp, human
gctccaaccgaccacgttcg

SEQ ID NO: 33096 - DNA, 20 bp, human
gaaggtcttgcggtggtgcg

SEQ ID NO: 33097 - DNA, 20 bp, human
gcggtgtggaatcggcagcg

SEQ ID NO: 33098 - DNA, 20 bp, human
gaacgaagtgggaagtatcg

SEQ ID NO: 33099 - DNA, 20 bp, human
gtcaccccagaggatccaat

SEQ ID NO: 33100 - DNA, 20 bp, human
gagctttgaaggtcttgcgg

SEQ ID NO: 33101 - DNA, 20 bp, human
gtcaaaggcccagcacgaca

SEQ ID NO: 33102 - DNA, 20 bp, human
ggtcttgcggtggtgcgtgg

SEQ ID NO: 33103 - DNA, 20 bp, human
gggctgcgcctggtattggg

SEQ ID NO: 33104 - DNA, 20 bp, human
gtccgcccggggtctctgta

SEQ ID NO: 33105 - DNA, 20 bp, human
ggagccccgaggagacggca

SEQ ID NO: 33106 - DNA, 20 bp, human
gggcccaagggaggcgaccg

SEQ ID NO: 33107 - DNA, 20 bp, human
gccaagggaggcgaccgcgg

SEQ ID NO: 33108 - DNA, 20 bp, human
gcgagtcacaccatcaggtg

SEQ ID NO: 33109 - DNA, 20 bp, human
gcagctgctagctggcccaa

SEQ ID NO: 33110 - DNA, 20 bp, human
gggattcaaactcccggaag

SEQ ID NO: 33111 - DNA, 20 bp, human
gaagcggcatccacacctga

SEQ ID NO: 33112 - DNA, 20 bp, human
gtagcagctgaagcgaagcg

SEQ ID NO: 33113 - DNA, 20 bp, human
ggccgcgggattcaaactcc

SEQ ID NO: 33114 - DNA, 20 bp, human
gtcggccgagtcacaccatc

SEQ ID NO: 33115 - DNA, 20 bp, human
gcgcccctcgccaccctccg

SEQ ID NO: 33116 - DNA, 20 bp, human
gagcgtaggcggccctgagg

SEQ ID NO: 33117 - DNA, 20 bp, human
gcgaagtgcggagaccccct

SEQ ID NO: 33118 - DNA, 20 bp, human
gccctgggcaggctgaaaga

SEQ ID NO: 33119 - DNA, 20 bp, human
gctgtgtaagctgtgagcgt

SEQ ID NO: 33120 - DNA, 20 bp, human
gcctgcaacacaccccctca

SEQ ID NO: 33121 - DNA, 20 bp, human
gtacgccaaaaggtgaataa

SEQ ID NO: 33122 - DNA, 20 bp, human
gtgtaagctgtgagcgtagg

SEQ ID NO: 33123 - DNA, 20 bp, human
gtctggctcccagtgaaact

SEQ ID NO: 33124 - DNA, 20 bp, human
gggggagcgcggggcaatct

SEQ ID NO: 33125 - DNA, 20 bp, human
gctgaacccctgatggaaaa

SEQ ID NO: 33126 - DNA, 20 bp, human
ggcacccacaggcaacgtcg

SEQ ID NO: 33127 - DNA, 20 bp, human
gacgtcgcggtggcccctgg

SEQ ID NO: 33128 - DNA, 20 bp, human
gggacagagtccaaacgtcc

SEQ ID NO: 33129 - DNA, 20 bp, human
gcaaaaaagggcggaatcag

SEQ ID NO: 33130 - DNA, 20 bp, human
gcatgcgtagcagccggcag

SEQ ID NO: 33131 - DNA, 20 bp, human
gctgggccaagcgcccccgg

SEQ ID NO: 33132 - DNA, 20 bp, human
gcccaagcgcggggtgtggt

SEQ ID NO: 33133 - DNA, 20 bp, human
gctcagtcaaatgaaatcct

SEQ ID NO: 33134 - DNA, 20 bp, human
gggactctgtcctggagaag

SEQ ID NO: 33135 - DNA, 20 bp, human
gccaccgcgacgttgcctgt

SEQ ID NO: 33136 - DNA, 20 bp, human
ggcggcaaccctgtaaccgc

SEQ ID NO: 33137 - DNA, 20 bp, human
gtaacggcgggaaggctcag

SEQ ID NO: 33138 - DNA, 20 bp, human
gaggcaggatgtaccaaacg

SEQ ID NO: 33139 - DNA, 20 bp, human
gacaaacgcgccgactacag

SEQ ID NO: 33140 - DNA, 20 bp, human
gacaggccgtccctcagctg

SEQ ID NO: 33141 - DNA, 20 bp, human
gcagcgccggcccgaggtaa

SEQ ID NO: 33142 - DNA, 20 bp, human
gaaacgtggaagcggagacg

SEQ ID NO: 33143 - DNA, 20 bp, human
gcactcgtgtcgggaggaaa

SEQ ID NO: 33144 - DNA, 20 bp, human
ggccggtgcgcaagttggag

SEQ ID NO: 33145 - DNA, 20 bp, human
ggatgtaccaaacgtggaag

SEQ ID NO: 33146 - DNA, 20 bp, human
gagggccgcagttgcagtca

SEQ ID NO: 33147 - DNA, 20 bp, human
ggtcagggtccgccagctcg

SEQ ID NO: 33148 - DNA, 20 bp, human
gacgcttcgcacgtccggag

SEQ ID NO: 33149 - DNA, 20 bp, human
gtgcgctggccccgagctgg

SEQ ID NO: 33150 - DNA, 20 bp, human
gaggcaccgaagagacgcgg

SEQ ID NO: 33151 - DNA, 20 bp, human
gtggtcggcctgggccccgg

SEQ ID NO: 33152 - DNA, 20 bp, human
gaacagcccacgcccgggag

SEQ ID NO: 33153 - DNA, 20 bp, human
gacgcccgggagaggcctga

SEQ ID NO: 33154 - DNA, 20 bp, human
gcagacggcccgcaccgcaa

SEQ ID NO: 33155 - DNA, 20 bp, human
gcgcaccgcaagggccccgc

SEQ ID NO: 33156 - DNA, 20 bp, human
gggaggccggcgactgagta

SEQ ID NO: 33157 - DNA, 20 bp, human
gggcgactgagtaaggtgag

SEQ ID NO: 33158 - DNA, 20 bp, human
gatcccagcctaacctggcc

SEQ ID NO: 33159 - DNA, 20 bp, human
ggtaaggtgagtggctctcg

SEQ ID NO: 33160 - DNA, 20 bp, human
ggcattcgcaggccaaagag

SEQ ID NO: 33161 - DNA, 20 bp, human
ggatggctcctccccgacaa

SEQ ID NO: 33162 - DNA, 20 bp, human
ggcggtggtaacggtcgcgg

SEQ ID NO: 33163 - DNA, 20 bp, human
gcctcccccggcggtggtaa

SEQ ID NO: 33164 - DNA, 20 bp, human
ggtcagactgacccttgtcg

SEQ ID NO: 33165 - DNA, 20 bp, human
gtaaagcttagaatcacgtc

SEQ ID NO: 33166 - DNA, 20 bp, human
gccgcgcaggcgccgtccga

SEQ ID NO: 33167 - DNA, 20 bp, human
ggaggtgatccccagcggga

SEQ ID NO: 33168 - DNA, 20 bp, human
ggagtgggcccaggagaacc

SEQ ID NO: 33169 - DNA, 20 bp, human
gttcaaacggagccctcgga

SEQ ID NO: 33170 - DNA, 20 bp, human
gaggcggttcgggcgaagag

SEQ ID NO: 33171 - DNA, 20 bp, human
ggagggctccgtttgaaaca

SEQ ID NO: 33172 - DNA, 20 bp, human
gcggatgtaacccccagtca

SEQ ID NO: 33173 - DNA, 20 bp, human
gggccgcacctgggcacggg

SEQ ID NO: 33174 - DNA, 20 bp, human
ggcccgcgccatgtttcaaa

SEQ ID NO: 33175 - DNA, 20 bp, human
gcgctcctggacagcaaggc

SEQ ID NO: 33176 - DNA, 20 bp, human
gcgcctagcgcagctcccgg

SEQ ID NO: 33177 - DNA, 20 bp, human
gggccgggccagggagcgtt

SEQ ID NO: 33178 - DNA, 20 bp, human
gagggagcgttaggagcgac

SEQ ID NO: 33179 - DNA, 20 bp, human
ggggagctgcgctaggcgaa

SEQ ID NO: 33180 - DNA, 20 bp, human
gtgcgctaggcgaacggctg

SEQ ID NO: 33181 - DNA, 20 bp, human
gtctggggcgatagaacgag

SEQ ID NO: 33182 - DNA, 20 bp, human
ggcaggtgctagcaagagtc

SEQ ID NO: 33183 - DNA, 20 bp, human
gcgcgcagttagggcatctg

SEQ ID NO: 33184 - DNA, 20 bp, human
gggggtgcgcaacgcagagt

SEQ ID NO: 33185 - DNA, 20 bp, human
ggtcccccgggagctgcgct

SEQ ID NO: 33186 - DNA, 20 bp, human
gagctcttgatggagaccaa

SEQ ID NO: 33187 - DNA, 20 bp, human
ggcctcagaggactatgagg

SEQ ID NO: 33188 - DNA, 20 bp, human
gcccgcctcatagtcctctg

SEQ ID NO: 33189 - DNA, 20 bp, human
ggccctgcggcccaagcagt

SEQ ID NO: 33190 - DNA, 20 bp, human
gaggcgcccagtccaccccg

SEQ ID NO: 33191 - DNA, 20 bp, human
gtgcgcgcctgtctccggga

SEQ ID NO: 33192 - DNA, 20 bp, human
ggcgcacaggtactcgtagt

SEQ ID NO: 33193 - DNA, 20 bp, human
gaggcgggcgccaactgctt

SEQ ID NO: 33194 - DNA, 20 bp, human
gcgcccagtccaccccgcgg

SEQ ID NO: 33195 - DNA, 20 bp, human
gcgcccaccggcttgaatcc

SEQ ID NO: 33196 - DNA, 20 bp, human
gccgttagaggagctgaggg

SEQ ID NO: 33197 - DNA, 20 bp, human
gtcgcgacctgccaccgtga

SEQ ID NO: 33198 - DNA, 20 bp, human
gggcgtgcaacggccgttag

SEQ ID NO: 33199 - DNA, 20 bp, human
gccgctcaccgcagacgtgg

SEQ ID NO: 33200 - DNA, 20 bp, human
gcggccgttagaggagctga

SEQ ID NO: 33201 - DNA, 20 bp, human
gagggctgtgcgctccgcaa

SEQ ID NO: 33202 - DNA, 20 bp, human
ggcggcgaaatccctcactc

SEQ ID NO: 33203 - DNA, 20 bp, human
ggcttcgccggagctatggg

SEQ ID NO: 33204 - DNA, 20 bp, human
gcgcttaacgtcgactccca

SEQ ID NO: 33205 - DNA, 20 bp, human
gtctccccggcccctcacgg

SEQ ID NO: 33206 - DNA, 20 bp, human
ggtgacggctgctagatccc

SEQ ID NO: 33207 - DNA, 20 bp, human
ggcgtgggcctcggcgacac

SEQ ID NO: 33208 - DNA, 20 bp, human
ggaggacactgggcacgcgg

SEQ ID NO: 33209 - DNA, 20 bp, human
gcagcacccgggctgacata

SEQ ID NO: 33210 - DNA, 20 bp, human
ggaggcggccggggtaagac

SEQ ID NO: 33211 - DNA, 20 bp, human
gccgccgccgaagaagcagg

SEQ ID NO: 33212 - DNA, 20 bp, human
ggcgctgtcccgttccttac

SEQ ID NO: 33213 - DNA, 20 bp, human
gcttccctgccggtaaggaa

SEQ ID NO: 33214 - DNA, 20 bp, human
gaaggaacgggacagcgccc

SEQ ID NO: 33215 - DNA, 20 bp, human
ggcgcctgccatggccaagc

SEQ ID NO: 33216 - DNA, 20 bp, human
gcgccgcgcgtggggctctg

SEQ ID NO: 33217 - DNA, 20 bp, human
gttggcctgagatccagtca

SEQ ID NO: 33218 - DNA, 20 bp, human
gcagcgcgaggagaatggac

SEQ ID NO: 33219 - DNA, 20 bp, human
ggcagatctatccacagcca

SEQ ID NO: 33220 - DNA, 20 bp, human
gtagatctgctgatgagtcc

SEQ ID NO: 33221 - DNA, 20 bp, human
gggctttagggagtggtccc

SEQ ID NO: 33222 - DNA, 20 bp, human
ggcgctgcaaggatgctcct

SEQ ID NO: 33223 - DNA, 20 bp, human
gttgcgaagagaaagcgtga

SEQ ID NO: 33224 - DNA, 20 bp, human
ggcggcctctccgaaatccc

SEQ ID NO: 33225 - DNA, 20 bp, human
gccttgcagcgcgaggagaa

SEQ ID NO: 33226 - DNA, 20 bp, human
gctcagggcccatagtgcaa

SEQ ID NO: 33227 - DNA, 20 bp, human
ggcgtccgcgccccagtgtc

SEQ ID NO: 33228 - DNA, 20 bp, human
ggcggagggcacacggacag

SEQ ID NO: 33229 - DNA, 20 bp, human
gccacgcagacccgacactg

SEQ ID NO: 33230 - DNA, 20 bp, human
ggacgcggccgggaaggcga

SEQ ID NO: 33231 - DNA, 20 bp, human
gccacagaaagacaagtccg

SEQ ID NO: 33232 - DNA, 20 bp, human
gcgggaaggcgacggtgtcc

SEQ ID NO: 33233 - DNA, 20 bp, human
gaaggcgacggtgtcctgga

SEQ ID NO: 33234 - DNA, 20 bp, human
gcggtcagaagggtcgtccc

SEQ ID NO: 33235 - DNA, 20 bp, human
gagctgagagaccctatcca

SEQ ID NO: 33236 - DNA, 20 bp, human
gcaagcagcaaatatggcgg

SEQ ID NO: 33237 - DNA, 20 bp, human
gcgcgctcccgatgctgagg

SEQ ID NO: 33238 - DNA, 20 bp, human
ggccgcgcgaaggcttctgg

SEQ ID NO: 33239 - DNA, 20 bp, human
gactaggcagcggtctctga

SEQ ID NO: 33240 - DNA, 20 bp, human
gtcgccttaccttctccggg

SEQ ID NO: 33241 - DNA, 20 bp, human
gttgcctcccggagaaggta

SEQ ID NO: 33242 - DNA, 20 bp, human
ggagcttgtaatctgaagga

SEQ ID NO: 33243 - DNA, 20 bp, human
gtattagcaagcagcaaata

SEQ ID NO: 33244 - DNA, 20 bp, human
gttccaggaaccaagaagag

SEQ ID NO: 33245 - DNA, 20 bp, human
gggcagcggtctctgaggga

SEQ ID NO: 33246 - DNA, 20 bp, human
gtgtgtgggagcccaaggta

SEQ ID NO: 33247 - DNA, 20 bp, human
gtcggaggcgatatttctag

SEQ ID NO: 33248 - DNA, 20 bp, human
gagccgactgggtgactgat

SEQ ID NO: 33249 - DNA, 20 bp, human
gcgcttccggagaaaatcag

SEQ ID NO: 33250 - DNA, 20 bp, human
gcgccgatcagtcacccagt

SEQ ID NO: 33251 - DNA, 20 bp, human
gctgacaagcaaggtccgtt

SEQ ID NO: 33252 - DNA, 20 bp, human
ggtaggggtgggaagaaccg

SEQ ID NO: 33253 - DNA, 20 bp, human
gcctccgactccagccgact

SEQ ID NO: 33254 - DNA, 20 bp, human
gcttggggcaggaggagagt

SEQ ID NO: 33255 - DNA, 20 bp, human
gtagcccccggaggcaatga

SEQ ID NO: 33256 - DNA, 20 bp, human
gatgatgaggcccaaaggag

SEQ ID NO: 33257 - DNA, 20 bp, human
ggccgtgtggtctttcctag

SEQ ID NO: 33258 - DNA, 20 bp, human
ggaggagatgcatgctgtca

SEQ ID NO: 33259 - DNA, 20 bp, human
gccctcatccagccgataga

SEQ ID NO: 33260 - DNA, 20 bp, human
ggcactgcgacaaacagatc

SEQ ID NO: 33261 - DNA, 20 bp, human
gaaaaactccggcttctcag

SEQ ID NO: 33262 - DNA, 20 bp, human
gtcttggcttcttcccgaag

SEQ ID NO: 33263 - DNA, 20 bp, human
gtatcggctggatgagggac

SEQ ID NO: 33264 - DNA, 20 bp, human
gagagaaatgcatccatcca

SEQ ID NO: 33265 - DNA, 20 bp, human
gttccttggcaggagtacgg

SEQ ID NO: 33266 - DNA, 20 bp, human
ggccggcccgagagctccgg

SEQ ID NO: 33267 - DNA, 20 bp, human
gcgcatggcgggcgcttggg

SEQ ID NO: 33268 - DNA, 20 bp, human
gccgggcattggcaccgagt

SEQ ID NO: 33269 - DNA, 20 bp, human
gccccaagaggaaggagtag

SEQ ID NO: 33270 - DNA, 20 bp, human
gccagagcgcccaggtagtg

SEQ ID NO: 33271 - DNA, 20 bp, human
gtgcccgggtctctcaccag

SEQ ID NO: 33272 - DNA, 20 bp, human
ggagcggctggactaccccc

SEQ ID NO: 33273 - DNA, 20 bp, human
ggggagacgacagacctctg

SEQ ID NO: 33274 - DNA, 20 bp, human
gtggcagggccgtctgtgag

SEQ ID NO: 33275 - DNA, 20 bp, human
gggcagggagcgagcagaca

SEQ ID NO: 33276 - DNA, 20 bp, human
gggcggagatgggggcgacg

SEQ ID NO: 33277 - DNA, 20 bp, human
gaccgggtgcagggagcgag

SEQ ID NO: 33278 - DNA, 20 bp, human
ggcccctgcagtggcccggg

SEQ ID NO: 33279 - DNA, 20 bp, human
gggagcgagcggctgtggta

SEQ ID NO: 33280 - DNA, 20 bp, human
ggccgcccgggccactgcag

SEQ ID NO: 33281 - DNA, 20 bp, human
ggggttcccggagcagacgg

SEQ ID NO: 33282 - DNA, 20 bp, human
ggcaggggccgctaacggtc

SEQ ID NO: 33283 - DNA, 20 bp, human
gaaagcgccgcgcagtggag

SEQ ID NO: 33284 - DNA, 20 bp, human
gcccacagcacggattgcag

SEQ ID NO: 33285 - DNA, 20 bp, human
ggccaggtccggccgaaccc

SEQ ID NO: 33286 - DNA, 20 bp, human
gctggacgcggctagagctg

SEQ ID NO: 33287 - DNA, 20 bp, human
ggctgtggcagcgctggacg

SEQ ID NO: 33288 - DNA, 20 bp, human
ggggtggagcaaaagctcgt

SEQ ID NO: 33289 - DNA, 20 bp, human
gaacagcgccggaggcacag

SEQ ID NO: 33290 - DNA, 20 bp, human
gcagtgaggcgagcacgggg

SEQ ID NO: 33291 - DNA, 20 bp, human
gacgtccccgcagcagacgg

SEQ ID NO: 33292 - DNA, 20 bp, human
ggccctgcgcgccgttgctg

SEQ ID NO: 33293 - DNA, 20 bp, human
gtccccgcagcagacggagg

SEQ ID NO: 33294 - DNA, 20 bp, human
ggagcgagcgagcactgcgg

SEQ ID NO: 33295 - DNA, 20 bp, human
ggggactcggtaacctgtcc

SEQ ID NO: 33296 - DNA, 20 bp, human
gggcggggccgctagctgag

SEQ ID NO: 33297 - DNA, 20 bp, human
gctgctagcccctcagctag

SEQ ID NO: 33298 - DNA, 20 bp, human
gcccgcgcggccacgacacg

SEQ ID NO: 33299 - DNA, 20 bp, human
gggacgcgtgcgcaggcgtc

SEQ ID NO: 33300 - DNA, 20 bp, human
gcaggacctactaacaacaa

SEQ ID NO: 33301 - DNA, 20 bp, human
gtttcttttgtggatagcat

SEQ ID NO: 33302 - DNA, 20 bp, human
gcttatgggcaattatggag

SEQ ID NO: 33303 - DNA, 20 bp, human
ggcggcgtccggaggcccca

SEQ ID NO: 33304 - DNA, 20 bp, human
ggggcgaattcctcgtgtcg

SEQ ID NO: 33305 - DNA, 20 bp, human
gtcactcaagtaccccctgc

SEQ ID NO: 33306 - DNA, 20 bp, human
gcggctccgtcggctaccgc

SEQ ID NO: 33307 - DNA, 20 bp, human
gcgggcgcaggcgacgggca

SEQ ID NO: 33308 - DNA, 20 bp, human
gctggctgctgcggatgaag

SEQ ID NO: 33309 - DNA, 20 bp, human
gccagcagcagcagctcggg

SEQ ID NO: 33310 - DNA, 20 bp, human
gggcgggcgagcgggcggta

SEQ ID NO: 33311 - DNA, 20 bp, human
ggggcgagcgggcggtatgg

SEQ ID NO: 33312 - DNA, 20 bp, human
gctggagaggcccaggacgt

SEQ ID NO: 33313 - DNA, 20 bp, human
ggcccgcccgcggtagccga

SEQ ID NO: 33314 - DNA, 20 bp, human
gacgttggagccccaggata

SEQ ID NO: 33315 - DNA, 20 bp, human
ggaggcccccacccacgttc

SEQ ID NO: 33316 - DNA, 20 bp, human
gcggcctttttttcccggct

SEQ ID NO: 33317 - DNA, 20 bp, human
gggggccccgactcacccgg

SEQ ID NO: 33318 - DNA, 20 bp, human
gcccgagcagacggagtaca

SEQ ID NO: 33319 - DNA, 20 bp, human
gctttcccgggcaacaggta

SEQ ID NO: 33320 - DNA, 20 bp, human
ggacggagtacacggagcag

SEQ ID NO: 33321 - DNA, 20 bp, human
gtcccgggcaacaggtaggg

SEQ ID NO: 33322 - DNA, 20 bp, human
gggaggagcttggtgaccat

SEQ ID NO: 33323 - DNA, 20 bp, human
gggcgcgagagcctccaccc

SEQ ID NO: 33324 - DNA, 20 bp, human
gactcacccggcggcagcgt

SEQ ID NO: 33325 - DNA, 20 bp, human
ggcgggggccccgactcacc

SEQ ID NO: 33326 - DNA, 20 bp, human
ggagcaatgcaggtcaggag

SEQ ID NO: 33327 - DNA, 20 bp, human
gcctgggtgcgtaacagaga

SEQ ID NO: 33328 - DNA, 20 bp, human
gacgaagctggttggaacgt

SEQ ID NO: 33329 - DNA, 20 bp, human
gtctctgaggagaacgaagc

SEQ ID NO: 33330 - DNA, 20 bp, human
gagggttaggaagaaaggtc

SEQ ID NO: 33331 - DNA, 20 bp, human
gcccgagagcaatgcaggtc

SEQ ID NO: 33332 - DNA, 20 bp, human
gttggagggtgggtctctga

SEQ ID NO: 33333 - DNA, 20 bp, human
gcattgagggttaggaagaa

SEQ ID NO: 33334 - DNA, 20 bp, human
gaaaggtaggcgccatccca

SEQ ID NO: 33335 - DNA, 20 bp, human
gcaggtcaggagtggaagtt

SEQ ID NO: 33336 - DNA, 20 bp, human
gagcagagtccggctgcctg

SEQ ID NO: 33337 - DNA, 20 bp, human
gaacgggctggagcgagtag

SEQ ID NO: 33338 - DNA, 20 bp, human
gcaacgggtgcccgaggacg

SEQ ID NO: 33339 - DNA, 20 bp, human
ggaggacgcggctgtgaaac

SEQ ID NO: 33340 - DNA, 20 bp, human
gctggcacgtcggggaaacg

SEQ ID NO: 33341 - DNA, 20 bp, human
gtgcgccccggccctcgtgg

SEQ ID NO: 33342 - DNA, 20 bp, human
gacgcggctgtgaaacgggc

SEQ ID NO: 33343 - DNA, 20 bp, human
gtcctggcctcgtgacgcgg

SEQ ID NO: 33344 - DNA, 20 bp, human
ggagcgagtaggggcgatcc

SEQ ID NO: 33345 - DNA, 20 bp, human
gccccagccctggcacgtcg

SEQ ID NO: 33346 - DNA, 20 bp, human
gcggcagctgacgcttgtgg

SEQ ID NO: 33347 - DNA, 20 bp, human
gcgggttccgttggctgtgg

SEQ ID NO: 33348 - DNA, 20 bp, human
gcagctgccgccacagccaa

SEQ ID NO: 33349 - DNA, 20 bp, human
ggtggtagcctagatggaga

SEQ ID NO: 33350 - DNA, 20 bp, human
ggcggcggtggcttcggggt

SEQ ID NO: 33351 - DNA, 20 bp, human
gcgggtgatgctaggcgcgt

SEQ ID NO: 33352 - DNA, 20 bp, human
gggcgaggtggtagcctaga

SEQ ID NO: 33353 - DNA, 20 bp, human
ggcctccccgcgggttccgt

SEQ ID NO: 33354 - DNA, 20 bp, human
gggccgcggcgggtgatgct

SEQ ID NO: 33355 - DNA, 20 bp, human
gccgctgtgggaagggccga

SEQ ID NO: 33356 - DNA, 20 bp, human
gcagagggaggagagaaccg

SEQ ID NO: 33357 - DNA, 20 bp, human
gccgcggccgctgctctcga

SEQ ID NO: 33358 - DNA, 20 bp, human
gccccagcgcggccagaggg

SEQ ID NO: 33359 - DNA, 20 bp, human
gcgcgagccttcgagagcag

SEQ ID NO: 33360 - DNA, 20 bp, human
ggcggacctgaagaacacgg

SEQ ID NO: 33361 - DNA, 20 bp, human
gcatcttcgagaggtaagaa

SEQ ID NO: 33362 - DNA, 20 bp, human
gtgggcggacctgaagaaca

SEQ ID NO: 33363 - DNA, 20 bp, human
gccgcccaggtgacattgtg

SEQ ID NO: 33364 - DNA, 20 bp, human
gggtgcggctcatcttcgag

SEQ ID NO: 33365 - DNA, 20 bp, human
gagcctggttctggaacgag

SEQ ID NO: 33366 - DNA, 20 bp, human
gaaggcacggagccacatcg

SEQ ID NO: 33367 - DNA, 20 bp, human
gccgtaaggggactaattaa

SEQ ID NO: 33368 - DNA, 20 bp, human
gcacggagccacatcgtgga

SEQ ID NO: 33369 - DNA, 20 bp, human
gggaagggcgacagttctcg

SEQ ID NO: 33370 - DNA, 20 bp, human
gacggctggatcacggagag

SEQ ID NO: 33371 - DNA, 20 bp, human
gtccccttacggctggatca

SEQ ID NO: 33372 - DNA, 20 bp, human
gctccgtgatccagccgtaa

SEQ ID NO: 33373 - DNA, 20 bp, human
gaggtctctgtgcagttcag

SEQ ID NO: 33374 - DNA, 20 bp, human
gcaggtccggctctgcggcg

SEQ ID NO: 33375 - DNA, 20 bp, human
gccgacagccggcccacctc

SEQ ID NO: 33376 - DNA, 20 bp, human
ggcctgaggtgcgagagaag

SEQ ID NO: 33377 - DNA, 20 bp, human
gtcccgggtccgagcagcca

SEQ ID NO: 33378 - DNA, 20 bp, human
gaggccgagaacccacaacg

SEQ ID NO: 33379 - DNA, 20 bp, human
gctcggacccgggaacatga

SEQ ID NO: 33380 - DNA, 20 bp, human
ggcgtccccacagcttggac

SEQ ID NO: 33381 - DNA, 20 bp, human
gccacagcttggaccggcag

SEQ ID NO: 33382 - DNA, 20 bp, human
ggcgagagaagcggtgaccg

SEQ ID NO: 33383 - DNA, 20 bp, human
ggccagaaccaggtctcagg

SEQ ID NO: 33384 - DNA, 20 bp, human
gggagctcccgtatccagga

SEQ ID NO: 33385 - DNA, 20 bp, human
ggagggacacgccgcgttgt

SEQ ID NO: 33386 - DNA, 20 bp, human
gccactgctggacagacccg

SEQ ID NO: 33387 - DNA, 20 bp, human
gggcagcctggggtcggagt

SEQ ID NO: 33388 - DNA, 20 bp, human
gtgaacagcagcgtgtccgc

SEQ ID NO: 33389 - DNA, 20 bp, human
gcctccccgccgcccaaggt

SEQ ID NO: 33390 - DNA, 20 bp, human
gggtctcggttcgctgccgg

SEQ ID NO: 33391 - DNA, 20 bp, human
gtagaagcacagaaagggtc

SEQ ID NO: 33392 - DNA, 20 bp, human
gcctcacccactccgacccc

SEQ ID NO: 33393 - DNA, 20 bp, human
gcaggccgggtaggcagcct

SEQ ID NO: 33394 - DNA, 20 bp, human
gcaaggcactgatccactgc

SEQ ID NO: 33395 - DNA, 20 bp, human
gctccgagggagcctcaccc

SEQ ID NO: 33396 - DNA, 20 bp, human
ggttcgacagaagcttcaga

SEQ ID NO: 33397 - DNA, 20 bp, human
ggaaccagttgtaaggagaa

SEQ ID NO: 33398 - DNA, 20 bp, human
gacagccctttagagatcgg

SEQ ID NO: 33399 - DNA, 20 bp, human
ggacagggacagggagcagt

SEQ ID NO: 33400 - DNA, 20 bp, human
gttctgtcgaaccagttgta

SEQ ID NO: 33401 - DNA, 20 bp, human
gagcaggtgtgtcttaccag

SEQ ID NO: 33402 - DNA, 20 bp, human
gtcaagagtgagacagggac

SEQ ID NO: 33403 - DNA, 20 bp, human
gcctgcagaggtacttggtg

SEQ ID NO: 33404 - DNA, 20 bp, human
gagcagtgggccgaccgctc

SEQ ID NO: 33405 - DNA, 20 bp, human
gtagagatcggtggtgctga

SEQ ID NO: 33406 - DNA, 20 bp, human
gagggtccgcagtgagaaga

SEQ ID NO: 33407 - DNA, 20 bp, human
gcgggagacctggcactcac

SEQ ID NO: 33408 - DNA, 20 bp, human
gacctgcgggcaccaggtag

SEQ ID NO: 33409 - DNA, 20 bp, human
gtgcgggcaccaggtagcgg

SEQ ID NO: 33410 - DNA, 20 bp, human
gccacagctgcggtcccaaa

SEQ ID NO: 33411 - DNA, 20 bp, human
ggggagatcgtttcaatcca

SEQ ID NO: 33412 - DNA, 20 bp, human
gcggcatcttcggcttcctg

SEQ ID NO: 33413 - DNA, 20 bp, human
gagagcggcggggactgggt

SEQ ID NO: 33414 - DNA, 20 bp, human
gttggccgcccgcgagaaag

SEQ ID NO: 33415 - DNA, 20 bp, human
gctgcggtcccaaagggtac

SEQ ID NO: 33416 - DNA, 20 bp, human
gcagggtgtgagcaacccaa

SEQ ID NO: 33417 - DNA, 20 bp, human
gtaacaggcaaatgctgaat

SEQ ID NO: 33418 - DNA, 20 bp, human
gtcccaactgaagctctctg

SEQ ID NO: 33419 - DNA, 20 bp, human
gaggcaaatgctgaataggc

SEQ ID NO: 33420 - DNA, 20 bp, human
gggcctcagagagcttcagt

SEQ ID NO: 33421 - DNA, 20 bp, human
gggagggctctcagaagatg

SEQ ID NO: 33422 - DNA, 20 bp, human
gactctgtgaacattgacgg

SEQ ID NO: 33423 - DNA, 20 bp, human
ggaaagagcttcctgttaac

SEQ ID NO: 33424 - DNA, 20 bp, human
ggatatccaatgggaaagga

SEQ ID NO: 33425 - DNA, 20 bp, human
gggcaggcagccaaatgagt

SEQ ID NO: 33426 - DNA, 20 bp, human
gctggccgccgtggtcccaa

SEQ ID NO: 33427 - DNA, 20 bp, human
gggtgccgttgggaccacgg

SEQ ID NO: 33428 - DNA, 20 bp, human
ggcgctgggcttcttgaagc

SEQ ID NO: 33429 - DNA, 20 bp, human
gtctccgaggtggacaggga

SEQ ID NO: 33430 - DNA, 20 bp, human
ggagctgggggagaacctca

SEQ ID NO: 33431 - DNA, 20 bp, human
gtttctcttttggccggtgg

SEQ ID NO: 33432 - DNA, 20 bp, human
gaggttctcccccagctcgt

SEQ ID NO: 33433 - DNA, 20 bp, human
gcgacgaagctgatcgggat

SEQ ID NO: 33434 - DNA, 20 bp, human
gcccgaatgagagcgcgggg

SEQ ID NO: 33435 - DNA, 20 bp, human
gtctgatcctcagtgagctc

SEQ ID NO: 33436 - DNA, 20 bp, human
ggccgagtcagtgtacacgt

SEQ ID NO: 33437 - DNA, 20 bp, human
gacgtcggttgcctaacaac

SEQ ID NO: 33438 - DNA, 20 bp, human
ggttgcctaacaaccggcag

SEQ ID NO: 33439 - DNA, 20 bp, human
gtgtcgcgccccacgcccag

SEQ ID NO: 33440 - DNA, 20 bp, human
ggagtccgctgccggttgtt

SEQ ID NO: 33441 - DNA, 20 bp, human
gcaaggtctgagagagtcag

SEQ ID NO: 33442 - DNA, 20 bp, human
gcagcggactcctttggcta

SEQ ID NO: 33443 - DNA, 20 bp, human
gaaccggcagcggactcctt

SEQ ID NO: 33444 - DNA, 20 bp, human
gaatgcaaggggagcccgag

SEQ ID NO: 33445 - DNA, 20 bp, human
gagcgaagcgcaggcccagt

SEQ ID NO: 33446 - DNA, 20 bp, human
ggaggaaaggaagggcagta

SEQ ID NO: 33447 - DNA, 20 bp, human
gggacaggaaaaatgaactt

SEQ ID NO: 33448 - DNA, 20 bp, human
gttcagttctttaacatcta

SEQ ID NO: 33449 - DNA, 20 bp, human
gaagtgaaattgataaggaa

SEQ ID NO: 33450 - DNA, 20 bp, human
gaaaggaagggcagtacggc

SEQ ID NO: 33451 - DNA, 20 bp, human
gctgcagtaagtaacagggg

SEQ ID NO: 33452 - DNA, 20 bp, human
gaaggggtagagaggtgata

SEQ ID NO: 33453 - DNA, 20 bp, human
gaaattgataaggaagggac

SEQ ID NO: 33454 - DNA, 20 bp, human
gttcttgggttcaaagccca

SEQ ID NO: 33455 - DNA, 20 bp, human
gttttcgatgcggatggaac

SEQ ID NO: 33456 - DNA, 20 bp, human
ggcgtcttgctgccttgggt

SEQ ID NO: 33457 - DNA, 20 bp, human
ggacgcgggaaaggagccta

SEQ ID NO: 33458 - DNA, 20 bp, human
gcccagagggtgagtgatcc

SEQ ID NO: 33459 - DNA, 20 bp, human
gaggcacacggatgaatgaa

SEQ ID NO: 33460 - DNA, 20 bp, human
ggcttagttgcgagcgaggt

SEQ ID NO: 33461 - DNA, 20 bp, human
ggattttaaccccctaccca

SEQ ID NO: 33462 - DNA, 20 bp, human
ggtcgttcgtgtctgttgaa

SEQ ID NO: 33463 - DNA, 20 bp, human
gcagacacgaacgacctcag

SEQ ID NO: 33464 - DNA, 20 bp, human
gcagcggagcagccgaggtg

SEQ ID NO: 33465 - DNA, 20 bp, human
ggtgtctgttgaacggctgt

SEQ ID NO: 33466 - DNA, 20 bp, human
gcagcatggttatcaggcag

SEQ ID NO: 33467 - DNA, 20 bp, human
ggtgcctttggagcaggcat

SEQ ID NO: 33468 - DNA, 20 bp, human
ggggaggctcctggcatagt

SEQ ID NO: 33469 - DNA, 20 bp, human
ggcattgcccagcagggcca

SEQ ID NO: 33470 - DNA, 20 bp, human
gtgggcggacatacatatac

SEQ ID NO: 33471 - DNA, 20 bp, human
ggtgtccatgaaaagacccc

SEQ ID NO: 33472 - DNA, 20 bp, human
gtcctctctctgggctagtg

SEQ ID NO: 33473 - DNA, 20 bp, human
gagatctgagccaggttagg

SEQ ID NO: 33474 - DNA, 20 bp, human
ggctccaggctgaacggctc

SEQ ID NO: 33475 - DNA, 20 bp, human
gtcagcccatctccctccca

SEQ ID NO: 33476 - DNA, 20 bp, human
gagggaatgtgaccaggtct

SEQ ID NO: 33477 - DNA, 20 bp, human
gtacgtgtctgcacagggta

SEQ ID NO: 33478 - DNA, 20 bp, human
gatgtgaccaggtctaggtc

SEQ ID NO: 33479 - DNA, 20 bp, human
gcgggccaaagaccatggag

SEQ ID NO: 33480 - DNA, 20 bp, human
gtggagggggtagagatcaa

SEQ ID NO: 33481 - DNA, 20 bp, human
ggtttgagggcaatgagtgt

SEQ ID NO: 33482 - DNA, 20 bp, human
gtggtcacacctgaagagaa

SEQ ID NO: 33483 - DNA, 20 bp, human
gaggggaagggaatgtgacc

SEQ ID NO: 33484 - DNA, 20 bp, human
ggaaactccagacctagacc

SEQ ID NO: 33485 - DNA, 20 bp, human
gcaggaccccgtagatctgc

SEQ ID NO: 33486 - DNA, 20 bp, human
gtcagccaggagaaacggga

SEQ ID NO: 33487 - DNA, 20 bp, human
ggtccctgagctagggtcgg

SEQ ID NO: 33488 - DNA, 20 bp, human
gcccagccaggtctcataga

SEQ ID NO: 33489 - DNA, 20 bp, human
ggcagtccctgagctagggt

SEQ ID NO: 33490 - DNA, 20 bp, human
gcgcccccgaccctagctca

SEQ ID NO: 33491 - DNA, 20 bp, human
gttgttcttcaggctcggag

SEQ ID NO: 33492 - DNA, 20 bp, human
gttctgcagtccctgagcta

SEQ ID NO: 33493 - DNA, 20 bp, human
gggaggcaccatgtcaggta

SEQ ID NO: 33494 - DNA, 20 bp, human
gccatgtcaggtaaggacag

SEQ ID NO: 33495 - DNA, 20 bp, human
gagccactgttcattaaagg

SEQ ID NO: 33496 - DNA, 20 bp, human
ggtccctgagctagggtcgg

SEQ ID NO: 33497 - DNA, 20 bp, human
gcccagccaggtctcataga

SEQ ID NO: 33498 - DNA, 20 bp, human
gtcagccaggagaaacggga

SEQ ID NO: 33499 - DNA, 20 bp, human
ggcagtccctgagctagggt

SEQ ID NO: 33500 - DNA, 20 bp, human
gcgcccccgaccctagctca

SEQ ID NO: 33501 - DNA, 20 bp, human
gttgttcttcaggctcggag

SEQ ID NO: 33502 - DNA, 20 bp, human
gttctgcagtccctgagcta

SEQ ID NO: 33503 - DNA, 20 bp, human
gggaggcaccatgtcaggta

SEQ ID NO: 33504 - DNA, 20 bp, human
gccatgtcaggtaaggacag

SEQ ID NO: 33505 - DNA, 20 bp, human
gagccactgttcattaaagg

SEQ ID NO: 33506 - DNA, 20 bp, human
gccgctgcccacccggggag

SEQ ID NO: 33507 - DNA, 20 bp, human
gtggggggcagtccctcaga

SEQ ID NO: 33508 - DNA, 20 bp, human
gaggcactgcgcccagggta

SEQ ID NO: 33509 - DNA, 20 bp, human
ggcaggcggccgctcctagg

SEQ ID NO: 33510 - DNA, 20 bp, human
gtaggaggaccagaactgcc

SEQ ID NO: 33511 - DNA, 20 bp, human
ggatcccagcgccctaccct

SEQ ID NO: 33512 - DNA, 20 bp, human
ggttctggtcctcctaggag

SEQ ID NO: 33513 - DNA, 20 bp, human
ggcccaggcctcctcaccgc

SEQ ID NO: 33514 - DNA, 20 bp, human
gcaggcctcctcaccgcagg

SEQ ID NO: 33515 - DNA, 20 bp, human
gcagagtacagaacccacag

SEQ ID NO: 33516 - DNA, 20 bp, human
gccgcagcagccgcctccaa

SEQ ID NO: 33517 - DNA, 20 bp, human
ggcggcgacggcagctaggg

SEQ ID NO: 33518 - DNA, 20 bp, human
gctccaacggcaaagctcta

SEQ ID NO: 33519 - DNA, 20 bp, human
gagagaccatagagccccgg

SEQ ID NO: 33520 - DNA, 20 bp, human
ggggagagaccatagagccc

SEQ ID NO: 33521 - DNA, 20 bp, human
ggttcccgcgctgcaagagg

SEQ ID NO: 33522 - DNA, 20 bp, human
gcgccgccgccggggctcta

SEQ ID NO: 33523 - DNA, 20 bp, human
gccggagctgcccaacggga

SEQ ID NO: 33524 - DNA, 20 bp, human
gcccgcgctgcaagaggggg

SEQ ID NO: 33525 - DNA, 20 bp, human
ggcagagcgcgcctcacgtg

SEQ ID NO: 33526 - DNA, 20 bp, human
gtggtagcatagttcttcag

SEQ ID NO: 33527 - DNA, 20 bp, human
gaggcaaagcaacaaggtct

SEQ ID NO: 33528 - DNA, 20 bp, human
gcacctggctggaatgctct

SEQ ID NO: 33529 - DNA, 20 bp, human
ggcaacaaggtctaggaaca

SEQ ID NO: 33530 - DNA, 20 bp, human
gccttgaaggcagcatcacc

SEQ ID NO: 33531 - DNA, 20 bp, human
gtaacttctaagggccttga

SEQ ID NO: 33532 - DNA, 20 bp, human
gcaatagcccctaacttcta

SEQ ID NO: 33533 - DNA, 20 bp, human
gcagggtaaacatcttttca

SEQ ID NO: 33534 - DNA, 20 bp, human
gccaatcttagcaatcagga

SEQ ID NO: 33535 - DNA, 20 bp, human
gcaccctgttatgtgatttc

SEQ ID NO: 33536 - DNA, 20 bp, human
gattcttggaagaggagaac

SEQ ID NO: 33537 - DNA, 20 bp, human
gctgtaacttgacaattgag

SEQ ID NO: 33538 - DNA, 20 bp, human
gcgttgtgaacagagttagc

SEQ ID NO: 33539 - DNA, 20 bp, human
gtttctgaaaaactatgatc

SEQ ID NO: 33540 - DNA, 20 bp, human
gacaaatagcccataacata

SEQ ID NO: 33541 - DNA, 20 bp, human
gtagatataccattcaaata

SEQ ID NO: 33542 - DNA, 20 bp, human
gtaaatgttaatgctgtgac

SEQ ID NO: 33543 - DNA, 20 bp, human
gcaagaattgtgattagtgc

SEQ ID NO: 33544 - DNA, 20 bp, human
ggagaattgggtttaacttc

SEQ ID NO: 33545 - DNA, 20 bp, human
gtgtaagaaccttatttgaa

SEQ ID NO: 33546 - DNA, 20 bp, human
gacttcccctgtaggaacct

SEQ ID NO: 33547 - DNA, 20 bp, human
gcttcattgattcttatagg

SEQ ID NO: 33548 - DNA, 20 bp, human
gtaggaggcatctcaaaata

SEQ ID NO: 33549 - DNA, 20 bp, human
gcaacacgtagagcatttcc

SEQ ID NO: 33550 - DNA, 20 bp, human
gattcttcattgattcttat

SEQ ID NO: 33551 - DNA, 20 bp, human
gtcaactgtcttgtgttacc

SEQ ID NO: 33552 - DNA, 20 bp, human
gctgtaggaacctgggaaaa

SEQ ID NO: 33553 - DNA, 20 bp, human
gttcatcatatagaattcca

SEQ ID NO: 33554 - DNA, 20 bp, human
gaatagaaaacttcccctgt

SEQ ID NO: 33555 - DNA, 20 bp, human
ggacacaaaattatattcac

SEQ ID NO: 33556 - DNA, 20 bp, human
gaaacctgctatactaacgg

SEQ ID NO: 33557 - DNA, 20 bp, human
gataactaaaaatacttcag

SEQ ID NO: 33558 - DNA, 20 bp, human
gactaaaaatacttcagtgg

SEQ ID NO: 33559 - DNA, 20 bp, human
gaaaaatacttcagtggtgg

SEQ ID NO: 33560 - DNA, 20 bp, human
gtgctatactaacggtggca

SEQ ID NO: 33561 - DNA, 20 bp, human
gattggaactaccaagcatg

SEQ ID NO: 33562 - DNA, 20 bp, human
ggattagaattacactgacc

SEQ ID NO: 33563 - DNA, 20 bp, human
ggtaaagaggaattaaatga

SEQ ID NO: 33564 - DNA, 20 bp, human
gccaaatagagaatgtaaag

SEQ ID NO: 33565 - DNA, 20 bp, human
gtctcacggatatcctctgt

SEQ ID NO: 33566 - DNA, 20 bp, human
gaaacctgctatactaacgg

SEQ ID NO: 33567 - DNA, 20 bp, human
gataactaaaaatacttcag

SEQ ID NO: 33568 - DNA, 20 bp, human
ggattgattgttctagttag

SEQ ID NO: 33569 - DNA, 20 bp, human
gattggaactaccaagcatg

SEQ ID NO: 33570 - DNA, 20 bp, human
gactaaaaatacttcagtgg

SEQ ID NO: 33571 - DNA, 20 bp, human
gaaaaatacttcagtggtgg

SEQ ID NO: 33572 - DNA, 20 bp, human
gtgctatactaacggtggca

SEQ ID NO: 33573 - DNA, 20 bp, human
ggattagaattacactgacc

SEQ ID NO: 33574 - DNA, 20 bp, human
gacctttgcaacttagagga

SEQ ID NO: 33575 - DNA, 20 bp, human
gtctcacggatatcctctgt

SEQ ID NO: 33576 - DNA, 20 bp, human
ggtaatacaaggggaacatt

SEQ ID NO: 33577 - DNA, 20 bp, human
gttccccttgtattacgtat

SEQ ID NO: 33578 - DNA, 20 bp, human
gtgcactaccatgaagctag

SEQ ID NO: 33579 - DNA, 20 bp, human
gtttcctatacgtaatacaa

SEQ ID NO: 33580 - DNA, 20 bp, human
gctaagttctacagtgtaaa

SEQ ID NO: 33581 - DNA, 20 bp, human
gcattattagttaccaagtg

SEQ ID NO: 33582 - DNA, 20 bp, human
ggttttcataatcttacata

SEQ ID NO: 33583 - DNA, 20 bp, human
gattattttatgaatcaaag

SEQ ID NO: 33584 - DNA, 20 bp, human
gagtttcagttgcactgttt

SEQ ID NO: 33585 - DNA, 20 bp, human
gcaatgtcattctgaccttg

SEQ ID NO: 33586 - DNA, 20 bp, human
ggtgcactaccacaaagcta

SEQ ID NO: 33587 - DNA, 20 bp, human
gtttcttattcataatacaa

SEQ ID NO: 33588 - DNA, 20 bp, human
gaagcatctaatattcatta

SEQ ID NO: 33589 - DNA, 20 bp, human
gccacaaagctagggcttta

SEQ ID NO: 33590 - DNA, 20 bp, human
gcataatacaagggaaactt

SEQ ID NO: 33591 - DNA, 20 bp, human
gatttttttataaatctgat

SEQ ID NO: 33592 - DNA, 20 bp, human
gagtttcagttgcactgttt

SEQ ID NO: 33593 - DNA, 20 bp, human
gttaaattcagaatcacact

SEQ ID NO: 33594 - DNA, 20 bp, human
ggaaaattctgaacatttta

SEQ ID NO: 33595 - DNA, 20 bp, human
gcaatgtcattctgaccttg

SEQ ID NO: 33596 - DNA, 20 bp, human
gcccttagcaaactagagaa

SEQ ID NO: 33597 - DNA, 20 bp, human
gagctgaggataatttgaag

SEQ ID NO: 33598 - DNA, 20 bp, human
gggttgatttttctagtcag

SEQ ID NO: 33599 - DNA, 20 bp, human
gactaaaaatactccagtga

SEQ ID NO: 33600 - DNA, 20 bp, human
gtgctataataaagatgaca

SEQ ID NO: 33601 - DNA, 20 bp, human
gctcatgggtatccactgtt

SEQ ID NO: 33602 - DNA, 20 bp, human
gagtgtaatcctaatctcat

SEQ ID NO: 33603 - DNA, 20 bp, human
gctagtttgctaagggtaaa

SEQ ID NO: 33604 - DNA, 20 bp, human
gtctcaaaacataatgaagg

SEQ ID NO: 33605 - DNA, 20 bp, human
gtgaatttcaatgtactaag

SEQ ID NO: 33606 - DNA, 20 bp, human
gttcatgttggaggtgttcg

SEQ ID NO: 33607 - DNA, 20 bp, human
gacatgaagaagcttcatgt

SEQ ID NO: 33608 - DNA, 20 bp, human
gaactatagagcgtactaag

SEQ ID NO: 33609 - DNA, 20 bp, human
gtttgttgctgactatagag

SEQ ID NO: 33610 - DNA, 20 bp, human
gttcaaaagaatacctggag

SEQ ID NO: 33611 - DNA, 20 bp, human
gtgaagaagcttcatgttgg

SEQ ID NO: 33612 - DNA, 20 bp, human
gtaaatttcaaaagaatacc

SEQ ID NO: 33613 - DNA, 20 bp, human
gcagttacggtaaatctctc

SEQ ID NO: 33614 - DNA, 20 bp, human
gaagtacaaagctctttagg

SEQ ID NO: 33615 - DNA, 20 bp, human
gacgctctatagttatagaa

SEQ ID NO: 33616 - DNA, 20 bp, human
gttcagtcgggtcccggcag

SEQ ID NO: 33617 - DNA, 20 bp, human
gtccggaaacgaaaaggaga

SEQ ID NO: 33618 - DNA, 20 bp, human
gagcgcgcccctaagaagaa

SEQ ID NO: 33619 - DNA, 20 bp, human
ggccgggacccgactgaacg

SEQ ID NO: 33620 - DNA, 20 bp, human
ggtaggagccgcacaatgag

SEQ ID NO: 33621 - DNA, 20 bp, human
gcgctctcgactggagcatg

SEQ ID NO: 33622 - DNA, 20 bp, human
gcggctcctactaaacggaa

SEQ ID NO: 33623 - DNA, 20 bp, human
gatgagggtctcgcacgaag

SEQ ID NO: 33624 - DNA, 20 bp, human
ggcgtccaaacccggcccgg

SEQ ID NO: 33625 - DNA, 20 bp, human
ggtcgcgcctttcttcttag

SEQ ID NO: 33626 - DNA, 20 bp, human
ggccacagccgagggcacta

SEQ ID NO: 33627 - DNA, 20 bp, human
gccgccgcagccacagccga

SEQ ID NO: 33628 - DNA, 20 bp, human
gcgtgctgcgaacgctgtgt

SEQ ID NO: 33629 - DNA, 20 bp, human
gagctcgggcttcggctctg

SEQ ID NO: 33630 - DNA, 20 bp, human
ggcgaacgctgtgtgggtca

SEQ ID NO: 33631 - DNA, 20 bp, human
ggcagggcctgacggccgga

SEQ ID NO: 33632 - DNA, 20 bp, human
gattaggaagcgaagggcaa

SEQ ID NO: 33633 - DNA, 20 bp, human
gcgtcttaccatagtgccct

SEQ ID NO: 33634 - DNA, 20 bp, human
gggcttcggctctgtggcac

SEQ ID NO: 33635 - DNA, 20 bp, human
gagtaaaattaggaagcgaa

SEQ ID NO: 33636 - DNA, 20 bp, human
gcccggagcgcagggctgtg

SEQ ID NO: 33637 - DNA, 20 bp, human
gctgctgcaatgctgactca

SEQ ID NO: 33638 - DNA, 20 bp, human
gtagttgagactcgtcggtg

SEQ ID NO: 33639 - DNA, 20 bp, human
ggactcccggagctaggggt

SEQ ID NO: 33640 - DNA, 20 bp, human
gaagggactcccggagctag

SEQ ID NO: 33641 - DNA, 20 bp, human
ggagtccccacccctagctc

SEQ ID NO: 33642 - DNA, 20 bp, human
gggaccacgggaggaggtgt

SEQ ID NO: 33643 - DNA, 20 bp, human
gcgggaaggcgcacccaaga

SEQ ID NO: 33644 - DNA, 20 bp, human
gctgcgctccgggaaactgc

SEQ ID NO: 33645 - DNA, 20 bp, human
ggctcccctagacgccggga

SEQ ID NO: 33646 - DNA, 20 bp, human
ggaagcggttcagcaggcag

SEQ ID NO: 33647 - DNA, 20 bp, human
ggaggactcacaacactccg

SEQ ID NO: 33648 - DNA, 20 bp, human
ggaatggactctggggaatg

SEQ ID NO: 33649 - DNA, 20 bp, human
gaggcgtgaagcggttcagc

SEQ ID NO: 33650 - DNA, 20 bp, human
gccagatgggacgaggaaca

SEQ ID NO: 33651 - DNA, 20 bp, human
gaacaggtggcttcgccgga

SEQ ID NO: 33652 - DNA, 20 bp, human
ggtcccggcggagatccagt

SEQ ID NO: 33653 - DNA, 20 bp, human
gttcagcaggcagaggttct

SEQ ID NO: 33654 - DNA, 20 bp, human
gcatcaacaggtggcttcgc

SEQ ID NO: 33655 - DNA, 20 bp, human
ggcggggattaggcgtgaag

SEQ ID NO: 33656 - DNA, 20 bp, human
gtaaagcgggacctcctctc

SEQ ID NO: 33657 - DNA, 20 bp, human
gtgcacctctaccagagagg

SEQ ID NO: 33658 - DNA, 20 bp, human
gggcggcagcaacaatcgag

SEQ ID NO: 33659 - DNA, 20 bp, human
gccctgcacctctaccagag

SEQ ID NO: 33660 - DNA, 20 bp, human
gcagggaaagaggaacctag

SEQ ID NO: 33661 - DNA, 20 bp, human
gagggaaggactgtctgtgg

SEQ ID NO: 33662 - DNA, 20 bp, human
ggggacctcctctctggtag

SEQ ID NO: 33663 - DNA, 20 bp, human
gctaccagaaacgtagtggt

SEQ ID NO: 33664 - DNA, 20 bp, human
ggtgggggtcacccaaaact

SEQ ID NO: 33665 - DNA, 20 bp, human
gttgcctaccagaaacgtag

SEQ ID NO: 33666 - DNA, 20 bp, human
ggtccctgctagggccgtct

SEQ ID NO: 33667 - DNA, 20 bp, human
gggcgctggggtccctgcta

SEQ ID NO: 33668 - DNA, 20 bp, human
ggacctctgcatggtctctc

SEQ ID NO: 33669 - DNA, 20 bp, human
gggcaggcacccagagtagt

SEQ ID NO: 33670 - DNA, 20 bp, human
gcgcccgagagaccatgcag

SEQ ID NO: 33671 - DNA, 20 bp, human
gagcccagacggccctagca

SEQ ID NO: 33672 - DNA, 20 bp, human
gcatggtctctcgggcgctg

SEQ ID NO: 33673 - DNA, 20 bp, human
ggaagacaatcaagtgtcca

SEQ ID NO: 33674 - DNA, 20 bp, human
gagtgtccaaggcatgaagg

SEQ ID NO: 33675 - DNA, 20 bp, human
gcaacgctggccttttccag

SEQ ID NO: 33676 - DNA, 20 bp, human
gtgttcagggcggttgactg

SEQ ID NO: 33677 - DNA, 20 bp, human
gttgactgtggatccgaaga

SEQ ID NO: 33678 - DNA, 20 bp, human
gctgcaaaaagcccagagaa

SEQ ID NO: 33679 - DNA, 20 bp, human
gcgaagctaaaatccctctt

SEQ ID NO: 33680 - DNA, 20 bp, human
gcatctcagcaggagacatt

SEQ ID NO: 33681 - DNA, 20 bp, human
gtttttgcaggatgtgttca

SEQ ID NO: 33682 - DNA, 20 bp, human
ggaaggaagtctgtaaaatt

SEQ ID NO: 33683 - DNA, 20 bp, human
gggaaagacgttcttttgag

SEQ ID NO: 33684 - DNA, 20 bp, human
gccttaataagaactgagac

SEQ ID NO: 33685 - DNA, 20 bp, human
gggcactcaagcatctcagc

SEQ ID NO: 33686 - DNA, 20 bp, human
ggcgctcctgcagacagaca

SEQ ID NO: 33687 - DNA, 20 bp, human
ggcaccctgcacatcaggag

SEQ ID NO: 33688 - DNA, 20 bp, human
gtctgtctgcaggagcgcca

SEQ ID NO: 33689 - DNA, 20 bp, human
gctgcacatcaggagcggaa

SEQ ID NO: 33690 - DNA, 20 bp, human
gtaactgagctaactgaata

SEQ ID NO: 33691 - DNA, 20 bp, human
gatctttctggtcacattgt

SEQ ID NO: 33692 - DNA, 20 bp, human
gtgctgctggattcatatct

SEQ ID NO: 33693 - DNA, 20 bp, human
ggtcacgcaccctgcacatc

SEQ ID NO: 33694 - DNA, 20 bp, human
gtgtgaaaattcatctacaa

SEQ ID NO: 33695 - DNA, 20 bp, human
ggtaagactcaagaataaaa

SEQ ID NO: 33696 - DNA, 20 bp, human
gtctttggtgcccggaaatg

SEQ ID NO: 33697 - DNA, 20 bp, human
gagactgcagcccccagtcc

SEQ ID NO: 33698 - DNA, 20 bp, human
gtagggtagatccacatttc

SEQ ID NO: 33699 - DNA, 20 bp, human
gggaacctggccagagtcag

SEQ ID NO: 33700 - DNA, 20 bp, human
gggtcctgaatagaagatgc

SEQ ID NO: 33701 - DNA, 20 bp, human
gttgtgggtggtgtaccatg

SEQ ID NO: 33702 - DNA, 20 bp, human
gctggccttcccatcccgca

SEQ ID NO: 33703 - DNA, 20 bp, human
gggtggtgtaccatgcggga

SEQ ID NO: 33704 - DNA, 20 bp, human
gttcccggcatcttctattc

SEQ ID NO: 33705 - DNA, 20 bp, human
ggagtgagacagggagtgag

SEQ ID NO: 33706 - DNA, 20 bp, human
gtctttggtgcccggaaatg

SEQ ID NO: 33707 - DNA, 20 bp, human
gagactgcagcccccagtcc

SEQ ID NO: 33708 - DNA, 20 bp, human
gtagggtagatccacatttc

SEQ ID NO: 33709 - DNA, 20 bp, human
gggaacctggccagagtcag

SEQ ID NO: 33710 - DNA, 20 bp, human
gggtcctgaatagaagatgc

SEQ ID NO: 33711 - DNA, 20 bp, human
gttgtgggtggtgtaccatg

SEQ ID NO: 33712 - DNA, 20 bp, human
gctggccttcccatcccgca

SEQ ID NO: 33713 - DNA, 20 bp, human
gggtggtgtaccatgcggga

SEQ ID NO: 33714 - DNA, 20 bp, human
gttcccggcatcttctattc

SEQ ID NO: 33715 - DNA, 20 bp, human
ggagtgagacagggagtgag

SEQ ID NO: 33716 - DNA, 20 bp, human
gagatgccacgaagggtctc

SEQ ID NO: 33717 - DNA, 20 bp, human
gggggtatctgagatcctct

SEQ ID NO: 33718 - DNA, 20 bp, human
gtgaataggagatgccacga

SEQ ID NO: 33719 - DNA, 20 bp, human
gatatcttccgcaagcactg

SEQ ID NO: 33720 - DNA, 20 bp, human
gaagacccagagacccttcg

SEQ ID NO: 33721 - DNA, 20 bp, human
ggtgatggcctggaagcagg

SEQ ID NO: 33722 - DNA, 20 bp, human
ggggtggggatctaaaatgt

SEQ ID NO: 33723 - DNA, 20 bp, human
ggagtgagacagggagtgag

SEQ ID NO: 33724 - DNA, 20 bp, human
gtccgtgggggagtgagaca

SEQ ID NO: 33725 - DNA, 20 bp, human
gggaacccggccggagtcag

SEQ ID NO: 33726 - DNA, 20 bp, human
gcgtgacccgagcaaagtgc

SEQ ID NO: 33727 - DNA, 20 bp, human
gcaggaggttgtaggatgct

SEQ ID NO: 33728 - DNA, 20 bp, human
gttcaatccagcactttgct

SEQ ID NO: 33729 - DNA, 20 bp, human
ggctggaccagtgagaggag

SEQ ID NO: 33730 - DNA, 20 bp, human
gtggtccagcgccaagggtg

SEQ ID NO: 33731 - DNA, 20 bp, human
gttggcgctggaccagtgag

SEQ ID NO: 33732 - DNA, 20 bp, human
gggggggcaagaggtagaca

SEQ ID NO: 33733 - DNA, 20 bp, human
gaagaggtagacaaggccag

SEQ ID NO: 33734 - DNA, 20 bp, human
gaaggccaccaggaggttgt

SEQ ID NO: 33735 - DNA, 20 bp, human
gtaacccttcggggggcaag

SEQ ID NO: 33736 - DNA, 20 bp, human
gggactccgagacccctcag

SEQ ID NO: 33737 - DNA, 20 bp, human
gggagtggagatcttacctg

SEQ ID NO: 33738 - DNA, 20 bp, human
gcctgcagccagcgagcagg

SEQ ID NO: 33739 - DNA, 20 bp, human
ggtgagcagctagcacccgg

SEQ ID NO: 33740 - DNA, 20 bp, human
gcaggacgccggaatcccga

SEQ ID NO: 33741 - DNA, 20 bp, human
ggcagccgcgggagccgaag

SEQ ID NO: 33742 - DNA, 20 bp, human
ggacgccggaatcccgaggg

SEQ ID NO: 33743 - DNA, 20 bp, human
gggaaaccggctgcatatct

SEQ ID NO: 33744 - DNA, 20 bp, human
gttacctggggcgccctctt

SEQ ID NO: 33745 - DNA, 20 bp, human
gatctggaggatgaggaacc

SEQ ID NO: 33746 - DNA, 20 bp, human
gcaagaaggcttgagaccgg

SEQ ID NO: 33747 - DNA, 20 bp, human
gggctggaaactcgccttca

SEQ ID NO: 33748 - DNA, 20 bp, human
gagttccttgaccagcagga

SEQ ID NO: 33749 - DNA, 20 bp, human
ggcatccacgccaggccaga

SEQ ID NO: 33750 - DNA, 20 bp, human
gaatattctgagacgtggta

SEQ ID NO: 33751 - DNA, 20 bp, human
ggtagggtgggagttaggag

SEQ ID NO: 33752 - DNA, 20 bp, human
gagggctgggcatccacgcc

SEQ ID NO: 33753 - DNA, 20 bp, human
gttctgagacgtggtagggt

SEQ ID NO: 33754 - DNA, 20 bp, human
gtgagaccgggggcagaacc

SEQ ID NO: 33755 - DNA, 20 bp, human
gggagttaggagaggtaacc

SEQ ID NO: 33756 - DNA, 20 bp, human
gtctttggtgcccggaaatg

SEQ ID NO: 33757 - DNA, 20 bp, human
gagactgcagcccccagtcc

SEQ ID NO: 33758 - DNA, 20 bp, human
gtagggtagatccacatttc

SEQ ID NO: 33759 - DNA, 20 bp, human
gggaacctggccagagtcag

SEQ ID NO: 33760 - DNA, 20 bp, human
gggtcctgaatagaagatgc

SEQ ID NO: 33761 - DNA, 20 bp, human
gttgtgggtggtgtaccatg

SEQ ID NO: 33762 - DNA, 20 bp, human
gctggccttcccatcccgca

SEQ ID NO: 33763 - DNA, 20 bp, human
gggtggtgtaccatgcggga

SEQ ID NO: 33764 - DNA, 20 bp, human
gttcccggcatcttctattc

SEQ ID NO: 33765 - DNA, 20 bp, human
ggagtgagacagggagtgag

SEQ ID NO: 33766 - DNA, 20 bp, human
gcgcggtgtcggacctaggt

SEQ ID NO: 33767 - DNA, 20 bp, human
gtccgacaccgcgtagtgag

SEQ ID NO: 33768 - DNA, 20 bp, human
ggcaggaatggctcaagtag

SEQ ID NO: 33769 - DNA, 20 bp, human
gaatgagtgcgagcccacct

SEQ ID NO: 33770 - DNA, 20 bp, human
ggatccagccgcagctgagt

SEQ ID NO: 33771 - DNA, 20 bp, human
gtgggcagccgctcactacg

SEQ ID NO: 33772 - DNA, 20 bp, human
gcagctgagtgggcgtgtct

SEQ ID NO: 33773 - DNA, 20 bp, human
gactacgcggtgtcggacct

SEQ ID NO: 33774 - DNA, 20 bp, human
ggggggcggagcagagctct

SEQ ID NO: 33775 - DNA, 20 bp, human
gtaagtctatccgcagtgtg

SEQ ID NO: 33776 - DNA, 20 bp, human
ggccgccgcggggctcgatc

SEQ ID NO: 33777 - DNA, 20 bp, human
gcgcctatggcagagcccgt

SEQ ID NO: 33778 - DNA, 20 bp, human
ggcccgatcgagccccgcgg

SEQ ID NO: 33779 - DNA, 20 bp, human
gttggcggcagtctcaaggg

SEQ ID NO: 33780 - DNA, 20 bp, human
gaagaggagcaagggaataa

SEQ ID NO: 33781 - DNA, 20 bp, human
ggacttggcggcagtctcaa

SEQ ID NO: 33782 - DNA, 20 bp, human
ggttgcccgatcgagccccg

SEQ ID NO: 33783 - DNA, 20 bp, human
ggggctcgatcgggcaacgg

SEQ ID NO: 33784 - DNA, 20 bp, human
gccagctagcggggtcggga

SEQ ID NO: 33785 - DNA, 20 bp, human
gaactcgacagccgacttgg

SEQ ID NO: 33786 - DNA, 20 bp, human
gccggcaacgagggaaatgg

SEQ ID NO: 33787 - DNA, 20 bp, human
gtggaggcaagagacggtcc

SEQ ID NO: 33788 - DNA, 20 bp, human
gcagcccggaaccacaagtg

SEQ ID NO: 33789 - DNA, 20 bp, human
ggtgcctggccgccttccag

SEQ ID NO: 33790 - DNA, 20 bp, human
ggaacatagactatccgcaa

SEQ ID NO: 33791 - DNA, 20 bp, human
gggctcacccaactcagaag

SEQ ID NO: 33792 - DNA, 20 bp, human
gaggaaagtccgctggaagg

SEQ ID NO: 33793 - DNA, 20 bp, human
ggagccggcaacgagggaaa

SEQ ID NO: 33794 - DNA, 20 bp, human
gaacgcagtgccctcacttg

SEQ ID NO: 33795 - DNA, 20 bp, human
gtcccttaattgagatacgt

SEQ ID NO: 33796 - DNA, 20 bp, human
gggtcagacgccagccctag

SEQ ID NO: 33797 - DNA, 20 bp, human
ggggagctccgaggacgagg

SEQ ID NO: 33798 - DNA, 20 bp, human
gggagcgcggagcccggcta

SEQ ID NO: 33799 - DNA, 20 bp, human
ggtgcagactcgccagggga

SEQ ID NO: 33800 - DNA, 20 bp, human
gcctggcgagtctgcacctc

SEQ ID NO: 33801 - DNA, 20 bp, human
gtgtgagatgcccctctcca

SEQ ID NO: 33802 - DNA, 20 bp, human
ggagaaaggagggagctccg

SEQ ID NO: 33803 - DNA, 20 bp, human
ggaggaaagcgagccttcag

SEQ ID NO: 33804 - DNA, 20 bp, human
gcatctggcacctcagggta

SEQ ID NO: 33805 - DNA, 20 bp, human
gccggtgccgagtgggagac

SEQ ID NO: 33806 - DNA, 20 bp, human
gcagctgtcactagagccgg

SEQ ID NO: 33807 - DNA, 20 bp, human
ggacttgtgtacgacaggat

SEQ ID NO: 33808 - DNA, 20 bp, human
gggtccaggcaggggtgcga

SEQ ID NO: 33809 - DNA, 20 bp, human
gcggtgagtgagctccgggc

SEQ ID NO: 33810 - DNA, 20 bp, human
gggctcgctcggcctcccgg

SEQ ID NO: 33811 - DNA, 20 bp, human
gggtccggccgagcacgccg

SEQ ID NO: 33812 - DNA, 20 bp, human
gcggcgcgggtcaccgagag

SEQ ID NO: 33813 - DNA, 20 bp, human
gcgccgcggcccttgcactc

SEQ ID NO: 33814 - DNA, 20 bp, human
gggcaggcgcagaacagatg

SEQ ID NO: 33815 - DNA, 20 bp, human
gccgcgccgcgcgtgtcctg

SEQ ID NO: 33816 - DNA, 20 bp, human
gctgccctcagggtacacag

SEQ ID NO: 33817 - DNA, 20 bp, human
gtgagccgcaggggatgcag

SEQ ID NO: 33818 - DNA, 20 bp, human
gctctcgggatctggaccag

SEQ ID NO: 33819 - DNA, 20 bp, human
gatcccctgcggctcagacg

SEQ ID NO: 33820 - DNA, 20 bp, human
gtcagacgcggcgggagcag

SEQ ID NO: 33821 - DNA, 20 bp, human
ggcgctggtggagctgcgaa

SEQ ID NO: 33822 - DNA, 20 bp, human
ggcgcggcgccgcagcaggt

SEQ ID NO: 33823 - DNA, 20 bp, human
gagtccctctgcatcccctg

SEQ ID NO: 33824 - DNA, 20 bp, human
gcgggatctggaccagaggc

SEQ ID NO: 33825 - DNA, 20 bp, human
gccctgcggctcagacgcgg

SEQ ID NO: 33826 - DNA, 20 bp, human
gacccagagcaagaccctga

SEQ ID NO: 33827 - DNA, 20 bp, human
gtcttgctctgggtagagcc

SEQ ID NO: 33828 - DNA, 20 bp, human
gccaccgcgatgtagaaaag

SEQ ID NO: 33829 - DNA, 20 bp, human
gagaaacaccgcagccatca

SEQ ID NO: 33830 - DNA, 20 bp, human
gtcgctggggcatcttgggg

SEQ ID NO: 33831 - DNA, 20 bp, human
gccaggggtgagagacgaag

SEQ ID NO: 33832 - DNA, 20 bp, human
gcgcgggccggaggacgtcg

SEQ ID NO: 33833 - DNA, 20 bp, human
gagccatcagggtcttgctc

SEQ ID NO: 33834 - DNA, 20 bp, human
gcccagcgacacggaccaaa

SEQ ID NO: 33835 - DNA, 20 bp, human
gaagcagccaggaagggctt

SEQ ID NO: 33836 - DNA, 20 bp, human
gcggagctgcaaaggacctg

SEQ ID NO: 33837 - DNA, 20 bp, human
gggaaggtgcggtacagcca

SEQ ID NO: 33838 - DNA, 20 bp, human
gtcctcaggtggtcccagag

SEQ ID NO: 33839 - DNA, 20 bp, human
gggatatccaggaccacgaa

SEQ ID NO: 33840 - DNA, 20 bp, human
gctcattgcgaggctgtgca

SEQ ID NO: 33841 - DNA, 20 bp, human
ggcagctcgggagcttcgtg

SEQ ID NO: 33842 - DNA, 20 bp, human
gcgcggatggcgagaagtca

SEQ ID NO: 33843 - DNA, 20 bp, human
ggtgcaccttgtggaaggtg

SEQ ID NO: 33844 - DNA, 20 bp, human
ggttgtggcagctcattgcg

SEQ ID NO: 33845 - DNA, 20 bp, human
gcgacatggagttcttcgtg

SEQ ID NO: 33846 - DNA, 20 bp, human
ggtgggcacggaaagaccga

SEQ ID NO: 33847 - DNA, 20 bp, human
gcagtcccaagtcgagtcca

SEQ ID NO: 33848 - DNA, 20 bp, human
gtaaagggcgcctccatggg

SEQ ID NO: 33849 - DNA, 20 bp, human
ggccaggtgtgtgcgtccgt

SEQ ID NO: 33850 - DNA, 20 bp, human
ggagagccccggacattcca

SEQ ID NO: 33851 - DNA, 20 bp, human
gactcggccagatgcactag

SEQ ID NO: 33852 - DNA, 20 bp, human
gctggcacagggataggccc

SEQ ID NO: 33853 - DNA, 20 bp, human
gcggggctggtctccggcgt

SEQ ID NO: 33854 - DNA, 20 bp, human
gcgtgccctggactcgactt

SEQ ID NO: 33855 - DNA, 20 bp, human
gacggcgagcgagtcccagg

SEQ ID NO: 33856 - DNA, 20 bp, human
ggtctctagagactaaccac

SEQ ID NO: 33857 - DNA, 20 bp, human
gaggagccgcgagaagatgt

SEQ ID NO: 33858 - DNA, 20 bp, human
gggcggcgcggcgacagcta

SEQ ID NO: 33859 - DNA, 20 bp, human
gctagggttcacggccactg

SEQ ID NO: 33860 - DNA, 20 bp, human
gtaccggaggcttcagtccc

SEQ ID NO: 33861 - DNA, 20 bp, human
ggccatctctaacccagccc

SEQ ID NO: 33862 - DNA, 20 bp, human
gccggttactcgcttaccgg

SEQ ID NO: 33863 - DNA, 20 bp, human
gcggcgacagctagggttca

SEQ ID NO: 33864 - DNA, 20 bp, human
gtagagacggcgagaagcgc

SEQ ID NO: 33865 - DNA, 20 bp, human
gaagctgcttaagatgccgg

SEQ ID NO: 33866 - DNA, 20 bp, human
gggccaccgtataaagaggg

SEQ ID NO: 33867 - DNA, 20 bp, human
gcttgttgtggtccaggtag

SEQ ID NO: 33868 - DNA, 20 bp, human
gttgtggtccaggtagaggt

SEQ ID NO: 33869 - DNA, 20 bp, human
ggcggggagagcaacccccg

SEQ ID NO: 33870 - DNA, 20 bp, human
ggaggtaggtcagctcggtc

SEQ ID NO: 33871 - DNA, 20 bp, human
gaccatggctgggacgcctg

SEQ ID NO: 33872 - DNA, 20 bp, human
gagctcggtcaggtcgtcga

SEQ ID NO: 33873 - DNA, 20 bp, human
ggagctgacctacctctacc

SEQ ID NO: 33874 - DNA, 20 bp, human
gcagggccaccgtataaaga

SEQ ID NO: 33875 - DNA, 20 bp, human
ggggctgcagaagatcccca

SEQ ID NO: 33876 - DNA, 20 bp, human
gagttccaggcggcatggag

SEQ ID NO: 33877 - DNA, 20 bp, human
gagtccagtgagcagcgagg

SEQ ID NO: 33878 - DNA, 20 bp, human
ggagaggccatgcctgacac

SEQ ID NO: 33879 - DNA, 20 bp, human
ggccaccaactccaacgcag

SEQ ID NO: 33880 - DNA, 20 bp, human
gtgggcccgatggtgcaagg

SEQ ID NO: 33881 - DNA, 20 bp, human
ggccccagaggaccagttcc

SEQ ID NO: 33882 - DNA, 20 bp, human
ggggattcagagcagctcag

SEQ ID NO: 33883 - DNA, 20 bp, human
gggtgagtctttgggcccga

SEQ ID NO: 33884 - DNA, 20 bp, human
gaggtgggctctgagacacg

SEQ ID NO: 33885 - DNA, 20 bp, human
ggaagggggtctcccaaggt

SEQ ID NO: 33886 - DNA, 20 bp, human
gggcagctcgacctcctctc

SEQ ID NO: 33887 - DNA, 20 bp, human
ggcgggagggcgaagagcag

SEQ ID NO: 33888 - DNA, 20 bp, human
gggcgcgggctcccctcagg

SEQ ID NO: 33889 - DNA, 20 bp, human
ggcgccggaaacaaacaata

SEQ ID NO: 33890 - DNA, 20 bp, human
gcgtccctccaggactctct

SEQ ID NO: 33891 - DNA, 20 bp, human
gagagcagcggccgcctgag

SEQ ID NO: 33892 - DNA, 20 bp, human
gctggggcggtgggtcggag

SEQ ID NO: 33893 - DNA, 20 bp, human
gccgccaaatacgagcgcgg

SEQ ID NO: 33894 - DNA, 20 bp, human
gagctcgacctcctctcagg

SEQ ID NO: 33895 - DNA, 20 bp, human
gcggccgccgcgctcgtatt

SEQ ID NO: 33896 - DNA, 20 bp, human
ggtccgggtccctccaggta

SEQ ID NO: 33897 - DNA, 20 bp, human
gcagggaagccgtacctgga

SEQ ID NO: 33898 - DNA, 20 bp, human
ggagggacccggacagtcag

SEQ ID NO: 33899 - DNA, 20 bp, human
ggggccagggaagccgtacc

SEQ ID NO: 33900 - DNA, 20 bp, human
gagccgtacctggagggacc

SEQ ID NO: 33901 - DNA, 20 bp, human
ggcctgtccccgcttagtag

SEQ ID NO: 33902 - DNA, 20 bp, human
gccaggtaaaggctacctag

SEQ ID NO: 33903 - DNA, 20 bp, human
gacggtgcctctgactgtcc

SEQ ID NO: 33904 - DNA, 20 bp, human
ggcagacggccggggcccct

SEQ ID NO: 33905 - DNA, 20 bp, human
gaaacgaaacacccaggtaa

SEQ ID NO: 33906 - DNA, 20 bp, human
gcaggtcggcggccgacacg

SEQ ID NO: 33907 - DNA, 20 bp, human
ggggcgatggaccgcgcgga

SEQ ID NO: 33908 - DNA, 20 bp, human
gcatccagtcgccattcggg

SEQ ID NO: 33909 - DNA, 20 bp, human
gcggcctcccgaatggcgac

SEQ ID NO: 33910 - DNA, 20 bp, human
gctcgcgcgggccttcggaa

SEQ ID NO: 33911 - DNA, 20 bp, human
gcgctcgcgcacccggatcc

SEQ ID NO: 33912 - DNA, 20 bp, human
ggctgcgctgcagggcctcg

SEQ ID NO: 33913 - DNA, 20 bp, human
ggtaataatgacagaagagg

SEQ ID NO: 33914 - DNA, 20 bp, human
gagtgcgtgggcaaaactag

SEQ ID NO: 33915 - DNA, 20 bp, human
ggctatacagcctccaaagt

SEQ ID NO: 33916 - DNA, 20 bp, human
gtgcggtgcagcgtcggccg

SEQ ID NO: 33917 - DNA, 20 bp, human
gccccgcccacactcctgag

SEQ ID NO: 33918 - DNA, 20 bp, human
gtgaatgaccggccagactg

SEQ ID NO: 33919 - DNA, 20 bp, human
gagcgcggtgccgggagcaa

SEQ ID NO: 33920 - DNA, 20 bp, human
ggctgctgcgcaggactcag

SEQ ID NO: 33921 - DNA, 20 bp, human
ggcggtgccgggagcaaggg

SEQ ID NO: 33922 - DNA, 20 bp, human
ggctgtcatcggctatgtcc

SEQ ID NO: 33923 - DNA, 20 bp, human
gcgaccgccgcccttgctcc

SEQ ID NO: 33924 - DNA, 20 bp, human
ggagtggtgcggtgcagcgt

SEQ ID NO: 33925 - DNA, 20 bp, human
gcgaaggtccaaccccagtc

SEQ ID NO: 33926 - DNA, 20 bp, human
ggaggctttgagaaaggagt

SEQ ID NO: 33927 - DNA, 20 bp, human
gcccgttgaggctttgagaa

SEQ ID NO: 33928 - DNA, 20 bp, human
gcagcagagcagaccctcac

SEQ ID NO: 33929 - DNA, 20 bp, human
gacaggcgcagctaacacac

SEQ ID NO: 33930 - DNA, 20 bp, human
ggagtaggagccgagcattc

SEQ ID NO: 33931 - DNA, 20 bp, human
ggagccgagcattccggcag

SEQ ID NO: 33932 - DNA, 20 bp, human
ggaccgtagtctgatgatcg

SEQ ID NO: 33933 - DNA, 20 bp, human
ggctcccactcaggacaggg

SEQ ID NO: 33934 - DNA, 20 bp, human
ggaggtcggactctaaaaga

SEQ ID NO: 33935 - DNA, 20 bp, human
ggtgaagaggcggctggtca

SEQ ID NO: 33936 - DNA, 20 bp, human
gctctggaggggcagatccg

SEQ ID NO: 33937 - DNA, 20 bp, human
gggggtcgtctggcgcggtt

SEQ ID NO: 33938 - DNA, 20 bp, human
gcccagcctgcggggtcgtc

SEQ ID NO: 33939 - DNA, 20 bp, human
gatgcaagtcgcctctggag

SEQ ID NO: 33940 - DNA, 20 bp, human
gccgggagcttggtgcgcta

SEQ ID NO: 33941 - DNA, 20 bp, human
gtatggcgacacccagcctg

SEQ ID NO: 33942 - DNA, 20 bp, human
gagcatgagcaggggcgggt

SEQ ID NO: 33943 - DNA, 20 bp, human
gccgcgccagacgaccccgc

SEQ ID NO: 33944 - DNA, 20 bp, human
gcgagggctcaggtgaccga

SEQ ID NO: 33945 - DNA, 20 bp, human
gggtcacgcgaggtcacgca

SEQ ID NO: 33946 - DNA, 20 bp, human
gcgggcgaccttagagacgg

SEQ ID NO: 33947 - DNA, 20 bp, human
gacccgggcgaccttagaga

SEQ ID NO: 33948 - DNA, 20 bp, human
gagccccggctggcccgaag

SEQ ID NO: 33949 - DNA, 20 bp, human
gcactcctcactggacactt

SEQ ID NO: 33950 - DNA, 20 bp, human
ggacccacgtctccacacgt

SEQ ID NO: 33951 - DNA, 20 bp, human
gcacccacgtgtggagacgt

SEQ ID NO: 33952 - DNA, 20 bp, human
gccgctgaaggctccggtca

SEQ ID NO: 33953 - DNA, 20 bp, human
ggtggactaggacccttccc

SEQ ID NO: 33954 - DNA, 20 bp, human
gaccgctgccgccgtctcta

SEQ ID NO: 33955 - DNA, 20 bp, human
gccgcgctgcggcttccccg

SEQ ID NO: 33956 - DNA, 20 bp, human
gtcattgccccagtagagtc

SEQ ID NO: 33957 - DNA, 20 bp, human
gggccgtccggactctactg

SEQ ID NO: 33958 - DNA, 20 bp, human
gacggctaggcctccggacg

SEQ ID NO: 33959 - DNA, 20 bp, human
gtctgaggagaccggaagat

SEQ ID NO: 33960 - DNA, 20 bp, human
gtcggtggttgtcccacgtc

SEQ ID NO: 33961 - DNA, 20 bp, human
gcgcgggcgggggtgaacta

SEQ ID NO: 33962 - DNA, 20 bp, human
gaagcgacttctgaggagac

SEQ ID NO: 33963 - DNA, 20 bp, human
gtaagcgacggctaggcctc

SEQ ID NO: 33964 - DNA, 20 bp, human
gggcgggggtgaactaaggt

SEQ ID NO: 33965 - DNA, 20 bp, human
gggtgaactaaggtcggctg

SEQ ID NO: 33966 - DNA, 20 bp, human
gaggaaccggaatcatgggt

SEQ ID NO: 33967 - DNA, 20 bp, human
gcacccacacgcgcgtggaa

SEQ ID NO: 33968 - DNA, 20 bp, human
gtgtggcgcgtgaccggagg

SEQ ID NO: 33969 - DNA, 20 bp, human
gtggccctccgcccgtccac

SEQ ID NO: 33970 - DNA, 20 bp, human
gaccgtggtgaagggcatcc

SEQ ID NO: 33971 - DNA, 20 bp, human
gccgtccacgggcactcacc

SEQ ID NO: 33972 - DNA, 20 bp, human
ggcctagagtttcaagacgt

SEQ ID NO: 33973 - DNA, 20 bp, human
gtgttgtggcgcgtgaccgg

SEQ ID NO: 33974 - DNA, 20 bp, human
gtccaggacgggagaaaccc

SEQ ID NO: 33975 - DNA, 20 bp, human
ggggcaggaaccggaatcat

SEQ ID NO: 33976 - DNA, 20 bp, human
ggtctcccgcaggccctcgt

SEQ ID NO: 33977 - DNA, 20 bp, human
gcacggagaccggcctacga

SEQ ID NO: 33978 - DNA, 20 bp, human
gctacgcacaggcccctctg

SEQ ID NO: 33979 - DNA, 20 bp, human
gcctccgagtgtcccagggt

SEQ ID NO: 33980 - DNA, 20 bp, human
gtattgccggcaggaaggta

SEQ ID NO: 33981 - DNA, 20 bp, human
gcgcggttgcgagggcgccg

SEQ ID NO: 33982 - DNA, 20 bp, human
gcgaagctctggggggaacg

SEQ ID NO: 33983 - DNA, 20 bp, human
ggagggaggtcacggcgtaa

SEQ ID NO: 33984 - DNA, 20 bp, human
gacgtggggtatggcaggag

SEQ ID NO: 33985 - DNA, 20 bp, human
gtgccggcaggaaggtaggg

SEQ ID NO: 33986 - DNA, 20 bp, human
ggacagccctacgccggcaa

SEQ ID NO: 33987 - DNA, 20 bp, human
ggggagcggcagcacgtatg

SEQ ID NO: 33988 - DNA, 20 bp, human
gggtcccaggcagatctgga

SEQ ID NO: 33989 - DNA, 20 bp, human
ggccggacctggggtactgg

SEQ ID NO: 33990 - DNA, 20 bp, human
ggcggcagcacgtatggggt

SEQ ID NO: 33991 - DNA, 20 bp, human
gtcctaagcagcgcgagagg

SEQ ID NO: 33992 - DNA, 20 bp, human
gcggcgtagggctgtccggg

SEQ ID NO: 33993 - DNA, 20 bp, human
gtgacaaccgataccggaaa

SEQ ID NO: 33994 - DNA, 20 bp, human
gccgggccggaagaagaggt

SEQ ID NO: 33995 - DNA, 20 bp, human
gcgaggcctaaacgcttaga

SEQ ID NO: 33996 - DNA, 20 bp, human
gtggagccgggtctcgggtc

SEQ ID NO: 33997 - DNA, 20 bp, human
gagccaccagacccgagacc

SEQ ID NO: 33998 - DNA, 20 bp, human
gcgaggcccctgggacacga

SEQ ID NO: 33999 - DNA, 20 bp, human
ggccacgtcctggctccggt

SEQ ID NO: 34000 - DNA, 20 bp, human
gacccggctccagagcaacc

SEQ ID NO: 34001 - DNA, 20 bp, human
gggcgtccctcgtgtcccag

SEQ ID NO: 34002 - DNA, 20 bp, human
gcccatggcgagatgccgca

SEQ ID NO: 34003 - DNA, 20 bp, human
ggttgttggcccggttgctc

SEQ ID NO: 34004 - DNA, 20 bp, human
ggaggagtgaagaactgtac

SEQ ID NO: 34005 - DNA, 20 bp, human
gggacgccctggccacgtcc

SEQ ID NO: 34006 - DNA, 20 bp, human
gtgcggccgcttcggaggta

SEQ ID NO: 34007 - DNA, 20 bp, human
gcagggcaaggagaaacgaa

SEQ ID NO: 34008 - DNA, 20 bp, human
gcgcttcggaggtagggcgg

SEQ ID NO: 34009 - DNA, 20 bp, human
gatgctgacgggctacaccg

SEQ ID NO: 34010 - DNA, 20 bp, human
gtgccctgcgcgcccacctc

SEQ ID NO: 34011 - DNA, 20 bp, human
gcgggggaaccactcacctc

SEQ ID NO: 34012 - DNA, 20 bp, human
gcggagcgaacagacccgtg

SEQ ID NO: 34013 - DNA, 20 bp, human
ggtgctggcgaagcggaggc

SEQ ID NO: 34014 - DNA, 20 bp, human
gccatgccgagagagacaag

SEQ ID NO: 34015 - DNA, 20 bp, human
gagggtggcctgccggaggt

SEQ ID NO: 34016 - DNA, 20 bp, human
gcaacagtcacaggttttct

SEQ ID NO: 34017 - DNA, 20 bp, human
gttttctttaggtgaatcaa

SEQ ID NO: 34018 - DNA, 20 bp, human
ggaaaactctgctacctatg

SEQ ID NO: 34019 - DNA, 20 bp, human
gaaagtgttagaaacagtag

SEQ ID NO: 34020 - DNA, 20 bp, human
gttgtttacttaaatctatt

SEQ ID NO: 34021 - DNA, 20 bp, human
gtagtatttggatagctaag

SEQ ID NO: 34022 - DNA, 20 bp, human
ggaaccttttttcataatac

SEQ ID NO: 34023 - DNA, 20 bp, human
gtttgagctaataattaagc

SEQ ID NO: 34024 - DNA, 20 bp, human
gtcagaatttttttagtatt

SEQ ID NO: 34025 - DNA, 20 bp, human
gaaacagtagtggagaatca

SEQ ID NO: 34026 - DNA, 20 bp, human
gaggccgtccaactcttcag

SEQ ID NO: 34027 - DNA, 20 bp, human
gggccgggacccaaacccac

SEQ ID NO: 34028 - DNA, 20 bp, human
gagcgcctggcttcttactg

SEQ ID NO: 34029 - DNA, 20 bp, human
gggcctgtggaggggaaacg

SEQ ID NO: 34030 - DNA, 20 bp, human
gactgagggccgagccgagg

SEQ ID NO: 34031 - DNA, 20 bp, human
gcctccgctgaagagttgga

SEQ ID NO: 34032 - DNA, 20 bp, human
ggaagccgcagtaagaagcc

SEQ ID NO: 34033 - DNA, 20 bp, human
ggcgcgggcgctactagccg

SEQ ID NO: 34034 - DNA, 20 bp, human
gtactgcggcttcatactga

SEQ ID NO: 34035 - DNA, 20 bp, human
gcatactgagggccgagccg

SEQ ID NO: 34036 - DNA, 20 bp, human
ggcagagcgcgctctctcta

SEQ ID NO: 34037 - DNA, 20 bp, human
ggttgcgtaaagtgaggcaa

SEQ ID NO: 34038 - DNA, 20 bp, human
gacgacctgggctctcagta

SEQ ID NO: 34039 - DNA, 20 bp, human
ggggaaagttgcgtaaagtg

SEQ ID NO: 34040 - DNA, 20 bp, human
gtgtagagagtgtcaatcaa

SEQ ID NO: 34041 - DNA, 20 bp, human
gtgaggctgcccgaaagtta

SEQ ID NO: 34042 - DNA, 20 bp, human
gggagagcgcacaaaaatgg

SEQ ID NO: 34043 - DNA, 20 bp, human
gcggctgcttctttccaaca

SEQ ID NO: 34044 - DNA, 20 bp, human
ggcagccgtactgagagccc

SEQ ID NO: 34045 - DNA, 20 bp, human
gcccagtaagtccctaggaa

SEQ ID NO: 34046 - DNA, 20 bp, human
gcaacatggcctcttcgctg

SEQ ID NO: 34047 - DNA, 20 bp, human
ggagggagtaaagcctagag

SEQ ID NO: 34048 - DNA, 20 bp, human
gtccgaggcggcaaccgcag

SEQ ID NO: 34049 - DNA, 20 bp, human
gcatggcctcttcgctgcgg

SEQ ID NO: 34050 - DNA, 20 bp, human
gtaaagcctagagaggagac

SEQ ID NO: 34051 - DNA, 20 bp, human
gccgcctcggaggctccccc

SEQ ID NO: 34052 - DNA, 20 bp, human
gcgcgctcggacccggtgag

SEQ ID NO: 34053 - DNA, 20 bp, human
gagctagggagccactcacc

SEQ ID NO: 34054 - DNA, 20 bp, human
ggcggtccggcccgggactc

SEQ ID NO: 34055 - DNA, 20 bp, human
gcgctgccgccgcagcgaag

SEQ ID NO: 34056 - DNA, 20 bp, human
gtcctcctcgtccctcagag

SEQ ID NO: 34057 - DNA, 20 bp, human
gaggatggcttcccctctga

SEQ ID NO: 34058 - DNA, 20 bp, human
ggcttcccctctgagggacg

SEQ ID NO: 34059 - DNA, 20 bp, human
gcgacgacgagggagtactc

SEQ ID NO: 34060 - DNA, 20 bp, human
ggcgaccgccacagcccccc

SEQ ID NO: 34061 - DNA, 20 bp, human
gtccccccccaagcccgagt

SEQ ID NO: 34062 - DNA, 20 bp, human
ggccgacgaggacgatgagg

SEQ ID NO: 34063 - DNA, 20 bp, human
gcgcgggccgggccacgacc

SEQ ID NO: 34064 - DNA, 20 bp, human
gtcccactcgggcttggggg

SEQ ID NO: 34065 - DNA, 20 bp, human
gcttggggggggagtcgggg

SEQ ID NO: 34066 - DNA, 20 bp, human
gggtcggctcctctgggcaa

SEQ ID NO: 34067 - DNA, 20 bp, human
gtccggagacgcctgaggaa

SEQ ID NO: 34068 - DNA, 20 bp, human
gccggacccagcgcgacctg

SEQ ID NO: 34069 - DNA, 20 bp, human
ggacccagcgcgacctgcgg

SEQ ID NO: 34070 - DNA, 20 bp, human
gcaagagctgcggggacgag

SEQ ID NO: 34071 - DNA, 20 bp, human
gctcggtgtcactcccgctc

SEQ ID NO: 34072 - DNA, 20 bp, human
gcctcgccgcggccgaaggg

SEQ ID NO: 34073 - DNA, 20 bp, human
gtaagaggcgacgctggagc

SEQ ID NO: 34074 - DNA, 20 bp, human
gctgtcctctgggacaactc

SEQ ID NO: 34075 - DNA, 20 bp, human
gggtcgcgctgggtccggct

SEQ ID NO: 34076 - DNA, 20 bp, human
gcgcagccggccgagggtgg

SEQ ID NO: 34077 - DNA, 20 bp, human
gagccggccgagggtggcgg

SEQ ID NO: 34078 - DNA, 20 bp, human
gagaatgaggacgagatgtc

SEQ ID NO: 34079 - DNA, 20 bp, human
gtctcctcggcgaacagccg

SEQ ID NO: 34080 - DNA, 20 bp, human
ggagtcccgcagccggccga

SEQ ID NO: 34081 - DNA, 20 bp, human
gacgagatgtcaggtgagcg

SEQ ID NO: 34082 - DNA, 20 bp, human
gcgaggccagaggcgcacgg

SEQ ID NO: 34083 - DNA, 20 bp, human
gaggcggccgagagaaaggg

SEQ ID NO: 34084 - DNA, 20 bp, human
gggcctcggcgagaagatgg

SEQ ID NO: 34085 - DNA, 20 bp, human
gggcggcagcgccagaggca

SEQ ID NO: 34086 - DNA, 20 bp, human
gccgcagcggcgcactccca

SEQ ID NO: 34087 - DNA, 20 bp, human
gcgtgccgaggccccccccg

SEQ ID NO: 34088 - DNA, 20 bp, human
gtgaatggagccgggatgag

SEQ ID NO: 34089 - DNA, 20 bp, human
gcggtccgccgaggccaggg

SEQ ID NO: 34090 - DNA, 20 bp, human
gatcccggctccattcatag

SEQ ID NO: 34091 - DNA, 20 bp, human
gagcggcgcactcccaagga

SEQ ID NO: 34092 - DNA, 20 bp, human
ggggaaggcgggcccgagat

SEQ ID NO: 34093 - DNA, 20 bp, human
gctgctgcaggagccatttt

SEQ ID NO: 34094 - DNA, 20 bp, human
gcgggcgcggtgggaccccc

SEQ ID NO: 34095 - DNA, 20 bp, human
ggttagggtgcccctatgaa

SEQ ID NO: 34096 - DNA, 20 bp, human
ggagttgggagcgaggagtt

SEQ ID NO: 34097 - DNA, 20 bp, human
ggctcgtgctcgggaactat

SEQ ID NO: 34098 - DNA, 20 bp, human
gtcccctcggcactaggcag

SEQ ID NO: 34099 - DNA, 20 bp, human
ggcagctgccgagccaactc

SEQ ID NO: 34100 - DNA, 20 bp, human
gcggggccgcgctaggagtt

SEQ ID NO: 34101 - DNA, 20 bp, human
gggcggcaggaaatcgctcc

SEQ ID NO: 34102 - DNA, 20 bp, human
gcgacgccggcgacactacg

SEQ ID NO: 34103 - DNA, 20 bp, human
gcgcgctcaccgggtcggtc

SEQ ID NO: 34104 - DNA, 20 bp, human
gcggcgcgggggttgagtcg

SEQ ID NO: 34105 - DNA, 20 bp, human
ggcagagcgggctccggagt

SEQ ID NO: 34106 - DNA, 20 bp, human
gtgcctggaaaggaagtacc

SEQ ID NO: 34107 - DNA, 20 bp, human
gaggcgccttgttctcggag

SEQ ID NO: 34108 - DNA, 20 bp, human
gagaacaaggcgccttccgg

SEQ ID NO: 34109 - DNA, 20 bp, human
ggttgaaacgctgcctggaa

SEQ ID NO: 34110 - DNA, 20 bp, human
gcagagaagggaaaactcct

SEQ ID NO: 34111 - DNA, 20 bp, human
gtactgggcgtagtgtagat

SEQ ID NO: 34112 - DNA, 20 bp, human
gagggctggccatgctccgc

SEQ ID NO: 34113 - DNA, 20 bp, human
ggcgtagtgtagattggagg

SEQ ID NO: 34114 - DNA, 20 bp, human
gtgggcgtagtgtagattgg

SEQ ID NO: 34115 - DNA, 20 bp, human
gagtatggagtaaccaaacg

SEQ ID NO: 34116 - DNA, 20 bp, human
gtcaccccagtggaggagag

SEQ ID NO: 34117 - DNA, 20 bp, human
gttaggttgcgcaggaggag

SEQ ID NO: 34118 - DNA, 20 bp, human
gtggccatccccaccctgga

SEQ ID NO: 34119 - DNA, 20 bp, human
gaaagggaaagggcgaggtg

SEQ ID NO: 34120 - DNA, 20 bp, human
gagtaaggtccatacagcag

SEQ ID NO: 34121 - DNA, 20 bp, human
gggtacatgcacttgaggta

SEQ ID NO: 34122 - DNA, 20 bp, human
gcgggataggagcaatgtta

SEQ ID NO: 34123 - DNA, 20 bp, human
gctagcgggggtgccctcca

SEQ ID NO: 34124 - DNA, 20 bp, human
ggaggcccgacaagccctga

SEQ ID NO: 34125 - DNA, 20 bp, human
gtgaggaagtgaggggttga

SEQ ID NO: 34126 - DNA, 20 bp, human
gtatctctgcagaccgcaag

SEQ ID NO: 34127 - DNA, 20 bp, human
gagagataaccggaggagtc

SEQ ID NO: 34128 - DNA, 20 bp, human
ggtcgcccagagccactcca

SEQ ID NO: 34129 - DNA, 20 bp, human
gggtctgcagagataaccgg

SEQ ID NO: 34130 - DNA, 20 bp, human
gcctgagtcccaggattccg

SEQ ID NO: 34131 - DNA, 20 bp, human
ggtggcgcctgcgctctagt

SEQ ID NO: 34132 - DNA, 20 bp, human
gggtctctgggtccccccca

SEQ ID NO: 34133 - DNA, 20 bp, human
ggctctagtgggcgcttcac

SEQ ID NO: 34134 - DNA, 20 bp, human
gaggctccagggagacgccc

SEQ ID NO: 34135 - DNA, 20 bp, human
gcctccagtccccggaatcc

SEQ ID NO: 34136 - DNA, 20 bp, human
gaggaagcccgggggcaccg

SEQ ID NO: 34137 - DNA, 20 bp, human
gctgccccgcgctgacaggg

SEQ ID NO: 34138 - DNA, 20 bp, human
gggaccggatccctcacctc

SEQ ID NO: 34139 - DNA, 20 bp, human
gtccccacgcccgaggcggt

SEQ ID NO: 34140 - DNA, 20 bp, human
gagcagcccgcagccatgac

SEQ ID NO: 34141 - DNA, 20 bp, human
gaggcccccctgtcagcgcg

SEQ ID NO: 34142 - DNA, 20 bp, human
gttcctccccacgcccgagg

SEQ ID NO: 34143 - DNA, 20 bp, human
ggcccgccccgcgcctgtca

SEQ ID NO: 34144 - DNA, 20 bp, human
ggatccctcacctcaggcgg

SEQ ID NO: 34145 - DNA, 20 bp, human
gcgactgagactgacactcg

SEQ ID NO: 34146 - DNA, 20 bp, human
gtggacaggaaataacccaa

SEQ ID NO: 34147 - DNA, 20 bp, human
gtttagatgacttgaaactg

SEQ ID NO: 34148 - DNA, 20 bp, human
gggatctaatataataacct

SEQ ID NO: 34149 - DNA, 20 bp, human
gtggctaccaatttatactc

SEQ ID NO: 34150 - DNA, 20 bp, human
gacaaaaagcagcataatag

SEQ ID NO: 34151 - DNA, 20 bp, human
gacttttcatgatgacagat

SEQ ID NO: 34152 - DNA, 20 bp, human
gttggaaatttcacagaaag

SEQ ID NO: 34153 - DNA, 20 bp, human
gtctttttaacattttacca

SEQ ID NO: 34154 - DNA, 20 bp, human
ggaaataatctttatgtcca

SEQ ID NO: 34155 - DNA, 20 bp, human
gaagtaatgttaacaaagcc

SEQ ID NO: 34156 - DNA, 20 bp, human
gtcgcctgctggggctcgga

SEQ ID NO: 34157 - DNA, 20 bp, human
gggaggcgcgcgaagcccga

SEQ ID NO: 34158 - DNA, 20 bp, human
gctccgccagcgctcggaca

SEQ ID NO: 34159 - DNA, 20 bp, human
gtgctggggctcggagggat

SEQ ID NO: 34160 - DNA, 20 bp, human
gccgagcgctggcggagcac

SEQ ID NO: 34161 - DNA, 20 bp, human
gcagctacgcggggttagag

SEQ ID NO: 34162 - DNA, 20 bp, human
gctccgcggctactcacccg

SEQ ID NO: 34163 - DNA, 20 bp, human
gccgcgcgaagcgaaacggg

SEQ ID NO: 34164 - DNA, 20 bp, human
gatgggccgtgtccgagcgc

SEQ ID NO: 34165 - DNA, 20 bp, human
ggcgcgcgaagcccgagggc

SEQ ID NO: 34166 - DNA, 20 bp, human
gatggggcagaaaacgcctg

SEQ ID NO: 34167 - DNA, 20 bp, human
gaggatatagggagcggtat

SEQ ID NO: 34168 - DNA, 20 bp, human
gaagggcggccggtagagta

SEQ ID NO: 34169 - DNA, 20 bp, human
gggcaaaggacagtccggtg

SEQ ID NO: 34170 - DNA, 20 bp, human
gaggaagaggatatagggag

SEQ ID NO: 34171 - DNA, 20 bp, human
gggcgaacgactggggaagg

SEQ ID NO: 34172 - DNA, 20 bp, human
ggctttccggcgaacgactg

SEQ ID NO: 34173 - DNA, 20 bp, human
gtagtgagggagggcatggt

SEQ ID NO: 34174 - DNA, 20 bp, human
gctgctagctaagaacccca

SEQ ID NO: 34175 - DNA, 20 bp, human
gcgagcacctcggctgtaaa

SEQ ID NO: 34176 - DNA, 20 bp, human
gtcacgcggtgagtcatatg

SEQ ID NO: 34177 - DNA, 20 bp, human
gctgcagcgctcggcactgt

SEQ ID NO: 34178 - DNA, 20 bp, human
gggatagggtggccagaagt

SEQ ID NO: 34179 - DNA, 20 bp, human
gggctccaggtgggctcacg

SEQ ID NO: 34180 - DNA, 20 bp, human
ggagagtgtgcggctccagg

SEQ ID NO: 34181 - DNA, 20 bp, human
gccgggcgagagacacgtcg

SEQ ID NO: 34182 - DNA, 20 bp, human
ggctgaagtagtctcgagtg

SEQ ID NO: 34183 - DNA, 20 bp, human
gagcgcccagtagctaagac

SEQ ID NO: 34184 - DNA, 20 bp, human
gagagaaggcgggactgatg

SEQ ID NO: 34185 - DNA, 20 bp, human
gcgagaggggaggacggatc

SEQ ID NO: 34186 - DNA, 20 bp, human
ggcgctggtggtcgatcgtg

SEQ ID NO: 34187 - DNA, 20 bp, human
gccattgcgagccacgaact

SEQ ID NO: 34188 - DNA, 20 bp, human
gcgaccaccagcgccgtctg

SEQ ID NO: 34189 - DNA, 20 bp, human
gcctatcgggacccgtacaa

SEQ ID NO: 34190 - DNA, 20 bp, human
gggccgcggggaacgtcctc

SEQ ID NO: 34191 - DNA, 20 bp, human
gcgggaatgcggggacccac

SEQ ID NO: 34192 - DNA, 20 bp, human
ggtcgatcgtgtggcgccgg

SEQ ID NO: 34193 - DNA, 20 bp, human
ggaggaccgcccaaagccgg

SEQ ID NO: 34194 - DNA, 20 bp, human
gcggccaataggaggttccg

SEQ ID NO: 34195 - DNA, 20 bp, human
gtctcaccatcggggggcag

SEQ ID NO: 34196 - DNA, 20 bp, human
gtggcctgcccgcaacccgg

SEQ ID NO: 34197 - DNA, 20 bp, human
ggcgggagtggaccatcggg

SEQ ID NO: 34198 - DNA, 20 bp, human
gtggagactcccgaccccag

SEQ ID NO: 34199 - DNA, 20 bp, human
gccgcaatgtctcttgacag

SEQ ID NO: 34200 - DNA, 20 bp, human
gggaccatcgggcggagacg

SEQ ID NO: 34201 - DNA, 20 bp, human
ggaagcgggagtggaccatc

SEQ ID NO: 34202 - DNA, 20 bp, human
gcgagccgcacgtcctcctg

SEQ ID NO: 34203 - DNA, 20 bp, human
gcgccccgcggatcagctga

SEQ ID NO: 34204 - DNA, 20 bp, human
gcaatgtctcttgacagcgg

SEQ ID NO: 34205 - DNA, 20 bp, human
gtgtctcttgacagcggcgg

SEQ ID NO: 34206 - DNA, 20 bp, human
gcgcccctcgcccggtgcct

SEQ ID NO: 34207 - DNA, 20 bp, human
gggggtcggggtatataagc

SEQ ID NO: 34208 - DNA, 20 bp, human
gagcactgcagtggcaggag

SEQ ID NO: 34209 - DNA, 20 bp, human
gcggggctcgagcactgcag

SEQ ID NO: 34210 - DNA, 20 bp, human
gggtgcccggacctcaaggt

SEQ ID NO: 34211 - DNA, 20 bp, human
ggtgctcgagccccgtgcag

SEQ ID NO: 34212 - DNA, 20 bp, human
ggacagacggacgcacgccg

SEQ ID NO: 34213 - DNA, 20 bp, human
gccgcgcccgaagggaagtg

SEQ ID NO: 34214 - DNA, 20 bp, human
gccgcaagctcccctgcacg

SEQ ID NO: 34215 - DNA, 20 bp, human
gagacaaggggtgggcacaa

SEQ ID NO: 34216 - DNA, 20 bp, human
gccacaccgcggggaccagg

SEQ ID NO: 34217 - DNA, 20 bp, human
gcggctggaccggagaagcg

SEQ ID NO: 34218 - DNA, 20 bp, human
gggcttcctagcccaaccag

SEQ ID NO: 34219 - DNA, 20 bp, human
gccctgtgcggaaaggaaga

SEQ ID NO: 34220 - DNA, 20 bp, human
gcggagaagcgaggcgcagg

SEQ ID NO: 34221 - DNA, 20 bp, human
ggaggcacgctggttttccg

SEQ ID NO: 34222 - DNA, 20 bp, human
gctcagatacagaaagactg

SEQ ID NO: 34223 - DNA, 20 bp, human
gtgaggtttccttgcaggta

SEQ ID NO: 34224 - DNA, 20 bp, human
gcggcggcccctgtgcggaa

SEQ ID NO: 34225 - DNA, 20 bp, human
ggtgctgcttcgtgacgtca

SEQ ID NO: 34226 - DNA, 20 bp, human
gctgctgggtgagggactaa

SEQ ID NO: 34227 - DNA, 20 bp, human
gtggggaagaggccctgtct

SEQ ID NO: 34228 - DNA, 20 bp, human
gtagctggcaccaggagccg

SEQ ID NO: 34229 - DNA, 20 bp, human
gggtgccagctacctagaca

SEQ ID NO: 34230 - DNA, 20 bp, human
gcaccaggagccgtgggcaa

SEQ ID NO: 34231 - DNA, 20 bp, human
gacgcctctggacttaaaag

SEQ ID NO: 34232 - DNA, 20 bp, human
gggtgagggactaagggagt

SEQ ID NO: 34233 - DNA, 20 bp, human
ggagtgggacaggtatataa

SEQ ID NO: 34234 - DNA, 20 bp, human
gccgcgtcggggagtggagt

SEQ ID NO: 34235 - DNA, 20 bp, human
ggacttaaaagtggaggtgg

SEQ ID NO: 34236 - DNA, 20 bp, human
gatggaccagaagtctctct

SEQ ID NO: 34237 - DNA, 20 bp, human
gagaagctggccaaggatat

SEQ ID NO: 34238 - DNA, 20 bp, human
ggatatgggagcaaccacca

SEQ ID NO: 34239 - DNA, 20 bp, human
gaccagaagtctctctgggc

SEQ ID NO: 34240 - DNA, 20 bp, human
ggtggttgctcccatatcct

SEQ ID NO: 34241 - DNA, 20 bp, human
ggaacatcctgccagtgcaa

SEQ ID NO: 34242 - DNA, 20 bp, human
gtgtgtatcccagaagaagc

SEQ ID NO: 34243 - DNA, 20 bp, human
gccattcaggaaagatcagg

SEQ ID NO: 34244 - DNA, 20 bp, human
gtagccagaaccctttgcac

SEQ ID NO: 34245 - DNA, 20 bp, human
gtctgggatacacattctct

SEQ ID NO: 34246 - DNA, 20 bp, human
ggttctgctgtcccagataa

SEQ ID NO: 34247 - DNA, 20 bp, human
gtacacctgcaatagatggg

SEQ ID NO: 34248 - DNA, 20 bp, human
gcactacacctgcaatagat

SEQ ID NO: 34249 - DNA, 20 bp, human
gccaagccaggagatccagg

SEQ ID NO: 34250 - DNA, 20 bp, human
gaaatctgttgagccaaacc

SEQ ID NO: 34251 - DNA, 20 bp, human
gctgaatcttagtgctccat

SEQ ID NO: 34252 - DNA, 20 bp, human
gcacccaagccaggagatcc

SEQ ID NO: 34253 - DNA, 20 bp, human
gagtgtcataaatatgtcag

SEQ ID NO: 34254 - DNA, 20 bp, human
gtgggtgtttcatatgttgg

SEQ ID NO: 34255 - DNA, 20 bp, human
gtcaaaaagaactagaacaa

SEQ ID NO: 34256 - DNA, 20 bp, human
gtgttcgtgcacagacgagg

SEQ ID NO: 34257 - DNA, 20 bp, human
gtcgtctgtgcacgaacagg

SEQ ID NO: 34258 - DNA, 20 bp, human
gtgaagctttggcaccgtct

SEQ ID NO: 34259 - DNA, 20 bp, human
ggtgagagatgtgtgagggg

SEQ ID NO: 34260 - DNA, 20 bp, human
gtgccatttatgtgagataa

SEQ ID NO: 34261 - DNA, 20 bp, human
gagatcattttatacccaaa

SEQ ID NO: 34262 - DNA, 20 bp, human
gacgaacaggtggccgactc

SEQ ID NO: 34263 - DNA, 20 bp, human
gtgtgtgagagatgtgtgag

SEQ ID NO: 34264 - DNA, 20 bp, human
gaggaggtttcatgaagctt

SEQ ID NO: 34265 - DNA, 20 bp, human
gaaagacacatgcacacgta

SEQ ID NO: 34266 - DNA, 20 bp, human
gatcctgctgcccaacatgg

SEQ ID NO: 34267 - DNA, 20 bp, human
gggcaccccgcactaataca

SEQ ID NO: 34268 - DNA, 20 bp, human
ggacaccatctcggaactgg

SEQ ID NO: 34269 - DNA, 20 bp, human
ggtctaaatggggaaaccat

SEQ ID NO: 34270 - DNA, 20 bp, human
gtgtcgaactccgccatgtt

SEQ ID NO: 34271 - DNA, 20 bp, human
gagcatcctgctgcccaaca

SEQ ID NO: 34272 - DNA, 20 bp, human
gagggttgactgattgactg

SEQ ID NO: 34273 - DNA, 20 bp, human
gcccgcactaatacagggtc

SEQ ID NO: 34274 - DNA, 20 bp, human
gcgctcactacccgaggcgg

SEQ ID NO: 34275 - DNA, 20 bp, human
gtgaggcgtacacttaggaa

SEQ ID NO: 34276 - DNA, 20 bp, human
gctccggctacagaggggat

SEQ ID NO: 34277 - DNA, 20 bp, human
gcagccgacagcgaactccg

SEQ ID NO: 34278 - DNA, 20 bp, human
gctcggctccggctacagag

SEQ ID NO: 34279 - DNA, 20 bp, human
gccgtgtaaggcccggagga

SEQ ID NO: 34280 - DNA, 20 bp, human
ggtcaccgtgtaaggcccgg

SEQ ID NO: 34281 - DNA, 20 bp, human
gcgcggacgaccaccgggtc

SEQ ID NO: 34282 - DNA, 20 bp, human
gggaggtgtcggcctctggg

SEQ ID NO: 34283 - DNA, 20 bp, human
gccttacacggtgacgtgac

SEQ ID NO: 34284 - DNA, 20 bp, human
gcacgtcaccgtgtaaggcc

SEQ ID NO: 34285 - DNA, 20 bp, human
gggagccgcggacgaccacc

SEQ ID NO: 34286 - DNA, 20 bp, human
gggcctgagtgcgcagacaa

SEQ ID NO: 34287 - DNA, 20 bp, human
gatgcaggtgagccccgcgg

SEQ ID NO: 34288 - DNA, 20 bp, human
gtgagagggtgtgaggacga

SEQ ID NO: 34289 - DNA, 20 bp, human
gccggacggccacaaacgca

SEQ ID NO: 34290 - DNA, 20 bp, human
gtaggcgcgctgggtggaag

SEQ ID NO: 34291 - DNA, 20 bp, human
gaaactgaggccgtgcaagg

SEQ ID NO: 34292 - DNA, 20 bp, human
gtgtgagcgcgcggctcgtg

SEQ ID NO: 34293 - DNA, 20 bp, human
gtccggcctccctgacatgc

SEQ ID NO: 34294 - DNA, 20 bp, human
gagggttgctatgagagcga

SEQ ID NO: 34295 - DNA, 20 bp, human
gcgcggctcgtgtggcagag

SEQ ID NO: 34296 - DNA, 20 bp, human
ggcaccatgatgcagctcag

SEQ ID NO: 34297 - DNA, 20 bp, human
ggacccagcccactatccga

SEQ ID NO: 34298 - DNA, 20 bp, human
gaggtgagccgtcggatagt

SEQ ID NO: 34299 - DNA, 20 bp, human
gccacaggaaaggtaatcaa

SEQ ID NO: 34300 - DNA, 20 bp, human
gagcctggggccaagatcct

SEQ ID NO: 34301 - DNA, 20 bp, human
gttgcaggacagacaatatg

SEQ ID NO: 34302 - DNA, 20 bp, human
gctggaaagctggtttgtat

SEQ ID NO: 34303 - DNA, 20 bp, human
gcaagggactgcaagccagg

SEQ ID NO: 34304 - DNA, 20 bp, human
gagcctaagggggagcccac

SEQ ID NO: 34305 - DNA, 20 bp, human
gtgcatcatggtgcggtctg

SEQ ID NO: 34306 - DNA, 20 bp, human
gcgggcggccgcagcgcgag

SEQ ID NO: 34307 - DNA, 20 bp, human
ggccgcagcgcgagaggact

SEQ ID NO: 34308 - DNA, 20 bp, human
gctgcggcgactgtggagcg

SEQ ID NO: 34309 - DNA, 20 bp, human
ggcagccggagccccggacg

SEQ ID NO: 34310 - DNA, 20 bp, human
gggctccggctgctcgtctg

SEQ ID NO: 34311 - DNA, 20 bp, human
ggcggccggcgctcctcgtg

SEQ ID NO: 34312 - DNA, 20 bp, human
gggcgctcctcgtgcggcgg

SEQ ID NO: 34313 - DNA, 20 bp, human
gccggctgctcgtctgcggg

SEQ ID NO: 34314 - DNA, 20 bp, human
gtctcactggcaggccggcg

SEQ ID NO: 34315 - DNA, 20 bp, human
ggccggcgctcctcgtgcgg

SEQ ID NO: 34316 - DNA, 20 bp, human
gcgagcccgtccgaagggag

SEQ ID NO: 34317 - DNA, 20 bp, human
gggtcgagcccgcgccatgg

SEQ ID NO: 34318 - DNA, 20 bp, human
gcaggcgcgggcgcaagagg

SEQ ID NO: 34319 - DNA, 20 bp, human
gcccggtcgagcccgcgcca

SEQ ID NO: 34320 - DNA, 20 bp, human
gcgagcgccgagcctaccaa

SEQ ID NO: 34321 - DNA, 20 bp, human
gtactcccggcaccattggt

SEQ ID NO: 34322 - DNA, 20 bp, human
ggcctggtgtgggtctgcag

SEQ ID NO: 34323 - DNA, 20 bp, human
ggcggccgaggcgacagctg

SEQ ID NO: 34324 - DNA, 20 bp, human
gggtaaaccctcagctcctc

SEQ ID NO: 34325 - DNA, 20 bp, human
ggccggggccgcggcaggta

SEQ ID NO: 34326 - DNA, 20 bp, human
gggcaggagggcgtagaccc

SEQ ID NO: 34327 - DNA, 20 bp, human
gtggctctctggccgcggga

SEQ ID NO: 34328 - DNA, 20 bp, human
ggtctacgccctcctgccgg

SEQ ID NO: 34329 - DNA, 20 bp, human
gccctcagcctgcacccggg

SEQ ID NO: 34330 - DNA, 20 bp, human
ggagccagcctccggcagga

SEQ ID NO: 34331 - DNA, 20 bp, human
ggtcagtcgacggagcacac

SEQ ID NO: 34332 - DNA, 20 bp, human
gaacggctccagccttcccg

SEQ ID NO: 34333 - DNA, 20 bp, human
gatccggcctcggccaccgg

SEQ ID NO: 34334 - DNA, 20 bp, human
gtaagctctgggcggatcca

SEQ ID NO: 34335 - DNA, 20 bp, human
gggtccctcgtccgcagtgg

SEQ ID NO: 34336 - DNA, 20 bp, human
gagttggcagttacagggag

SEQ ID NO: 34337 - DNA, 20 bp, human
ggcgggagttggcagttaca

SEQ ID NO: 34338 - DNA, 20 bp, human
ggatcacatcaaactccgaa

SEQ ID NO: 34339 - DNA, 20 bp, human
gacgtttcccgtcaagatgg

SEQ ID NO: 34340 - DNA, 20 bp, human
gatgtgatcgtaatagggac

SEQ ID NO: 34341 - DNA, 20 bp, human
gttatcaacggagacgactt

SEQ ID NO: 34342 - DNA, 20 bp, human
ggagtatccgccatcttgac

SEQ ID NO: 34343 - DNA, 20 bp, human
gcaaatggcgataagcactg

SEQ ID NO: 34344 - DNA, 20 bp, human
gtgcagtgtcatgaaatgga

SEQ ID NO: 34345 - DNA, 20 bp, human
gggtagtccggagtcagcgc

SEQ ID NO: 34346 - DNA, 20 bp, human
gcttgcatttcgggaaggaa

SEQ ID NO: 34347 - DNA, 20 bp, human
ggaatccagaacttcagtga

SEQ ID NO: 34348 - DNA, 20 bp, human
gaatagcaaggaactcacca

SEQ ID NO: 34349 - DNA, 20 bp, human
ggctattaaaatacgataac

SEQ ID NO: 34350 - DNA, 20 bp, human
gggattcttgcatttcggga

SEQ ID NO: 34351 - DNA, 20 bp, human
gacgataactggctttcttc

SEQ ID NO: 34352 - DNA, 20 bp, human
gactcaccatggttgaaaag

SEQ ID NO: 34353 - DNA, 20 bp, human
gcgatgaaccaattagaaat

SEQ ID NO: 34354 - DNA, 20 bp, human
gcagaaaaatccttctttgg

SEQ ID NO: 34355 - DNA, 20 bp, human
gtattagacacccccaaaga

SEQ ID NO: 34356 - DNA, 20 bp, human
gtccgggcggtgtcaggtcc

SEQ ID NO: 34357 - DNA, 20 bp, human
ggggcggtgtcaggtcccgg

SEQ ID NO: 34358 - DNA, 20 bp, human
ggagaagggacgccaactcc

SEQ ID NO: 34359 - DNA, 20 bp, human
gaagggacgccaactccggg

SEQ ID NO: 34360 - DNA, 20 bp, human
gcaggagcagcactcggaga

SEQ ID NO: 34361 - DNA, 20 bp, human
gacctgacaccgcccggagt

SEQ ID NO: 34362 - DNA, 20 bp, human
gcagcactcggagagggaga

SEQ ID NO: 34363 - DNA, 20 bp, human
gccgccgggtgcagcttggt

SEQ ID NO: 34364 - DNA, 20 bp, human
ggttccgggtcgggtatcgg

SEQ ID NO: 34365 - DNA, 20 bp, human
ggggcctagaccaccaaccc

SEQ ID NO: 34366 - DNA, 20 bp, human
gagcgcgccgaaggcagaga

SEQ ID NO: 34367 - DNA, 20 bp, human
gggaagtgggaccaaaacaa

SEQ ID NO: 34368 - DNA, 20 bp, human
gcggctgagaagcgcgccga

SEQ ID NO: 34369 - DNA, 20 bp, human
gagccgggccgccgacccaa

SEQ ID NO: 34370 - DNA, 20 bp, human
gtccagacggcggtgacgat

SEQ ID NO: 34371 - DNA, 20 bp, human
ggctgccagggtccagacgg

SEQ ID NO: 34372 - DNA, 20 bp, human
gggcaaggtgaccaagtcga

SEQ ID NO: 34373 - DNA, 20 bp, human
ggacgtccagagtctcaaac

SEQ ID NO: 34374 - DNA, 20 bp, human
gggtaaggtaagtccgctcc

SEQ ID NO: 34375 - DNA, 20 bp, human
gcatgttagacatagtcgga

SEQ ID NO: 34376 - DNA, 20 bp, human
gagcgaggcaccggacaccc

SEQ ID NO: 34377 - DNA, 20 bp, human
ggtgcgggcggcagcgtacg

SEQ ID NO: 34378 - DNA, 20 bp, human
gcggcggcgacaggaccgag

SEQ ID NO: 34379 - DNA, 20 bp, human
gtagaggaggacaggatggg

SEQ ID NO: 34380 - DNA, 20 bp, human
gccgaggggccttagttggt

SEQ ID NO: 34381 - DNA, 20 bp, human
gtccagcaggggccactcac

SEQ ID NO: 34382 - DNA, 20 bp, human
gtgggcccggcaccaaagca

SEQ ID NO: 34383 - DNA, 20 bp, human
gccgacttgcccaccaacta

SEQ ID NO: 34384 - DNA, 20 bp, human
ggaggacagagcaattgtgg

SEQ ID NO: 34385 - DNA, 20 bp, human
gaccaagaacaggtgaatgt

SEQ ID NO: 34386 - DNA, 20 bp, human
ggagttccaggccgggctga

SEQ ID NO: 34387 - DNA, 20 bp, human
gtcctttgccagcgttgggc

SEQ ID NO: 34388 - DNA, 20 bp, human
gacctgagctccgggtgacg

SEQ ID NO: 34389 - DNA, 20 bp, human
gcctaggtgagcctaaggtg

SEQ ID NO: 34390 - DNA, 20 bp, human
gacccggagctcaggtgacc

SEQ ID NO: 34391 - DNA, 20 bp, human
gccacaggtgaccgccctcg

SEQ ID NO: 34392 - DNA, 20 bp, human
gcctgctgaggaaaacccga

SEQ ID NO: 34393 - DNA, 20 bp, human
gccccgcctccagggacagt

SEQ ID NO: 34394 - DNA, 20 bp, human
ggccgcgtcacccggagctc

SEQ ID NO: 34395 - DNA, 20 bp, human
gggtcgccaggcaggacccg

SEQ ID NO: 34396 - DNA, 20 bp, human
gctttcagttccccgcgccc

SEQ ID NO: 34397 - DNA, 20 bp, human
gagtgaagttggtaaatgac

SEQ ID NO: 34398 - DNA, 20 bp, human
gggctgcccgtgacctgcct

SEQ ID NO: 34399 - DNA, 20 bp, human
ggggaactgaaagccggaag

SEQ ID NO: 34400 - DNA, 20 bp, human
gtctttgggcggcttctcct

SEQ ID NO: 34401 - DNA, 20 bp, human
gaaagccggaaggggcaaga

SEQ ID NO: 34402 - DNA, 20 bp, human
gacctcgccactgagcgcgt

SEQ ID NO: 34403 - DNA, 20 bp, human
gtcgaacaggtagccgaggg

SEQ ID NO: 34404 - DNA, 20 bp, human
gtacgctgggaaaaggttcc

SEQ ID NO: 34405 - DNA, 20 bp, human
gggactcccactcgacaggg

SEQ ID NO: 34406 - DNA, 20 bp, human
gagctcgcgatgagtggtct

SEQ ID NO: 34407 - DNA, 20 bp, human
gtctggaggacgctgagggg

SEQ ID NO: 34408 - DNA, 20 bp, human
ggaggcgagctcgcgatgag

SEQ ID NO: 34409 - DNA, 20 bp, human
gaagtctggaggacgctgag

SEQ ID NO: 34410 - DNA, 20 bp, human
gcttcgggaagggtgagcca

SEQ ID NO: 34411 - DNA, 20 bp, human
gtcggcaggctcttcgggaa

SEQ ID NO: 34412 - DNA, 20 bp, human
gcaggagcaaggcggaagtc

SEQ ID NO: 34413 - DNA, 20 bp, human
gaaaccccggcggccgatgg

SEQ ID NO: 34414 - DNA, 20 bp, human
gggaacaaggcgccccgaca

SEQ ID NO: 34415 - DNA, 20 bp, human
gcgggaagggtgagccaggg

SEQ ID NO: 34416 - DNA, 20 bp, human
ggctgcgcgcagcagaggtg

SEQ ID NO: 34417 - DNA, 20 bp, human
ggacgtccgactgtacccag

SEQ ID NO: 34418 - DNA, 20 bp, human
gtaggacctcaggcacctct

SEQ ID NO: 34419 - DNA, 20 bp, human
gcagcctgcggtgcgggtca

SEQ ID NO: 34420 - DNA, 20 bp, human
gagccttggggtgcccggtg

SEQ ID NO: 34421 - DNA, 20 bp, human
gctctgctgcgcgcagcctg

SEQ ID NO: 34422 - DNA, 20 bp, human
gatggcgcggctaccgaagc

SEQ ID NO: 34423 - DNA, 20 bp, human
gtttgggtgagggacgggaa

SEQ ID NO: 34424 - DNA, 20 bp, human
gaagctggcagtctttgatt

SEQ ID NO: 34425 - DNA, 20 bp, human
gccataagagcaggtgaggt

SEQ ID NO: 34426 - DNA, 20 bp, human
gtctgacccggagagttcca

SEQ ID NO: 34427 - DNA, 20 bp, human
gagggtcagaccagaccccg

SEQ ID NO: 34428 - DNA, 20 bp, human
ggcccgtggcaagtctgaag

SEQ ID NO: 34429 - DNA, 20 bp, human
gtgacggccgccaagaagca

SEQ ID NO: 34430 - DNA, 20 bp, human
gcggcgagcagcaaccatgt

SEQ ID NO: 34431 - DNA, 20 bp, human
ggccccttcagacttgccac

SEQ ID NO: 34432 - DNA, 20 bp, human
ggagacattgaagggagtcg

SEQ ID NO: 34433 - DNA, 20 bp, human
gcttgccacgggctcccccc

SEQ ID NO: 34434 - DNA, 20 bp, human
gtctgatgaaggtgaagtcc

SEQ ID NO: 34435 - DNA, 20 bp, human
gcccggcccggcaggcgtca

SEQ ID NO: 34436 - DNA, 20 bp, human
gtcggggacccagaccggaa

SEQ ID NO: 34437 - DNA, 20 bp, human
gacaggtgacacacactcca

SEQ ID NO: 34438 - DNA, 20 bp, human
gtcctctcggggacccagac

SEQ ID NO: 34439 - DNA, 20 bp, human
gactcttagggcactgacta

SEQ ID NO: 34440 - DNA, 20 bp, human
gtgagcaaggcagtcctctc

SEQ ID NO: 34441 - DNA, 20 bp, human
ggggacccagaccggaaagg

SEQ ID NO: 34442 - DNA, 20 bp, human
ggaataagcgaggtaggctg

SEQ ID NO: 34443 - DNA, 20 bp, human
gtccccaagggaaaggctag

SEQ ID NO: 34444 - DNA, 20 bp, human
gccgattgtccccaagggaa

SEQ ID NO: 34445 - DNA, 20 bp, human
ggaactggtactgactctta

SEQ ID NO: 34446 - DNA, 20 bp, human
gtgaggtgggaagggtgtat

SEQ ID NO: 34447 - DNA, 20 bp, human
gtaagggatcaggcaggatg

SEQ ID NO: 34448 - DNA, 20 bp, human
gggaagggtgtatgggccta

SEQ ID NO: 34449 - DNA, 20 bp, human
gggatcaaggcgagagcgag

SEQ ID NO: 34450 - DNA, 20 bp, human
gggtgtatgggcctagggct

SEQ ID NO: 34451 - DNA, 20 bp, human
gaaggcgagagcgagtggac

SEQ ID NO: 34452 - DNA, 20 bp, human
gcccaggacccgaaatgaag

SEQ ID NO: 34453 - DNA, 20 bp, human
ggggtgttggtagaaggagt

SEQ ID NO: 34454 - DNA, 20 bp, human
ggagcgagtggacgggcaat

SEQ ID NO: 34455 - DNA, 20 bp, human
gagagagggacgacgtgtaa

SEQ ID NO: 34456 - DNA, 20 bp, human
gcggccgaacaggttaccca

SEQ ID NO: 34457 - DNA, 20 bp, human
gccgaacaggttacccatgg

SEQ ID NO: 34458 - DNA, 20 bp, human
gggtggcgattggacttggt

SEQ ID NO: 34459 - DNA, 20 bp, human
gagcgggaggacccgagcta

SEQ ID NO: 34460 - DNA, 20 bp, human
gaagaagcagagccgcgtca

SEQ ID NO: 34461 - DNA, 20 bp, human
gccgcgcggaccccacggac

SEQ ID NO: 34462 - DNA, 20 bp, human
ggcgcggccgccgtagcggg

SEQ ID NO: 34463 - DNA, 20 bp, human
gcggcggtggcgattggact

SEQ ID NO: 34464 - DNA, 20 bp, human
gcgcagggcggagagaccga

SEQ ID NO: 34465 - DNA, 20 bp, human
ggggaggacccgagctacgg

SEQ ID NO: 34466 - DNA, 20 bp, human
gcccgctccggggaccacat

SEQ ID NO: 34467 - DNA, 20 bp, human
gcgagggcggaagcggacca

SEQ ID NO: 34468 - DNA, 20 bp, human
gtgtgttcgcagccttgccg

SEQ ID NO: 34469 - DNA, 20 bp, human
gtgtgcagagaacaggacca

SEQ ID NO: 34470 - DNA, 20 bp, human
gtccgatgtggtccccggag

SEQ ID NO: 34471 - DNA, 20 bp, human
gacgcaggcgcaccaccccc

SEQ ID NO: 34472 - DNA, 20 bp, human
gggcgggggcagctctcgga

SEQ ID NO: 34473 - DNA, 20 bp, human
gaggccgaggccccagccgg

SEQ ID NO: 34474 - DNA, 20 bp, human
gccgactgggacagcaagat

SEQ ID NO: 34475 - DNA, 20 bp, human
gggtgctgcaggacctgctg

SEQ ID NO: 34476 - DNA, 20 bp, human
ggcggcgcggccgagctcgt

SEQ ID NO: 34477 - DNA, 20 bp, human
gcccacacctcggagagagt

SEQ ID NO: 34478 - DNA, 20 bp, human
ggagcgcctggactcgcggg

SEQ ID NO: 34479 - DNA, 20 bp, human
gtccaggcgctcctcccagg

SEQ ID NO: 34480 - DNA, 20 bp, human
ggagagtggggtgcccgatg

SEQ ID NO: 34481 - DNA, 20 bp, human
gagggtcagggccattgtaa

SEQ ID NO: 34482 - DNA, 20 bp, human
ggaggagcgcctggactcgc

SEQ ID NO: 34483 - DNA, 20 bp, human
gtgggtgcggcgggctgatg

SEQ ID NO: 34484 - DNA, 20 bp, human
ggggcaccccactctctccg

SEQ ID NO: 34485 - DNA, 20 bp, human
gggtgatccctagcccgcct

SEQ ID NO: 34486 - DNA, 20 bp, human
gaagtgcaggcagagtccgg

SEQ ID NO: 34487 - DNA, 20 bp, human
gcatctgacagcgcagaggt

SEQ ID NO: 34488 - DNA, 20 bp, human
gcgcagaggtgggagagcgg

SEQ ID NO: 34489 - DNA, 20 bp, human
gaggaagtgcaggcagagtc

SEQ ID NO: 34490 - DNA, 20 bp, human
gacccgcgtccgcacactaa

SEQ ID NO: 34491 - DNA, 20 bp, human
gcggccgctcgcagcctccg

SEQ ID NO: 34492 - DNA, 20 bp, human
ggcggcagcgcgtcatctgg

SEQ ID NO: 34493 - DNA, 20 bp, human
ggtccccaggactttgccat

SEQ ID NO: 34494 - DNA, 20 bp, human
gccgacgggctgaaactcac

SEQ ID NO: 34495 - DNA, 20 bp, human
gctgacatctgacagcgcag

SEQ ID NO: 34496 - DNA, 20 bp, human
gtcgtcgtgtcccaacctcc

SEQ ID NO: 34497 - DNA, 20 bp, human
ggaagaagcaagcagcccca

SEQ ID NO: 34498 - DNA, 20 bp, human
gtggtacagaacacatcagg

SEQ ID NO: 34499 - DNA, 20 bp, human
gctgggtcatgtgagcctag

SEQ ID NO: 34500 - DNA, 20 bp, human
gtaatggtacagaacacatc

SEQ ID NO: 34501 - DNA, 20 bp, human
ggggaagcgctgacttgatg

SEQ ID NO: 34502 - DNA, 20 bp, human
ggactccagcgcagtgattc

SEQ ID NO: 34503 - DNA, 20 bp, human
gagggacaaaccaacctgaa

SEQ ID NO: 34504 - DNA, 20 bp, human
ggcgctgacttgatgcggcc

SEQ ID NO: 34505 - DNA, 20 bp, human
gagtgattcaggagagtgct

SEQ ID NO: 34506 - DNA, 20 bp, human
gccggcctctgacaagtgag

SEQ ID NO: 34507 - DNA, 20 bp, human
gatccaggaccagggcgcac

SEQ ID NO: 34508 - DNA, 20 bp, human
gtcagcctctcacttgtcag

SEQ ID NO: 34509 - DNA, 20 bp, human
gtctgccgccgcgtggtcag

SEQ ID NO: 34510 - DNA, 20 bp, human
ggtggtcagcggtgagtcag

SEQ ID NO: 34511 - DNA, 20 bp, human
ggagaccacgcggctcatcg

SEQ ID NO: 34512 - DNA, 20 bp, human
gaacggtgtggtccaagccg

SEQ ID NO: 34513 - DNA, 20 bp, human
ggaagagaagcaaagcgcaa

SEQ ID NO: 34514 - DNA, 20 bp, human
gccgaaggcgatgcgcgcag

SEQ ID NO: 34515 - DNA, 20 bp, human
ggaagcaaagcgcaacggtg

SEQ ID NO: 34516 - DNA, 20 bp, human
gggagcgtctctctccgcag

SEQ ID NO: 34517 - DNA, 20 bp, human
gagcaccggtctgacgactg

SEQ ID NO: 34518 - DNA, 20 bp, human
ggacggctgcaggagatccg

SEQ ID NO: 34519 - DNA, 20 bp, human
gaggagtgcggggacgacgg

SEQ ID NO: 34520 - DNA, 20 bp, human
ggggaaacacgtggatccat

SEQ ID NO: 34521 - DNA, 20 bp, human
ggcagtggcagaggacagtc

SEQ ID NO: 34522 - DNA, 20 bp, human
gggaacgcggcgcaacagag

SEQ ID NO: 34523 - DNA, 20 bp, human
gccagagactggagggccag

SEQ ID NO: 34524 - DNA, 20 bp, human
ggcggagagagacgctccca

SEQ ID NO: 34525 - DNA, 20 bp, human
gtgacgactgaggcggctac

SEQ ID NO: 34526 - DNA, 20 bp, human
ggacccgggagggaacccag

SEQ ID NO: 34527 - DNA, 20 bp, human
gcggggctctagctactgtg

SEQ ID NO: 34528 - DNA, 20 bp, human
gaggctggcctcacaaccaa

SEQ ID NO: 34529 - DNA, 20 bp, human
gctggcctcacaaccaaggg

SEQ ID NO: 34530 - DNA, 20 bp, human
gttccctcccgggtccgcag

SEQ ID NO: 34531 - DNA, 20 bp, human
gtccccagcgcaccacccct

SEQ ID NO: 34532 - DNA, 20 bp, human
gttccactgcggacccggga

SEQ ID NO: 34533 - DNA, 20 bp, human
gtcgtcccgcagtaacgtgg

SEQ ID NO: 34534 - DNA, 20 bp, human
ggcctcttcatagggaaggg

SEQ ID NO: 34535 - DNA, 20 bp, human
ggtagctagagccccgctcc

SEQ ID NO: 34536 - DNA, 20 bp, human
gcccatggccgagctggagg

SEQ ID NO: 34537 - DNA, 20 bp, human
gtccccgtcgggaatgaccg

SEQ ID NO: 34538 - DNA, 20 bp, human
gtccaggttcaagacccggg

SEQ ID NO: 34539 - DNA, 20 bp, human
ggagaacgcgtgggtccggg

SEQ ID NO: 34540 - DNA, 20 bp, human
gtgggagctgcgcgacccca

SEQ ID NO: 34541 - DNA, 20 bp, human
ggcgggaggagagaacgcgt

SEQ ID NO: 34542 - DNA, 20 bp, human
ggagctgacggcggttggaa

SEQ ID NO: 34543 - DNA, 20 bp, human
gacgccgcggtcattcccga

SEQ ID NO: 34544 - DNA, 20 bp, human
gcagcccggctcgaagctga

SEQ ID NO: 34545 - DNA, 20 bp, human
gtcgcgcagctcccacgccg

SEQ ID NO: 34546 - DNA, 20 bp, human
gcgcccggaccgcgggtccc

SEQ ID NO: 34547 - DNA, 20 bp, human
gggccggggacccgcggtcc

SEQ ID NO: 34548 - DNA, 20 bp, human
gcgggctgtgcagggtggta

SEQ ID NO: 34549 - DNA, 20 bp, human
ggccagaggagtctccgagg

SEQ ID NO: 34550 - DNA, 20 bp, human
gccgcgcggcaacaccaacg

SEQ ID NO: 34551 - DNA, 20 bp, human
gtggccgtgggcatctccct

SEQ ID NO: 34552 - DNA, 20 bp, human
gagctgctggaggggaatcg

SEQ ID NO: 34553 - DNA, 20 bp, human
ggtgacacgtcggacagctg

SEQ ID NO: 34554 - DNA, 20 bp, human
ggctcagagtctccaggttg

SEQ ID NO: 34555 - DNA, 20 bp, human
ggaaggcgccggggagaatt

SEQ ID NO: 34556 - DNA, 20 bp, human
gtcgccgagaggtagcgcag

SEQ ID NO: 34557 - DNA, 20 bp, human
gggcgcctcagcgggcactg

SEQ ID NO: 34558 - DNA, 20 bp, human
gggcggagccggcgcctcag

SEQ ID NO: 34559 - DNA, 20 bp, human
gacgggtgactgacaggcag

SEQ ID NO: 34560 - DNA, 20 bp, human
ggcgtcgggtcttcgttcta

SEQ ID NO: 34561 - DNA, 20 bp, human
gatagagacgggtgactgac

SEQ ID NO: 34562 - DNA, 20 bp, human
gacgcgcctggcagggagca

SEQ ID NO: 34563 - DNA, 20 bp, human
ggaggcgtggggaccaagag

SEQ ID NO: 34564 - DNA, 20 bp, human
gggaagaggaagctgcggac

SEQ ID NO: 34565 - DNA, 20 bp, human
gtctcagcagcccggtgacg

SEQ ID NO: 34566 - DNA, 20 bp, human
gcacggccaccgaagaggta

SEQ ID NO: 34567 - DNA, 20 bp, human
gcatccagagcgggatccac

SEQ ID NO: 34568 - DNA, 20 bp, human
gtgtcccacggccaccgaag

SEQ ID NO: 34569 - DNA, 20 bp, human
gtcggtggccgtgggacagt

SEQ ID NO: 34570 - DNA, 20 bp, human
gaggtccagtagagctgcag

SEQ ID NO: 34571 - DNA, 20 bp, human
gcacggcggaggtcgaggtc

SEQ ID NO: 34572 - DNA, 20 bp, human
ggccagccctacctcttcgg

SEQ ID NO: 34573 - DNA, 20 bp, human
gttgacggcgagccccagca

SEQ ID NO: 34574 - DNA, 20 bp, human
gaccggtcgggcccgcacgg

SEQ ID NO: 34575 - DNA, 20 bp, human
ggcccgcacggcggaggtcg

SEQ ID NO: 34576 - DNA, 20 bp, human
gtggtcgtgggtaaagacaa

SEQ ID NO: 34577 - DNA, 20 bp, human
gcccgtgggagttgtagtgt

SEQ ID NO: 34578 - DNA, 20 bp, human
gtgacccggatgcgggatag

SEQ ID NO: 34579 - DNA, 20 bp, human
gcggcgcatgcgcagatcgg

SEQ ID NO: 34580 - DNA, 20 bp, human
gggcggggcgcgaggggtaa

SEQ ID NO: 34581 - DNA, 20 bp, human
gtgggagttgtagtgtgggg

SEQ ID NO: 34582 - DNA, 20 bp, human
ggccgcgcccgctgccccgt

SEQ ID NO: 34583 - DNA, 20 bp, human
ggacgcgcgagaaagtgtgg

SEQ ID NO: 34584 - DNA, 20 bp, human
ggcccggcaagagcagccgg

SEQ ID NO: 34585 - DNA, 20 bp, human
gactggagaacgtgagggag

SEQ ID NO: 34586 - DNA, 20 bp, human
ggacgtggcacccggaccta

SEQ ID NO: 34587 - DNA, 20 bp, human
gcgaatggctcccctaggtc

SEQ ID NO: 34588 - DNA, 20 bp, human
ggggtgccacgtctcgtcca

SEQ ID NO: 34589 - DNA, 20 bp, human
gctatgccttggacgagacg

SEQ ID NO: 34590 - DNA, 20 bp, human
gtcctcctcagcaaacgggg

SEQ ID NO: 34591 - DNA, 20 bp, human
ggacgcgaacgggacagctg

SEQ ID NO: 34592 - DNA, 20 bp, human
gagtcagcgccagcccggag

SEQ ID NO: 34593 - DNA, 20 bp, human
ggctccttctcagaacggat

SEQ ID NO: 34594 - DNA, 20 bp, human
gcgcagcgcatcaccccgaa

SEQ ID NO: 34595 - DNA, 20 bp, human
gaggctcggcatgacgcgaa

SEQ ID NO: 34596 - DNA, 20 bp, human
gacgcgctccgagctccccg

SEQ ID NO: 34597 - DNA, 20 bp, human
gtccaccctgagctacccaa

SEQ ID NO: 34598 - DNA, 20 bp, human
gatggccagaggataggata

SEQ ID NO: 34599 - DNA, 20 bp, human
gcgctctcgtccgaggtctg

SEQ ID NO: 34600 - DNA, 20 bp, human
gctcggacgagagcgccccg

SEQ ID NO: 34601 - DNA, 20 bp, human
gaaaacaggctcaggaatac

SEQ ID NO: 34602 - DNA, 20 bp, human
ggaatacaggcagtgattaa

SEQ ID NO: 34603 - DNA, 20 bp, human
ggagtcccttgggtagctca

SEQ ID NO: 34604 - DNA, 20 bp, human
gaggcagatggccagaggat

SEQ ID NO: 34605 - DNA, 20 bp, human
gcagttagcaacctggatgg

SEQ ID NO: 34606 - DNA, 20 bp, human
gagggccaggaagcagcggt

SEQ ID NO: 34607 - DNA, 20 bp, human
gggagacgaaaaggacacgg

SEQ ID NO: 34608 - DNA, 20 bp, human
gggccggctgtgctcgccaa

SEQ ID NO: 34609 - DNA, 20 bp, human
ggcggcggtcccagcagcgg

SEQ ID NO: 34610 - DNA, 20 bp, human
ggaggtctgctgctagagcg

SEQ ID NO: 34611 - DNA, 20 bp, human
gctagagcggggtcggagaa

SEQ ID NO: 34612 - DNA, 20 bp, human
gaagggagacgaaaaggaca

SEQ ID NO: 34613 - DNA, 20 bp, human
gaggaagggaggtctaaggt

SEQ ID NO: 34614 - DNA, 20 bp, human
gctctagcagcagacctcct

SEQ ID NO: 34615 - DNA, 20 bp, human
gtcaacccacagaccccagg

SEQ ID NO: 34616 - DNA, 20 bp, human
gacagggcgcagctccccct

SEQ ID NO: 34617 - DNA, 20 bp, human
gggtgggacatgccaatcac

SEQ ID NO: 34618 - DNA, 20 bp, human
gacgccgcaggcccccaggg

SEQ ID NO: 34619 - DNA, 20 bp, human
gctctcccgctgccagcaca

SEQ ID NO: 34620 - DNA, 20 bp, human
ggagaggcacagccagtgat

SEQ ID NO: 34621 - DNA, 20 bp, human
ggagacgccgcaggccccca

SEQ ID NO: 34622 - DNA, 20 bp, human
gctgcactaaggtagagggt

SEQ ID NO: 34623 - DNA, 20 bp, human
gggggagctgcgccctgtgc

SEQ ID NO: 34624 - DNA, 20 bp, human
gctccagggacccaaacacc

SEQ ID NO: 34625 - DNA, 20 bp, human
gctgaggcccagaagggatt

SEQ ID NO: 34626 - DNA, 20 bp, human
gcaagtggctgagacgagtg

SEQ ID NO: 34627 - DNA, 20 bp, human
gcgggagagaaccgacccca

SEQ ID NO: 34628 - DNA, 20 bp, human
gacctgttcgtggtttagac

SEQ ID NO: 34629 - DNA, 20 bp, human
gtgctgtactaaaggcgcca

SEQ ID NO: 34630 - DNA, 20 bp, human
gcgccagggcgcaaagacct

SEQ ID NO: 34631 - DNA, 20 bp, human
ggtgccagggcccttggagt

SEQ ID NO: 34632 - DNA, 20 bp, human
gctccacgccaaaccactaa

SEQ ID NO: 34633 - DNA, 20 bp, human
gtgatgccgagacactgtag

SEQ ID NO: 34634 - DNA, 20 bp, human
ggctggcctcggactctaag

SEQ ID NO: 34635 - DNA, 20 bp, human
gccccaagccggaggctcag

SEQ ID NO: 34636 - DNA, 20 bp, human
ggacacggcctacccacccc

SEQ ID NO: 34637 - DNA, 20 bp, human
gcacctgtcaatggcagctc

SEQ ID NO: 34638 - DNA, 20 bp, human
gtggccatgttggttgccag

SEQ ID NO: 34639 - DNA, 20 bp, human
gccacccctggcaaccaaca

SEQ ID NO: 34640 - DNA, 20 bp, human
gtggctggccctggactacg

SEQ ID NO: 34641 - DNA, 20 bp, human
gccaggcagcagcaatcatg

SEQ ID NO: 34642 - DNA, 20 bp, human
ggcccggcgcaccaccaaga

SEQ ID NO: 34643 - DNA, 20 bp, human
gggtgtgaagttggccatgt

SEQ ID NO: 34644 - DNA, 20 bp, human
gcttggtgacgcagaagtag

SEQ ID NO: 34645 - DNA, 20 bp, human
ggggtaggccgtgtctgggg

SEQ ID NO: 34646 - DNA, 20 bp, human
gtataaaattaaatcttacc

SEQ ID NO: 34647 - DNA, 20 bp, human
gtaggattatagaaccagaa

SEQ ID NO: 34648 - DNA, 20 bp, human
gcattagttaggatagtatg

SEQ ID NO: 34649 - DNA, 20 bp, human
gtctggacggtgagcgtact

SEQ ID NO: 34650 - DNA, 20 bp, human
gaactgctgttaccagataa

SEQ ID NO: 34651 - DNA, 20 bp, human
ggctttatcatgtctctgga

SEQ ID NO: 34652 - DNA, 20 bp, human
gtacggctttatcatgtctc

SEQ ID NO: 34653 - DNA, 20 bp, human
gggtgagttttgcctttatc

SEQ ID NO: 34654 - DNA, 20 bp, human
gatgaagactccatttggat

SEQ ID NO: 34655 - DNA, 20 bp, human
ggggttacaaaagcatgagg

SEQ ID NO: 34656 - DNA, 20 bp, human
gccggagcttgtgtggacca

SEQ ID NO: 34657 - DNA, 20 bp, human
ggagtgccagtgagaagcac

SEQ ID NO: 34658 - DNA, 20 bp, human
gtgggctaccggagcttgtg

SEQ ID NO: 34659 - DNA, 20 bp, human
gggatcatggtagtgtccgg

SEQ ID NO: 34660 - DNA, 20 bp, human
ggtggtccaggtcctacaaa

SEQ ID NO: 34661 - DNA, 20 bp, human
gaatggtgccgagtgttcag

SEQ ID NO: 34662 - DNA, 20 bp, human
gacaggccaccactctgccc

SEQ ID NO: 34663 - DNA, 20 bp, human
gtgacagagcagcccctggt

SEQ ID NO: 34664 - DNA, 20 bp, human
gtctcactggcactctggct

SEQ ID NO: 34665 - DNA, 20 bp, human
gtgggtgcttgtctgctgga

SEQ ID NO: 34666 - DNA, 20 bp, human
gcctggcactgcaagagcgg

SEQ ID NO: 34667 - DNA, 20 bp, human
gggcctcctggccagaccta

SEQ ID NO: 34668 - DNA, 20 bp, human
gcggggagcttccagagaca

SEQ ID NO: 34669 - DNA, 20 bp, human
gggccctggcactgcaagag

SEQ ID NO: 34670 - DNA, 20 bp, human
gccagctggcaaggatggtg

SEQ ID NO: 34671 - DNA, 20 bp, human
gccagacctagggcaaaatt

SEQ ID NO: 34672 - DNA, 20 bp, human
gtggtggctccggagcccca

SEQ ID NO: 34673 - DNA, 20 bp, human
gagggctgggaaaatcagag

SEQ ID NO: 34674 - DNA, 20 bp, human
ggcttaaaagcgtggtcctg

SEQ ID NO: 34675 - DNA, 20 bp, human
gtaagcatgcacatctgacc

SEQ ID NO: 34676 - DNA, 20 bp, human
gctgtaaccacaggtaagaa

SEQ ID NO: 34677 - DNA, 20 bp, human
gagcctggcttggagattct

SEQ ID NO: 34678 - DNA, 20 bp, human
gccaaggcttatgttgaggg

SEQ ID NO: 34679 - DNA, 20 bp, human
gaacagaggctgaagagtga

SEQ ID NO: 34680 - DNA, 20 bp, human
gagcagaagacttacatgag

SEQ ID NO: 34681 - DNA, 20 bp, human
gtgggtacctttcttacctg

SEQ ID NO: 34682 - DNA, 20 bp, human
gtgcaggtgaaacccaagcc

SEQ ID NO: 34683 - DNA, 20 bp, human
gagtcaccccagaaatagag

SEQ ID NO: 34684 - DNA, 20 bp, human
ggtttctgggtactcaggag

SEQ ID NO: 34685 - DNA, 20 bp, human
ggtaagtcttctgctcgacg

SEQ ID NO: 34686 - DNA, 20 bp, human
gggtcccagtccccagcgcc

SEQ ID NO: 34687 - DNA, 20 bp, human
gtgtcctcccgcgggtccga

SEQ ID NO: 34688 - DNA, 20 bp, human
gcagcccggccaccagccat

SEQ ID NO: 34689 - DNA, 20 bp, human
gggtgggaggtgagccgaaa

SEQ ID NO: 34690 - DNA, 20 bp, human
gcccggcggcgacttgggtg

SEQ ID NO: 34691 - DNA, 20 bp, human
ggcctggcgcagcttcactc

SEQ ID NO: 34692 - DNA, 20 bp, human
gcccagacctggagccgtgc

SEQ ID NO: 34693 - DNA, 20 bp, human
ggcgccctcggacccgcggg

SEQ ID NO: 34694 - DNA, 20 bp, human
gtccagcccggcggcgactt

SEQ ID NO: 34695 - DNA, 20 bp, human
gtgcgcgggttccgagtccc

SEQ ID NO: 34696 - DNA, 20 bp, human
ggaagacgaaccgggcccgg

SEQ ID NO: 34697 - DNA, 20 bp, human
gccacaggagaagacgaacc

SEQ ID NO: 34698 - DNA, 20 bp, human
ggcgcgggaggcatgaagtt

SEQ ID NO: 34699 - DNA, 20 bp, human
ggcgcgcacgggcctcgaag

SEQ ID NO: 34700 - DNA, 20 bp, human
gtgaccgccggcgaatgcgg

SEQ ID NO: 34701 - DNA, 20 bp, human
gtctcctgtggggcgcggtg

SEQ ID NO: 34702 - DNA, 20 bp, human
gggtgcgagcgcagcctgtg

SEQ ID NO: 34703 - DNA, 20 bp, human
gtcctgcgcggtaagttacg

SEQ ID NO: 34704 - DNA, 20 bp, human
gcgaggagggagttgaccgc

SEQ ID NO: 34705 - DNA, 20 bp, human
gagttgaccgccggcgaatg

SEQ ID NO: 34706 - DNA, 20 bp, human
ggagtcgtgagacaaaacga

SEQ ID NO: 34707 - DNA, 20 bp, human
gtaggctgaggctgctgtcc

SEQ ID NO: 34708 - DNA, 20 bp, human
ggctgaggctgctgtcccgg

SEQ ID NO: 34709 - DNA, 20 bp, human
ggctgtcccggcgggagctg

SEQ ID NO: 34710 - DNA, 20 bp, human
gtcagcctagcagcttctgg

SEQ ID NO: 34711 - DNA, 20 bp, human
gtgcagagaaagggctactt

SEQ ID NO: 34712 - DNA, 20 bp, human
gcgagggcagacgcagcaga

SEQ ID NO: 34713 - DNA, 20 bp, human
gccgcgccacagctcccgcc

SEQ ID NO: 34714 - DNA, 20 bp, human
ggcctcagcctagcagcttc

SEQ ID NO: 34715 - DNA, 20 bp, human
gcgcgcagagaggtaagccc

SEQ ID NO: 34716 - DNA, 20 bp, human
gagactgaggcagacatgaa

SEQ ID NO: 34717 - DNA, 20 bp, human
gttaccaggatcagagactg

SEQ ID NO: 34718 - DNA, 20 bp, human
gtaattagcagttgtaacag

SEQ ID NO: 34719 - DNA, 20 bp, human
gttagcagttgtaacagtgg

SEQ ID NO: 34720 - DNA, 20 bp, human
gacatccccgggacttcaca

SEQ ID NO: 34721 - DNA, 20 bp, human
gaaatctgaggggtagggtg

SEQ ID NO: 34722 - DNA, 20 bp, human
gaaccatgctgaccagcaag

SEQ ID NO: 34723 - DNA, 20 bp, human
gaataaccgtgtgaagtccc

SEQ ID NO: 34724 - DNA, 20 bp, human
gagacacacacggattgcag

SEQ ID NO: 34725 - DNA, 20 bp, human
gggggcagggattccttcat

SEQ ID NO: 34726 - DNA, 20 bp, human
gtggccacgggcctctccaa

SEQ ID NO: 34727 - DNA, 20 bp, human
gcctgcaaggcgagttccag

SEQ ID NO: 34728 - DNA, 20 bp, human
ggccggcgcgctccacgtct

SEQ ID NO: 34729 - DNA, 20 bp, human
gacttaaggagagaagaccc

SEQ ID NO: 34730 - DNA, 20 bp, human
gccaggcgcggggcgcacag

SEQ ID NO: 34731 - DNA, 20 bp, human
gtaaaggcgcgcgagccgag

SEQ ID NO: 34732 - DNA, 20 bp, human
gcgccttgcagggacactta

SEQ ID NO: 34733 - DNA, 20 bp, human
ggaactacaatcccttggag

SEQ ID NO: 34734 - DNA, 20 bp, human
gcactcctccgtgggatccc

SEQ ID NO: 34735 - DNA, 20 bp, human
ggccgagacgtggagcgcgc

SEQ ID NO: 34736 - DNA, 20 bp, human
gcataaggctgcagcggtgt

SEQ ID NO: 34737 - DNA, 20 bp, human
ggacaaacaacacaagactg

SEQ ID NO: 34738 - DNA, 20 bp, human
gccttatggcgggagagctc

SEQ ID NO: 34739 - DNA, 20 bp, human
ggccccagatgagacaagat

SEQ ID NO: 34740 - DNA, 20 bp, human
gttccagactgagaggtgag

SEQ ID NO: 34741 - DNA, 20 bp, human
gcttccccctatgaatacaa

SEQ ID NO: 34742 - DNA, 20 bp, human
gatgggggatggcccaacac

SEQ ID NO: 34743 - DNA, 20 bp, human
gtacaaaggatctgggcaca

SEQ ID NO: 34744 - DNA, 20 bp, human
gcctatgaatacaaaggatc

SEQ ID NO: 34745 - DNA, 20 bp, human
ggatggcccaacactggcga

SEQ ID NO: 34746 - DNA, 20 bp, human
gcgccaggctatgaccccag

SEQ ID NO: 34747 - DNA, 20 bp, human
gcctgtgctggcggtcccag

SEQ ID NO: 34748 - DNA, 20 bp, human
ggcaaggccggaccagggac

SEQ ID NO: 34749 - DNA, 20 bp, human
gacgggcctggagtagaact

SEQ ID NO: 34750 - DNA, 20 bp, human
gcggggcctgggacgagacc

SEQ ID NO: 34751 - DNA, 20 bp, human
gtcgatccaatcttcaccaa

SEQ ID NO: 34752 - DNA, 20 bp, human
gagcccctggggtcatagcc

SEQ ID NO: 34753 - DNA, 20 bp, human
ggtaagtgtaggccccgaag

SEQ ID NO: 34754 - DNA, 20 bp, human
ggaggtgggagaccgtgtca

SEQ ID NO: 34755 - DNA, 20 bp, human
gccccagcctgtccctggtc

SEQ ID NO: 34756 - DNA, 20 bp, human
gcgcctgctcataccaggat

SEQ ID NO: 34757 - DNA, 20 bp, human
gcctcgcagccggctccctg

SEQ ID NO: 34758 - DNA, 20 bp, human
gtgctctctgcagtcccggg

SEQ ID NO: 34759 - DNA, 20 bp, human
ggcacctgggaggctggact

SEQ ID NO: 34760 - DNA, 20 bp, human
ggaagggattccctagaggt

SEQ ID NO: 34761 - DNA, 20 bp, human
gggaagaagggattccctag

SEQ ID NO: 34762 - DNA, 20 bp, human
gacctgagcacagccggagg

SEQ ID NO: 34763 - DNA, 20 bp, human
gggcccaggaaccaccgcgg

SEQ ID NO: 34764 - DNA, 20 bp, human
gggcgcgctccagccggtgt

SEQ ID NO: 34765 - DNA, 20 bp, human
gtgcctatcctggtatgagc

SEQ ID NO: 34766 - DNA, 20 bp, human
ggcggcacactcggcgagag

SEQ ID NO: 34767 - DNA, 20 bp, human
gatccgaagtggaacccaag

SEQ ID NO: 34768 - DNA, 20 bp, human
gtgaagtgcactttgagaag

SEQ ID NO: 34769 - DNA, 20 bp, human
gacctgaggaagggatgcca

SEQ ID NO: 34770 - DNA, 20 bp, human
gagcagaggaggcaaaacta

SEQ ID NO: 34771 - DNA, 20 bp, human
gaggggttcaaaatccgaag

SEQ ID NO: 34772 - DNA, 20 bp, human
gtgtgacttgtgcttacctg

SEQ ID NO: 34773 - DNA, 20 bp, human
ggcatttccactggaaaagg

SEQ ID NO: 34774 - DNA, 20 bp, human
gaagctcatagtgattcaga

SEQ ID NO: 34775 - DNA, 20 bp, human
gtgctggttctcatcgtcct

SEQ ID NO: 34776 - DNA, 20 bp, human
ggcagtgggctggatgacac

SEQ ID NO: 34777 - DNA, 20 bp, human
gtggcagcggctccgagaag

SEQ ID NO: 34778 - DNA, 20 bp, human
gccccgccagcaaacctcgg

SEQ ID NO: 34779 - DNA, 20 bp, human
gactcgaccgcgcggctcac

SEQ ID NO: 34780 - DNA, 20 bp, human
gcccacagcggagctcgcgg

SEQ ID NO: 34781 - DNA, 20 bp, human
ggccgccgcgagctccgctg

SEQ ID NO: 34782 - DNA, 20 bp, human
ggactgctggggatgacccg

SEQ ID NO: 34783 - DNA, 20 bp, human
ggattgtcccggccagatgg

SEQ ID NO: 34784 - DNA, 20 bp, human
ggtcgagtgagcgccggtcc

SEQ ID NO: 34785 - DNA, 20 bp, human
gcagcggctccgagaagagg

SEQ ID NO: 34786 - DNA, 20 bp, human
gacagccctgtagacaggag

SEQ ID NO: 34787 - DNA, 20 bp, human
gagatgcacgtcccagtcag

SEQ ID NO: 34788 - DNA, 20 bp, human
gcggcccgtggcacacaaag

SEQ ID NO: 34789 - DNA, 20 bp, human
gggggccagtgctgacactg

SEQ ID NO: 34790 - DNA, 20 bp, human
gcgaggaggagcggctgatc

SEQ ID NO: 34791 - DNA, 20 bp, human
gcccttaccacacaccgcca

SEQ ID NO: 34792 - DNA, 20 bp, human
gcaagagaagggctacaaca

SEQ ID NO: 34793 - DNA, 20 bp, human
gaccggagggcctctcacca

SEQ ID NO: 34794 - DNA, 20 bp, human
gcagaaggcggccccccaca

SEQ ID NO: 34795 - DNA, 20 bp, human
gttggagagtgtgagggcca

SEQ ID NO: 34796 - DNA, 20 bp, human
gcgtaccgagaagccccaag

SEQ ID NO: 34797 - DNA, 20 bp, human
gggcttctcggtacggacag

SEQ ID NO: 34798 - DNA, 20 bp, human
gtgatggtgacagtatcctc

SEQ ID NO: 34799 - DNA, 20 bp, human
gtggcttaagatgagggtgg

SEQ ID NO: 34800 - DNA, 20 bp, human
ggctctggcaggcttggagg

SEQ ID NO: 34801 - DNA, 20 bp, human
gtcctgctgcgtggttctca

SEQ ID NO: 34802 - DNA, 20 bp, human
ggtacggacaggggctagag

SEQ ID NO: 34803 - DNA, 20 bp, human
gagtgagatgagattcgtca

SEQ ID NO: 34804 - DNA, 20 bp, human
gccgcactggccggcttcct

SEQ ID NO: 34805 - DNA, 20 bp, human
ggatggcaagggctccgctt

SEQ ID NO: 34806 - DNA, 20 bp, human
gctatccccagcaggtccca

SEQ ID NO: 34807 - DNA, 20 bp, human
ggagctgaggcaccatgcat

SEQ ID NO: 34808 - DNA, 20 bp, human
gctggtaagccgcaggacgg

SEQ ID NO: 34809 - DNA, 20 bp, human
gctgcctgggtgggacacaa

SEQ ID NO: 34810 - DNA, 20 bp, human
gtaagccgcaggacggagga

SEQ ID NO: 34811 - DNA, 20 bp, human
ggacctgctggggatagcat

SEQ ID NO: 34812 - DNA, 20 bp, human
ggctccagccaccaagaggt

SEQ ID NO: 34813 - DNA, 20 bp, human
gacaacagctccaaggtctg

SEQ ID NO: 34814 - DNA, 20 bp, human
gctgggcccctgcaatagac

SEQ ID NO: 34815 - DNA, 20 bp, human
gtgacccctcctccgtcctg

SEQ ID NO: 34816 - DNA, 20 bp, human
gggctacagctccgagcgag

SEQ ID NO: 34817 - DNA, 20 bp, human
gctgactccagacccgagga

SEQ ID NO: 34818 - DNA, 20 bp, human
ggaccctgactccagacccg

SEQ ID NO: 34819 - DNA, 20 bp, human
gctgctgtccccgagcggag

SEQ ID NO: 34820 - DNA, 20 bp, human
gcgcgggcgggcgctccgag

SEQ ID NO: 34821 - DNA, 20 bp, human
gcggggacagcagctaccgg

SEQ ID NO: 34822 - DNA, 20 bp, human
gccgccgcagcagccgggag

SEQ ID NO: 34823 - DNA, 20 bp, human
ggcggggcccggccaatacc

SEQ ID NO: 34824 - DNA, 20 bp, human
gcgcgtccccgaccaggtat

SEQ ID NO: 34825 - DNA, 20 bp, human
ggcccggccaatacctggtc

SEQ ID NO: 34826 - DNA, 20 bp, human
gggcggcggcagcggaagta

SEQ ID NO: 34827 - DNA, 20 bp, human
gctactcccgcgaactaggg

SEQ ID NO: 34828 - DNA, 20 bp, human
gccgctactcccgcgaacta

SEQ ID NO: 34829 - DNA, 20 bp, human
ggtcctggcgagccacatcc

SEQ ID NO: 34830 - DNA, 20 bp, human
ggtcgggtcccgggatgtgg

SEQ ID NO: 34831 - DNA, 20 bp, human
ggacgagcgccgctccagta

SEQ ID NO: 34832 - DNA, 20 bp, human
ggacgcccggcgcgctagac

SEQ ID NO: 34833 - DNA, 20 bp, human
ggctttgggggccagaacgc

SEQ ID NO: 34834 - DNA, 20 bp, human
gcggaagtaaggaagacgcc

SEQ ID NO: 34835 - DNA, 20 bp, human
gcgagctcaccctactggag

SEQ ID NO: 34836 - DNA, 20 bp, human
ggagaagggagagggcccgt

SEQ ID NO: 34837 - DNA, 20 bp, human
gagcgctgctggaagtgatg

SEQ ID NO: 34838 - DNA, 20 bp, human
gcccggaatatatagatcgt

SEQ ID NO: 34839 - DNA, 20 bp, human
gggccgctgtggctgtccga

SEQ ID NO: 34840 - DNA, 20 bp, human
gcaaggctcagagggaggat

SEQ ID NO: 34841 - DNA, 20 bp, human
ggcgcgcttcccggacaccc

SEQ ID NO: 34842 - DNA, 20 bp, human
gcggccgccggcgggatcgg

SEQ ID NO: 34843 - DNA, 20 bp, human
ggtgtggaaggtgccggagt

SEQ ID NO: 34844 - DNA, 20 bp, human
gccgccggcgggatcggagg

SEQ ID NO: 34845 - DNA, 20 bp, human
ggaaggtgccggagttggtc

SEQ ID NO: 34846 - DNA, 20 bp, human
gcgactagcggaccccccag

SEQ ID NO: 34847 - DNA, 20 bp, human
gggtctggacgagaaatctg

SEQ ID NO: 34848 - DNA, 20 bp, human
gtggtcctacccctgccggg

SEQ ID NO: 34849 - DNA, 20 bp, human
gtcgcgagaagacgaccggt

SEQ ID NO: 34850 - DNA, 20 bp, human
gagaagacgaccggtaggag

SEQ ID NO: 34851 - DNA, 20 bp, human
gcagcactggccgagagaga

SEQ ID NO: 34852 - DNA, 20 bp, human
gaggggtaggaccaattccc

SEQ ID NO: 34853 - DNA, 20 bp, human
gcgacgagcggggctcagag

SEQ ID NO: 34854 - DNA, 20 bp, human
gtacccctgccgggcggcag

SEQ ID NO: 34855 - DNA, 20 bp, human
gagaggctgatgccgggcag

SEQ ID NO: 34856 - DNA, 20 bp, human
gagcgcggcgcccagacagg

SEQ ID NO: 34857 - DNA, 20 bp, human
gcagccaggaaggagacaac

SEQ ID NO: 34858 - DNA, 20 bp, human
gcagcagcgctcatgtccag

SEQ ID NO: 34859 - DNA, 20 bp, human
gagtggggaggtaactccgg

SEQ ID NO: 34860 - DNA, 20 bp, human
gctgaggaggcgggacacgg

SEQ ID NO: 34861 - DNA, 20 bp, human
gcagcccctgcgagtcgctg

SEQ ID NO: 34862 - DNA, 20 bp, human
ggggagtggggaggtaactc

SEQ ID NO: 34863 - DNA, 20 bp, human
ggcgcgcccggcacagcatg

SEQ ID NO: 34864 - DNA, 20 bp, human
ggaggacagtccgctggata

SEQ ID NO: 34865 - DNA, 20 bp, human
gggccggcgggcactcaccc

SEQ ID NO: 34866 - DNA, 20 bp, human
gcggtgatcgtggcctccag

SEQ ID NO: 34867 - DNA, 20 bp, human
gacagccctggcgcgtgtag

SEQ ID NO: 34868 - DNA, 20 bp, human
gccgcaaacatcagcatgga

SEQ ID NO: 34869 - DNA, 20 bp, human
ggacgtagcagtagaggaag

SEQ ID NO: 34870 - DNA, 20 bp, human
ggctgctgctcatgatcgag

SEQ ID NO: 34871 - DNA, 20 bp, human
gcttggggacgtagcagtag

SEQ ID NO: 34872 - DNA, 20 bp, human
ggtaggggtggccggctccc

SEQ ID NO: 34873 - DNA, 20 bp, human
gatgatcgagcggggcatcc

SEQ ID NO: 34874 - DNA, 20 bp, human
gggacgcggacttgcaagtg

SEQ ID NO: 34875 - DNA, 20 bp, human
ggcagtagaggaagcggtaa

SEQ ID NO: 34876 - DNA, 20 bp, human
gagttgccggcgcttcccgg

SEQ ID NO: 34877 - DNA, 20 bp, human
ggcagggcgggcgggaacgt

SEQ ID NO: 34878 - DNA, 20 bp, human
gtctctggccggccttggtg

SEQ ID NO: 34879 - DNA, 20 bp, human
gcgctcggctcgccgcacca

SEQ ID NO: 34880 - DNA, 20 bp, human
ggccaccgcgtcctatctcc

SEQ ID NO: 34881 - DNA, 20 bp, human
gcggctcgccgcaccaaggc

SEQ ID NO: 34882 - DNA, 20 bp, human
gcggcgcttcccggcggtgg

SEQ ID NO: 34883 - DNA, 20 bp, human
ggggcacccggacagcgacg

SEQ ID NO: 34884 - DNA, 20 bp, human
gtcggagccgcccgggtcct

SEQ ID NO: 34885 - DNA, 20 bp, human
gtcgggaggcggcgtgactc

SEQ ID NO: 34886 - DNA, 20 bp, human
gggagcgcggccaggaccaa

SEQ ID NO: 34887 - DNA, 20 bp, human
ggcctctagccccgcatcca

SEQ ID NO: 34888 - DNA, 20 bp, human
gcgcgggaagggttacccag

SEQ ID NO: 34889 - DNA, 20 bp, human
gaggcttcagcgatccccag

SEQ ID NO: 34890 - DNA, 20 bp, human
gatgcggggctagaggctcg

SEQ ID NO: 34891 - DNA, 20 bp, human
gcggagccgcagaggctccc

SEQ ID NO: 34892 - DNA, 20 bp, human
gttcagcgatccccagcggg

SEQ ID NO: 34893 - DNA, 20 bp, human
gggctgggcgtagggagtcc

SEQ ID NO: 34894 - DNA, 20 bp, human
gttgacgcgccctggatgcg

SEQ ID NO: 34895 - DNA, 20 bp, human
ggccctggatgcggggctag

SEQ ID NO: 34896 - DNA, 20 bp, human
gcgggtagcagcatcctcct

SEQ ID NO: 34897 - DNA, 20 bp, human
ggcccggcgtaaggggagtc

SEQ ID NO: 34898 - DNA, 20 bp, human
gttgcgggcgcccggcgtaa

SEQ ID NO: 34899 - DNA, 20 bp, human
gtgcggtcccgagaaagcgg

SEQ ID NO: 34900 - DNA, 20 bp, human
gcggaggccgaaagcgagag

SEQ ID NO: 34901 - DNA, 20 bp, human
ggactcagctcccggcatag

SEQ ID NO: 34902 - DNA, 20 bp, human
gcgccgccgccgcgcgaaag

SEQ ID NO: 34903 - DNA, 20 bp, human
gcgcgaaagcggcgcccagg

SEQ ID NO: 34904 - DNA, 20 bp, human
gtcgctcaggggaacgaagc

SEQ ID NO: 34905 - DNA, 20 bp, human
gcagcctccgactggaccaa

SEQ ID NO: 34906 - DNA, 20 bp, human
ggccaggcaggacctctcgc

SEQ ID NO: 34907 - DNA, 20 bp, human
gccggccgccgagactccac

SEQ ID NO: 34908 - DNA, 20 bp, human
gtagccggctcgggcctgag

SEQ ID NO: 34909 - DNA, 20 bp, human
gaggcgcgcgcgccagactt

SEQ ID NO: 34910 - DNA, 20 bp, human
ggccggtcggcacgctggaa

SEQ ID NO: 34911 - DNA, 20 bp, human
ggcgcgcgccagactttgga

SEQ ID NO: 34912 - DNA, 20 bp, human
ggcctgcgagaggtcctgcc

SEQ ID NO: 34913 - DNA, 20 bp, human
gccagctcggggaaaagccc

SEQ ID NO: 34914 - DNA, 20 bp, human
gtgcgcagcgagcctgcgag

SEQ ID NO: 34915 - DNA, 20 bp, human
ggccgtgtgcggggtatgag

SEQ ID NO: 34916 - DNA, 20 bp, human
ggagcctctcaaaagcagca

SEQ ID NO: 34917 - DNA, 20 bp, human
gcttccctgctgcttttgag

SEQ ID NO: 34918 - DNA, 20 bp, human
gaggagaaaagcgcatggcc

SEQ ID NO: 34919 - DNA, 20 bp, human
gaggaagccaagaggggagt

SEQ ID NO: 34920 - DNA, 20 bp, human
ggtggaagacaggaggtgca

SEQ ID NO: 34921 - DNA, 20 bp, human
gaggatctgaacgagtcagt

SEQ ID NO: 34922 - DNA, 20 bp, human
gtgagaggctcactgctagc

SEQ ID NO: 34923 - DNA, 20 bp, human
ggtcagaggagaaaagcgca

SEQ ID NO: 34924 - DNA, 20 bp, human
ggactcaccaactcccctct

SEQ ID NO: 34925 - DNA, 20 bp, human
ggagattacagtggcgaagg

SEQ ID NO: 34926 - DNA, 20 bp, human
gagtgtggggacacctccgg

SEQ ID NO: 34927 - DNA, 20 bp, human
gtccccacactcggttgggc

SEQ ID NO: 34928 - DNA, 20 bp, human
gtattaagggacacccagtg

SEQ ID NO: 34929 - DNA, 20 bp, human
gagggacacccagtgaggct

SEQ ID NO: 34930 - DNA, 20 bp, human
gtccaaaccagcgctagcag

SEQ ID NO: 34931 - DNA, 20 bp, human
gccgagtgtggggacacctc

SEQ ID NO: 34932 - DNA, 20 bp, human
gggcatggacgaagagtcgg

SEQ ID NO: 34933 - DNA, 20 bp, human
gcgggaatcctcactgcgca

SEQ ID NO: 34934 - DNA, 20 bp, human
gttggcgtgtctgccagagc

SEQ ID NO: 34935 - DNA, 20 bp, human
gacttgggtctcaaagggtg

SEQ ID NO: 34936 - DNA, 20 bp, human
gggctctgcccgagctgcag

SEQ ID NO: 34937 - DNA, 20 bp, human
gcgcccgagcgcacacaatg

SEQ ID NO: 34938 - DNA, 20 bp, human
gcgagctgcagcggcacggt

SEQ ID NO: 34939 - DNA, 20 bp, human
gcgtggctgcggtcccgagg

SEQ ID NO: 34940 - DNA, 20 bp, human
ggatgtccccacactcgggt

SEQ ID NO: 34941 - DNA, 20 bp, human
gctcgaggtagaacgaatgt

SEQ ID NO: 34942 - DNA, 20 bp, human
gaatgaggcgctttcagacg

SEQ ID NO: 34943 - DNA, 20 bp, human
gccccagccgacccgagtgt

SEQ ID NO: 34944 - DNA, 20 bp, human
gccacggcgctagctcccgc

SEQ ID NO: 34945 - DNA, 20 bp, human
ggcggtcccgaggtggccag

SEQ ID NO: 34946 - DNA, 20 bp, human
gggttcccaagcaacctcag

SEQ ID NO: 34947 - DNA, 20 bp, human
ggccgccgtccaatacggag

SEQ ID NO: 34948 - DNA, 20 bp, human
gcggggccgcgcatccacaa

SEQ ID NO: 34949 - DNA, 20 bp, human
gcgcgggccgccgaggaagg

SEQ ID NO: 34950 - DNA, 20 bp, human
gtgctcctcccggcgcagag

SEQ ID NO: 34951 - DNA, 20 bp, human
ggggcgcgaaccagtctcct

SEQ ID NO: 34952 - DNA, 20 bp, human
ggaggccacaggagcggacc

SEQ ID NO: 34953 - DNA, 20 bp, human
gtcgcggccgccgtccaata

SEQ ID NO: 34954 - DNA, 20 bp, human
gccacaaggggaaacttgga

SEQ ID NO: 34955 - DNA, 20 bp, human
ggcggccgcgacggggacaa

SEQ ID NO: 34956 - DNA, 20 bp, human
gatccggcagtgctgcgggg

SEQ ID NO: 34957 - DNA, 20 bp, human
gccggcgcgcaagccggatc

SEQ ID NO: 34958 - DNA, 20 bp, human
gtggcgagcggtgcagtccg

SEQ ID NO: 34959 - DNA, 20 bp, human
gcggatccggcagtgctgcg

SEQ ID NO: 34960 - DNA, 20 bp, human
gacttcgctgggagccttcc

SEQ ID NO: 34961 - DNA, 20 bp, human
ggcctgcgcgccccaagcag

SEQ ID NO: 34962 - DNA, 20 bp, human
gtgcagtccggggcccgctc

SEQ ID NO: 34963 - DNA, 20 bp, human
ggggagtccgaagctgcggg

SEQ ID NO: 34964 - DNA, 20 bp, human
ggtccgggagcggttctccg

SEQ ID NO: 34965 - DNA, 20 bp, human
gggaacccagtgcgatctgt

SEQ ID NO: 34966 - DNA, 20 bp, human
ggccgtgaggtggctgagag

SEQ ID NO: 34967 - DNA, 20 bp, human
gcgcactcctggcagccgtg

SEQ ID NO: 34968 - DNA, 20 bp, human
gcactgaagtgaagggaagt

SEQ ID NO: 34969 - DNA, 20 bp, human
gagcggggacagctcggagt

SEQ ID NO: 34970 - DNA, 20 bp, human
gagtccagggtgccccgccg

SEQ ID NO: 34971 - DNA, 20 bp, human
ggccgggagcgggctctggt

SEQ ID NO: 34972 - DNA, 20 bp, human
gggggatcctgactttgagg

SEQ ID NO: 34973 - DNA, 20 bp, human
gcggagtcgggcgctcaccc

SEQ ID NO: 34974 - DNA, 20 bp, human
ggttggaatactggaggtag

SEQ ID NO: 34975 - DNA, 20 bp, human
gccgcgaggtaaccgcgctg

SEQ ID NO: 34976 - DNA, 20 bp, human
gggcggcgccggctacgaag

SEQ ID NO: 34977 - DNA, 20 bp, human
ggcgccgtgcgtgacgtgag

SEQ ID NO: 34978 - DNA, 20 bp, human
gggaggatgtgcagctgcgg

SEQ ID NO: 34979 - DNA, 20 bp, human
ggcgccggctacgaagagga

SEQ ID NO: 34980 - DNA, 20 bp, human
gggcctcgcggcgctagggc

SEQ ID NO: 34981 - DNA, 20 bp, human
ggccgggcctcgcggcgcta

SEQ ID NO: 34982 - DNA, 20 bp, human
gtagggcgggctggcctccg

SEQ ID NO: 34983 - DNA, 20 bp, human
ggagcccctcacgtcacgca

SEQ ID NO: 34984 - DNA, 20 bp, human
gctacgaagaggacggggac

SEQ ID NO: 34985 - DNA, 20 bp, human
gtggctgggctcggttcgca

SEQ ID NO: 34986 - DNA, 20 bp, human
ggcgaccgtagtaggagcag

SEQ ID NO: 34987 - DNA, 20 bp, human
gtggctcatcgcccccaggg

SEQ ID NO: 34988 - DNA, 20 bp, human
gggagtgaaacttctcccgg

SEQ ID NO: 34989 - DNA, 20 bp, human
ggcagcagagcgaccgtagt

SEQ ID NO: 34990 - DNA, 20 bp, human
gaggcgcgccactgacaggg

SEQ ID NO: 34991 - DNA, 20 bp, human
gggggctccgagcaagggtc

SEQ ID NO: 34992 - DNA, 20 bp, human
gcccaggcgcgccactgaca

SEQ ID NO: 34993 - DNA, 20 bp, human
gtcctggctcatcgccccca

SEQ ID NO: 34994 - DNA, 20 bp, human
ggtgaaacttctcccggcgg

SEQ ID NO: 34995 - DNA, 20 bp, human
gccagccccagtcccgacca

SEQ ID NO: 34996 - DNA, 20 bp, human
gccgccccagccgcatctgt

SEQ ID NO: 34997 - DNA, 20 bp, human
ggacccggccggctgcaggt

SEQ ID NO: 34998 - DNA, 20 bp, human
gcggcgcgggaggttcggag

SEQ ID NO: 34999 - DNA, 20 bp, human
gctcgggctcgcggacggta

SEQ ID NO: 35000 - DNA, 20 bp, human
gaggttcggagcgggagctc

SEQ ID NO: 35001 - DNA, 20 bp, human
gatgccgccaacctaccgtg

SEQ ID NO: 35002 - DNA, 20 bp, human
gagacagcagatcccgccag

SEQ ID NO: 35003 - DNA, 20 bp, human
gtgggagaggagattgtcag

SEQ ID NO: 35004 - DNA, 20 bp, human
ggggctcgcggacggtatgg

SEQ ID NO: 35005 - DNA, 20 bp, human
gacagtggcgacctcgggga

SEQ ID NO: 35006 - DNA, 20 bp, human
gggcgagggccggaatctcg

SEQ ID NO: 35007 - DNA, 20 bp, human
gagcgggagaagggcggaaa

SEQ ID NO: 35008 - DNA, 20 bp, human
gcgcggctcggagagaagaa

SEQ ID NO: 35009 - DNA, 20 bp, human
gtgcgccaggagcacttccg

SEQ ID NO: 35010 - DNA, 20 bp, human
ggcggtgtggagacggaagg

SEQ ID NO: 35011 - DNA, 20 bp, human
gcccgcggcctgacctgcaa

SEQ ID NO: 35012 - DNA, 20 bp, human
gggaatctcgaggtacgtgc

SEQ ID NO: 35013 - DNA, 20 bp, human
ggcgggcggaggacggagaa

SEQ ID NO: 35014 - DNA, 20 bp, human
ggcgagggagcgggaagcta

SEQ ID NO: 35015 - DNA, 20 bp, human
gggaagccgagagacgagtg

SEQ ID NO: 35016 - DNA, 20 bp, human
gggcggccgctgcagacgaa

SEQ ID NO: 35017 - DNA, 20 bp, human
gaggcggagcccctgcgaag

SEQ ID NO: 35018 - DNA, 20 bp, human
gctggtggcgggattgatgg

SEQ ID NO: 35019 - DNA, 20 bp, human
ggggctgaactggaacctgg

SEQ ID NO: 35020 - DNA, 20 bp, human
gccgcctgccggagccgtgg

SEQ ID NO: 35021 - DNA, 20 bp, human
gctcccccgccccttcgcag

SEQ ID NO: 35022 - DNA, 20 bp, human
gagacaagcactggacgtgg

SEQ ID NO: 35023 - DNA, 20 bp, human
ggacgccagtgctcctcccg

SEQ ID NO: 35024 - DNA, 20 bp, human
gtagccggtcagacaagcac

SEQ ID NO: 35025 - DNA, 20 bp, human
ggccggcggacgcggaaagg

SEQ ID NO: 35026 - DNA, 20 bp, human
gaccggccttggaacaactg

SEQ ID NO: 35027 - DNA, 20 bp, human
gcgggggccgctccatgggg

SEQ ID NO: 35028 - DNA, 20 bp, human
ggagctgttgcggggaactt

SEQ ID NO: 35029 - DNA, 20 bp, human
gccccgggggccgctccatg

SEQ ID NO: 35030 - DNA, 20 bp, human
gggaacaactgtggaacctg

SEQ ID NO: 35031 - DNA, 20 bp, human
ggccctcccgccccatggag

SEQ ID NO: 35032 - DNA, 20 bp, human
gagcatcggcggcccggaac

SEQ ID NO: 35033 - DNA, 20 bp, human
gcgggagggcaagcggcctc

SEQ ID NO: 35034 - DNA, 20 bp, human
gaaagacgcgcgagcatcgg

SEQ ID NO: 35035 - DNA, 20 bp, human
gtgactgtcaggctgtgacc

SEQ ID NO: 35036 - DNA, 20 bp, human
ggcgatgtgtggcgactgtg

SEQ ID NO: 35037 - DNA, 20 bp, human
gcatcgcgacgcagtcaaca

SEQ ID NO: 35038 - DNA, 20 bp, human
gccgccagggcgggtaccag

SEQ ID NO: 35039 - DNA, 20 bp, human
gcccctccagcgctagaatt

SEQ ID NO: 35040 - DNA, 20 bp, human
gcccaaccgggtgagcgact

SEQ ID NO: 35041 - DNA, 20 bp, human
gggtcccggtgacccagtag

SEQ ID NO: 35042 - DNA, 20 bp, human
gcctcgcgagaactgagata

SEQ ID NO: 35043 - DNA, 20 bp, human
gttgactgcgtcgcgatgtg

SEQ ID NO: 35044 - DNA, 20 bp, human
gtcgagcttgaggatgagac

SEQ ID NO: 35045 - DNA, 20 bp, human
ggagaaggaatatcccaacc

SEQ ID NO: 35046 - DNA, 20 bp, human
ggcgatgtgtggcgactgtg

SEQ ID NO: 35047 - DNA, 20 bp, human
gcatcgcgacgcagtcaaca

SEQ ID NO: 35048 - DNA, 20 bp, human
gccgccagggcgggtaccag

SEQ ID NO: 35049 - DNA, 20 bp, human
gcccctccagcgctagaatt

SEQ ID NO: 35050 - DNA, 20 bp, human
gcccaaccgggtgagcgact

SEQ ID NO: 35051 - DNA, 20 bp, human
gttgactgcgtcgcgatgtg

SEQ ID NO: 35052 - DNA, 20 bp, human
gggtcccggtgacccagtag

SEQ ID NO: 35053 - DNA, 20 bp, human
ggagaaggaatatcccaacc

SEQ ID NO: 35054 - DNA, 20 bp, human
gcaactgaggtcagccgcca

SEQ ID NO: 35055 - DNA, 20 bp, human
ggagcgcccagtcgctcacc

SEQ ID NO: 35056 - DNA, 20 bp, human
gggccgcggaagcctggagt

SEQ ID NO: 35057 - DNA, 20 bp, human
gtcatgtcggcccgacgcag

SEQ ID NO: 35058 - DNA, 20 bp, human
ggtcggcccgacgcaggggg

SEQ ID NO: 35059 - DNA, 20 bp, human
gggaattgtgttagctgcag

SEQ ID NO: 35060 - DNA, 20 bp, human
ggaaccagcagcgggagtcc

SEQ ID NO: 35061 - DNA, 20 bp, human
gaccggagaatccgcatctg

SEQ ID NO: 35062 - DNA, 20 bp, human
gttcctggcggagggagagt

SEQ ID NO: 35063 - DNA, 20 bp, human
gggcggtacgcagacgcgcg

SEQ ID NO: 35064 - DNA, 20 bp, human
ggaagtctgcgactgttggg

SEQ ID NO: 35065 - DNA, 20 bp, human
gaggctgaacctgttcctgg

SEQ ID NO: 35066 - DNA, 20 bp, human
ggcgcaaggcgtggagtcga

SEQ ID NO: 35067 - DNA, 20 bp, human
gcccagggaccaaaacgtca

SEQ ID NO: 35068 - DNA, 20 bp, human
ggcggcaggtgagagtggtg

SEQ ID NO: 35069 - DNA, 20 bp, human
gggcccaaggtcacaacgat

SEQ ID NO: 35070 - DNA, 20 bp, human
gattggctactggtaggacc

SEQ ID NO: 35071 - DNA, 20 bp, human
gccactctcacctgccgcct

SEQ ID NO: 35072 - DNA, 20 bp, human
ggggacagttgagggagctc

SEQ ID NO: 35073 - DNA, 20 bp, human
gtcgcgagaggcgcaaggcg

SEQ ID NO: 35074 - DNA, 20 bp, human
gaaggcgtggagtcgacggc

SEQ ID NO: 35075 - DNA, 20 bp, human
ggccggccctaacctccctg

SEQ ID NO: 35076 - DNA, 20 bp, human
gtctgcgtctcgaggcgagt

SEQ ID NO: 35077 - DNA, 20 bp, human
gcagtgacgcggcccaaggg

SEQ ID NO: 35078 - DNA, 20 bp, human
gaggccgggagacctagccc

SEQ ID NO: 35079 - DNA, 20 bp, human
ggcgtctcgaggcgagttgg

SEQ ID NO: 35080 - DNA, 20 bp, human
gacgctggggcctcaggcga

SEQ ID NO: 35081 - DNA, 20 bp, human
gtactcggccagcagctcct

SEQ ID NO: 35082 - DNA, 20 bp, human
gcgtcaggaacgtcaagtcc

SEQ ID NO: 35083 - DNA, 20 bp, human
ggcggggcgatggggggctc

SEQ ID NO: 35084 - DNA, 20 bp, human
gctggggcctcaggcgaggg

SEQ ID NO: 35085 - DNA, 20 bp, human
gtcgggcagtcgcctgtcca

SEQ ID NO: 35086 - DNA, 20 bp, human
gcccgcagctcgcctggagg

SEQ ID NO: 35087 - DNA, 20 bp, human
gcgccccgcagctcgcctgg

SEQ ID NO: 35088 - DNA, 20 bp, human
gcggcgcggcggccaccatg

SEQ ID NO: 35089 - DNA, 20 bp, human
gggaagggtccggccaccgt

SEQ ID NO: 35090 - DNA, 20 bp, human
ggggctccgactcccatcag

SEQ ID NO: 35091 - DNA, 20 bp, human
gcagcgaccgagaaaaggga

SEQ ID NO: 35092 - DNA, 20 bp, human
gaggtcacgcgtcgagctga

SEQ ID NO: 35093 - DNA, 20 bp, human
ggcctcctccaggcgagctg

SEQ ID NO: 35094 - DNA, 20 bp, human
ggagcagctagacaactacc

SEQ ID NO: 35095 - DNA, 20 bp, human
gctgcggggcgggaagggtc

SEQ ID NO: 35096 - DNA, 20 bp, human
gaagcgtatcaggtagaggg

SEQ ID NO: 35097 - DNA, 20 bp, human
gacttggggatgcaccccaa

SEQ ID NO: 35098 - DNA, 20 bp, human
gggacggtacacccagatga

SEQ ID NO: 35099 - DNA, 20 bp, human
ggaaccacagcccagacttg

SEQ ID NO: 35100 - DNA, 20 bp, human
gggggtgcatccccaagtct

SEQ ID NO: 35101 - DNA, 20 bp, human
gagatcatgaggtcagtcca

SEQ ID NO: 35102 - DNA, 20 bp, human
gtcatgaggtcagtccaggg

SEQ ID NO: 35103 - DNA, 20 bp, human
gctggaagcgtatcaggtag

SEQ ID NO: 35104 - DNA, 20 bp, human
gcatccccaagtctgggctg

SEQ ID NO: 35105 - DNA, 20 bp, human
ggtgtggccccgaggaagct

SEQ ID NO: 35106 - DNA, 20 bp, human
gctactgctggcagacagaa

SEQ ID NO: 35107 - DNA, 20 bp, human
ggctggcagacagaaaggtg

SEQ ID NO: 35108 - DNA, 20 bp, human
gagtaccaggtgggtagatc

SEQ ID NO: 35109 - DNA, 20 bp, human
gacctggaagagtaccaggt

SEQ ID NO: 35110 - DNA, 20 bp, human
gagatcgggctagggactct

SEQ ID NO: 35111 - DNA, 20 bp, human
ggaggctgaggttctactgc

SEQ ID NO: 35112 - DNA, 20 bp, human
gctcaaggactcgccagctg

SEQ ID NO: 35113 - DNA, 20 bp, human
gagatctcatctgggccaca

SEQ ID NO: 35114 - DNA, 20 bp, human
ggaaaggtgtggttggcatg

SEQ ID NO: 35115 - DNA, 20 bp, human
gctagcccgatctacccacc

SEQ ID NO: 35116 - DNA, 20 bp, human
gggggccgggcttgcgcgga

SEQ ID NO: 35117 - DNA, 20 bp, human
gcggcagagacccccgcgtg

SEQ ID NO: 35118 - DNA, 20 bp, human
gcgctggacgcgggcatcag

SEQ ID NO: 35119 - DNA, 20 bp, human
ggcagagtaaagggatgacg

SEQ ID NO: 35120 - DNA, 20 bp, human
gcgggccgagtggttagtga

SEQ ID NO: 35121 - DNA, 20 bp, human
gcccctccggccgccccacg

SEQ ID NO: 35122 - DNA, 20 bp, human
ggctaagtgcggagtaacgg

SEQ ID NO: 35123 - DNA, 20 bp, human
gccgagtggttagtgatggc

SEQ ID NO: 35124 - DNA, 20 bp, human
ggcggagtggggcgtatctg

SEQ ID NO: 35125 - DNA, 20 bp, human
gggtgctaagtgcggagtaa

SEQ ID NO: 35126 - DNA, 20 bp, human
gcggggcactcgcctgatga

SEQ ID NO: 35127 - DNA, 20 bp, human
gagacctccaggcccgctag

SEQ ID NO: 35128 - DNA, 20 bp, human
gggaagcgcacggcaatcag

SEQ ID NO: 35129 - DNA, 20 bp, human
gcagtcgcgggcgcagaaga

SEQ ID NO: 35130 - DNA, 20 bp, human
ggctcctgcatagtcccggg

SEQ ID NO: 35131 - DNA, 20 bp, human
ggcgcccgcgactgcagcag

SEQ ID NO: 35132 - DNA, 20 bp, human
gcatggcgcggatcccctag

SEQ ID NO: 35133 - DNA, 20 bp, human
gctatgcaggagccctcatc

SEQ ID NO: 35134 - DNA, 20 bp, human
gcggcaatcagggggacgcg

SEQ ID NO: 35135 - DNA, 20 bp, human
gaggccgcccgggactatgc

SEQ ID NO: 35136 - DNA, 20 bp, human
ggctgagaggtactccatgg

SEQ ID NO: 35137 - DNA, 20 bp, human
ggaccggagagttccttccc

SEQ ID NO: 35138 - DNA, 20 bp, human
ggtggttctctcctgtgctg

SEQ ID NO: 35139 - DNA, 20 bp, human
ggagcttgacaagcccactg

SEQ ID NO: 35140 - DNA, 20 bp, human
gtgtcctgggctgagatccc

SEQ ID NO: 35141 - DNA, 20 bp, human
gggaactctccggtccacca

SEQ ID NO: 35142 - DNA, 20 bp, human
gagacacggaaaggtcgctg

SEQ ID NO: 35143 - DNA, 20 bp, human
gtagagtggctagagggcta

SEQ ID NO: 35144 - DNA, 20 bp, human
ggtcaagaaggggcgaggag

SEQ ID NO: 35145 - DNA, 20 bp, human
gcacggaaaggtcgctgggg

SEQ ID NO: 35146 - DNA, 20 bp, human
gggggcccagagcaagccga

SEQ ID NO: 35147 - DNA, 20 bp, human
gacgccagcgtgctgctcac

SEQ ID NO: 35148 - DNA, 20 bp, human
gtcgccaaggccccttccgg

SEQ ID NO: 35149 - DNA, 20 bp, human
gaagccgaaggcaagcacga

SEQ ID NO: 35150 - DNA, 20 bp, human
ggcatacgcggtccctccac

SEQ ID NO: 35151 - DNA, 20 bp, human
ggccgggacggcgagcaaca

SEQ ID NO: 35152 - DNA, 20 bp, human
ggaaggttgactgcgtggta

SEQ ID NO: 35153 - DNA, 20 bp, human
gggccaggcgggctgcaagg

SEQ ID NO: 35154 - DNA, 20 bp, human
gctgcagaaggttgactgcg

SEQ ID NO: 35155 - DNA, 20 bp, human
ggtcgcagcgctggctccac

SEQ ID NO: 35156 - DNA, 20 bp, human
gaggctgtgagggggaggta

SEQ ID NO: 35157 - DNA, 20 bp, human
gacagcagaaacagacccag

SEQ ID NO: 35158 - DNA, 20 bp, human
ggaagctcccggcacaggta

SEQ ID NO: 35159 - DNA, 20 bp, human
ggaataggaagaggacctca

SEQ ID NO: 35160 - DNA, 20 bp, human
gtgtgccgggagcttcgaat

SEQ ID NO: 35161 - DNA, 20 bp, human
ggagcaggttaggtagctct

SEQ ID NO: 35162 - DNA, 20 bp, human
gcctagccaagggtgcctct

SEQ ID NO: 35163 - DNA, 20 bp, human
gcgcagagcaaggggcacaa

SEQ ID NO: 35164 - DNA, 20 bp, human
ggggacagggcagtatttcc

SEQ ID NO: 35165 - DNA, 20 bp, human
gtagggcttcgcagagcaag

SEQ ID NO: 35166 - DNA, 20 bp, human
gtccaggtgaggaaagtcat

SEQ ID NO: 35167 - DNA, 20 bp, human
ggttctggcttacagctcat

SEQ ID NO: 35168 - DNA, 20 bp, human
gctggcttacagctcatagg

SEQ ID NO: 35169 - DNA, 20 bp, human
gtgagcctgagcacccggtg

SEQ ID NO: 35170 - DNA, 20 bp, human
ggagttgggatagaagaata

SEQ ID NO: 35171 - DNA, 20 bp, human
gatgggtatacaggtcacag

SEQ ID NO: 35172 - DNA, 20 bp, human
ggaggaaggttgctgaacag

SEQ ID NO: 35173 - DNA, 20 bp, human
gttgggatagaagaataggg

SEQ ID NO: 35174 - DNA, 20 bp, human
gctctccccaccgggtgctc

SEQ ID NO: 35175 - DNA, 20 bp, human
gatgagaaacatggagtgag

SEQ ID NO: 35176 - DNA, 20 bp, human
gttctgagctgggcatccga

SEQ ID NO: 35177 - DNA, 20 bp, human
gacctgaagtctccctccgg

SEQ ID NO: 35178 - DNA, 20 bp, human
gggcatccgaaggcatcctt

SEQ ID NO: 35179 - DNA, 20 bp, human
gggaagctgagggcacgagg

SEQ ID NO: 35180 - DNA, 20 bp, human
gggctgtgtgcttctgagct

SEQ ID NO: 35181 - DNA, 20 bp, human
gagcttggcgggctcccaac

SEQ ID NO: 35182 - DNA, 20 bp, human
gaccatgtatcagcaccgaa

SEQ ID NO: 35183 - DNA, 20 bp, human
gctgacctgaagtctccctc

SEQ ID NO: 35184 - DNA, 20 bp, human
gtccaccggagggagacttc

SEQ ID NO: 35185 - DNA, 20 bp, human
gggcgagaagaccttgctgt

SEQ ID NO: 35186 - DNA, 20 bp, human
gaggagtcctgctcaagaca

SEQ ID NO: 35187 - DNA, 20 bp, human
ggatgctgagaaacctctgt

SEQ ID NO: 35188 - DNA, 20 bp, human
ggcatatgctgaggaaacgg

SEQ ID NO: 35189 - DNA, 20 bp, human
gctgctccagggatgtctgg

SEQ ID NO: 35190 - DNA, 20 bp, human
ggcagttgagtccagcagtg

SEQ ID NO: 35191 - DNA, 20 bp, human
gatggcaagcctaaccatca

SEQ ID NO: 35192 - DNA, 20 bp, human
gaccatcagggcatatgctg

SEQ ID NO: 35193 - DNA, 20 bp, human
gcctaagtgggaccatctgg

SEQ ID NO: 35194 - DNA, 20 bp, human
gtgagcaggactcctcagct

SEQ ID NO: 35195 - DNA, 20 bp, human
gaagggaatggagtagtcag

SEQ ID NO: 35196 - DNA, 20 bp, human
ggcgtgctcgggtccaactc

SEQ ID NO: 35197 - DNA, 20 bp, human
ggccggggcagagcgtccga

SEQ ID NO: 35198 - DNA, 20 bp, human
gcggagcccggaccctccct

SEQ ID NO: 35199 - DNA, 20 bp, human
gcattgagtgttccagggat

SEQ ID NO: 35200 - DNA, 20 bp, human
ggttggacccgagcacgccg

SEQ ID NO: 35201 - DNA, 20 bp, human
gagcagcgacgccatggccg

SEQ ID NO: 35202 - DNA, 20 bp, human
gggccgctgggactgagagt

SEQ ID NO: 35203 - DNA, 20 bp, human
gctcccaccctggaccgaag

SEQ ID NO: 35204 - DNA, 20 bp, human
ggcgtgtgtgggagttaggt

SEQ ID NO: 35205 - DNA, 20 bp, human
gtgctcgggtccaactccgg

SEQ ID NO: 35206 - DNA, 20 bp, human
gtatctgtggaccttatgga

SEQ ID NO: 35207 - DNA, 20 bp, human
gtcggttcctttcccggggt

SEQ ID NO: 35208 - DNA, 20 bp, human
gggtccgcagcggggaacag

SEQ ID NO: 35209 - DNA, 20 bp, human
gagccaccccaccccgggaa

SEQ ID NO: 35210 - DNA, 20 bp, human
ggctcgccgcccgcagaatc

SEQ ID NO: 35211 - DNA, 20 bp, human
gtatggaaggtgcgtgagat

SEQ ID NO: 35212 - DNA, 20 bp, human
gggcttcgcgtctccttcta

SEQ ID NO: 35213 - DNA, 20 bp, human
gaccgcgggcgagggagacg

SEQ ID NO: 35214 - DNA, 20 bp, human
gtctcccgagcagctcgcag

SEQ ID NO: 35215 - DNA, 20 bp, human
gctccttctacggatatctg

SEQ ID NO: 35216 - DNA, 20 bp, human
gtgagtaaacagacccgggg

SEQ ID NO: 35217 - DNA, 20 bp, human
gagaagcggaggctgtccta

SEQ ID NO: 35218 - DNA, 20 bp, human
gactggaactagggaaagca

SEQ ID NO: 35219 - DNA, 20 bp, human
gtcagctgaaggaagtactg

SEQ ID NO: 35220 - DNA, 20 bp, human
gaaacgcagttccggttagg

SEQ ID NO: 35221 - DNA, 20 bp, human
gtggaaacgcagttccggtt

SEQ ID NO: 35222 - DNA, 20 bp, human
gtttaggcctagagaagcgg

SEQ ID NO: 35223 - DNA, 20 bp, human
gctgggaaggcggtccctgt

SEQ ID NO: 35224 - DNA, 20 bp, human
gctatcttaagtaaacgggg

SEQ ID NO: 35225 - DNA, 20 bp, human
gggggaacttccgagatcaa

SEQ ID NO: 35226 - DNA, 20 bp, human
ggggccctcaccactgagtc

SEQ ID NO: 35227 - DNA, 20 bp, human
gagggacctgcccgactcag

SEQ ID NO: 35228 - DNA, 20 bp, human
gtaggaggctcgggtcgttg

SEQ ID NO: 35229 - DNA, 20 bp, human
gctcgcgcgttaggaggctc

SEQ ID NO: 35230 - DNA, 20 bp, human
gtaacgcgcgagtgaggggg

SEQ ID NO: 35231 - DNA, 20 bp, human
ggctcggtaagcaaaagcgt

SEQ ID NO: 35232 - DNA, 20 bp, human
gccctcactcgcgcgttagg

SEQ ID NO: 35233 - DNA, 20 bp, human
gggcaggtccctgacgcaag

SEQ ID NO: 35234 - DNA, 20 bp, human
gcctcaccactgagtcgggc

SEQ ID NO: 35235 - DNA, 20 bp, human
ggccgagttcccggatggag

SEQ ID NO: 35236 - DNA, 20 bp, human
gagagaggcgagcaccggga

SEQ ID NO: 35237 - DNA, 20 bp, human
gtgcgccaggagcacttccg

SEQ ID NO: 35238 - DNA, 20 bp, human
gcgcggctcggagagaagaa

SEQ ID NO: 35239 - DNA, 20 bp, human
gcccttccccaactcaccag

SEQ ID NO: 35240 - DNA, 20 bp, human
gcaccgggaaggggagcgtg

SEQ ID NO: 35241 - DNA, 20 bp, human
gtcttgaggaagaaacgaca

SEQ ID NO: 35242 - DNA, 20 bp, human
ggggctactctgtagactcg

SEQ ID NO: 35243 - DNA, 20 bp, human
gctggccgagagtagagacc

SEQ ID NO: 35244 - DNA, 20 bp, human
ggcgagggagcgggaagcta

SEQ ID NO: 35245 - DNA, 20 bp, human
gtggggccgctggtgagttg

SEQ ID NO: 35246 - DNA, 20 bp, human
ggcgcggccggcgagagtaa

SEQ ID NO: 35247 - DNA, 20 bp, human
ggcgagagtaaaggtgccag

SEQ ID NO: 35248 - DNA, 20 bp, human
gtaggaccggcgggcgcgta

SEQ ID NO: 35249 - DNA, 20 bp, human
gcgcctgcgcggtagcatcg

SEQ ID NO: 35250 - DNA, 20 bp, human
gtagcctggaaaagaaggaa

SEQ ID NO: 35251 - DNA, 20 bp, human
gcgggccggacagcgaaagg

SEQ ID NO: 35252 - DNA, 20 bp, human
ggcgcggtcattaggtgtta

SEQ ID NO: 35253 - DNA, 20 bp, human
gggacatgaaagcgtcttag

SEQ ID NO: 35254 - DNA, 20 bp, human
gaggcgccgcggcgggtcgt

SEQ ID NO: 35255 - DNA, 20 bp, human
ggagctcaaacgggttcgcg

SEQ ID NO: 35256 - DNA, 20 bp, human
gagcttggccagagcggagg

SEQ ID NO: 35257 - DNA, 20 bp, human
gcgcggcagcttggccagag

SEQ ID NO: 35258 - DNA, 20 bp, human
gtggcgaacgtgcaaggatg

SEQ ID NO: 35259 - DNA, 20 bp, human
gcccgcgcgcagaggaaggt

SEQ ID NO: 35260 - DNA, 20 bp, human
gacgcctgtgaggcagtctc

SEQ ID NO: 35261 - DNA, 20 bp, human
gtccgctcccggcgcaggcg

SEQ ID NO: 35262 - DNA, 20 bp, human
gttgcacgttcgccaagcgg

SEQ ID NO: 35263 - DNA, 20 bp, human
gccgggtgcttgatgcccca

SEQ ID NO: 35264 - DNA, 20 bp, human
gtccgaggacaaaagaccct

SEQ ID NO: 35265 - DNA, 20 bp, human
gacgctctccagcaccatcc

SEQ ID NO: 35266 - DNA, 20 bp, human
gccaggcacggagatctcaa

SEQ ID NO: 35267 - DNA, 20 bp, human
gggcaggcatcacaagacgg

SEQ ID NO: 35268 - DNA, 20 bp, human
ggctgaggcaagccagacac

SEQ ID NO: 35269 - DNA, 20 bp, human
gagggcgggggtgctcaccc

SEQ ID NO: 35270 - DNA, 20 bp, human
gcaaggtacgcaagcatggc

SEQ ID NO: 35271 - DNA, 20 bp, human
gcatggcaggcatcacaaga

SEQ ID NO: 35272 - DNA, 20 bp, human
gcacgggaggccatctagga

SEQ ID NO: 35273 - DNA, 20 bp, human
gggtcttgtgcgaggaggag

SEQ ID NO: 35274 - DNA, 20 bp, human
gaggacacgggaggccatct

SEQ ID NO: 35275 - DNA, 20 bp, human
ggtgctggctgcggaggtcc

SEQ ID NO: 35276 - DNA, 20 bp, human
ggcggctggagggaaccagt

SEQ ID NO: 35277 - DNA, 20 bp, human
ggcgcaggacagggactgag

SEQ ID NO: 35278 - DNA, 20 bp, human
gcgtgctgggtaggctcccg

SEQ ID NO: 35279 - DNA, 20 bp, human
gggcgcgcgggcgcaggaca

SEQ ID NO: 35280 - DNA, 20 bp, human
gggctaaaggaggaactcac

SEQ ID NO: 35281 - DNA, 20 bp, human
gaaggaggaactcacagggt

SEQ ID NO: 35282 - DNA, 20 bp, human
gcgcggagcgcgtgctgggt

SEQ ID NO: 35283 - DNA, 20 bp, human
gtggggactcggctggacgg

SEQ ID NO: 35284 - DNA, 20 bp, human
gtgggcccagaagaatatct

SEQ ID NO: 35285 - DNA, 20 bp, human
gtagctgccgggcattggga

SEQ ID NO: 35286 - DNA, 20 bp, human
gcgttcctcgggttcaaacg

SEQ ID NO: 35287 - DNA, 20 bp, human
gggaacagatcgcagacctg

SEQ ID NO: 35288 - DNA, 20 bp, human
gtagccccggaagaccctcc

SEQ ID NO: 35289 - DNA, 20 bp, human
gtcctcgggttcaaacgcgg

SEQ ID NO: 35290 - DNA, 20 bp, human
gggaaccggccgactacact

SEQ ID NO: 35291 - DNA, 20 bp, human
gctcggctcccaaggaaggt

SEQ ID NO: 35292 - DNA, 20 bp, human
gtgcagttagtgctgacagg

SEQ ID NO: 35293 - DNA, 20 bp, human
gtgaatacgctgaaacagag

SEQ ID NO: 35294 - DNA, 20 bp, human
gaggcctggagggtcttccg

SEQ ID NO: 35295 - DNA, 20 bp, human
gtcacgctctgcgaaccccc

SEQ ID NO: 35296 - DNA, 20 bp, human
gcggttccgcggctccatct

SEQ ID NO: 35297 - DNA, 20 bp, human
ggagacctggctgcgaatcc

SEQ ID NO: 35298 - DNA, 20 bp, human
gcttcgcagagcaccggact

SEQ ID NO: 35299 - DNA, 20 bp, human
gtccctgcttcgcagagcac

SEQ ID NO: 35300 - DNA, 20 bp, human
gatctgggatgcggcgagga

SEQ ID NO: 35301 - DNA, 20 bp, human
ggccgtgcaagggatgctcc

SEQ ID NO: 35302 - DNA, 20 bp, human
ggcacgcgcccgccgtgcaa

SEQ ID NO: 35303 - DNA, 20 bp, human
gtgccgcgtcggatgctcag

SEQ ID NO: 35304 - DNA, 20 bp, human
gtccggtgctctgcgaagca

SEQ ID NO: 35305 - DNA, 20 bp, human
gccgcggcgagtccgcactc

SEQ ID NO: 35306 - DNA, 20 bp, human
gtcgccggcggactacaaga

SEQ ID NO: 35307 - DNA, 20 bp, human
gggcagagcgagcttcctct

SEQ ID NO: 35308 - DNA, 20 bp, human
gtcggcgccggactccgggg

SEQ ID NO: 35309 - DNA, 20 bp, human
gcggcggcaaagctgcagaa

SEQ ID NO: 35310 - DNA, 20 bp, human
gcgggcaccagctcggtcag

SEQ ID NO: 35311 - DNA, 20 bp, human
ggcttcggcgccggactccg

SEQ ID NO: 35312 - DNA, 20 bp, human
gcgaggggcagttctcggtg

SEQ ID NO: 35313 - DNA, 20 bp, human
gtcggctaggaatcccagga

SEQ ID NO: 35314 - DNA, 20 bp, human
ggcggcactgtgcggtgcag

SEQ ID NO: 35315 - DNA, 20 bp, human
ggctctccgggcggcaatgg

SEQ ID NO: 35316 - DNA, 20 bp, human
gagctgtgagggcaacggag

SEQ ID NO: 35317 - DNA, 20 bp, human
gcggtcctgccgagctgtga

SEQ ID NO: 35318 - DNA, 20 bp, human
gacagctcggcaggaccgcc

SEQ ID NO: 35319 - DNA, 20 bp, human
gagttcgcagcagggctacg

SEQ ID NO: 35320 - DNA, 20 bp, human
gccccgaagtggcctaataa

SEQ ID NO: 35321 - DNA, 20 bp, human
gtgggcgagcacatacacta

SEQ ID NO: 35322 - DNA, 20 bp, human
ggatgtgcaacaacaggatg

SEQ ID NO: 35323 - DNA, 20 bp, human
gattgttggcagctgccggg

SEQ ID NO: 35324 - DNA, 20 bp, human
gcgtccggctgtgttatgag

SEQ ID NO: 35325 - DNA, 20 bp, human
gtgcaacaacaggatgagga

SEQ ID NO: 35326 - DNA, 20 bp, human
gccgcaaggtgcgcagtagt

SEQ ID NO: 35327 - DNA, 20 bp, human
gccgaaggccccgtacgcca

SEQ ID NO: 35328 - DNA, 20 bp, human
gaccttgcggccgcagcctg

SEQ ID NO: 35329 - DNA, 20 bp, human
gggaggtttcggagcactac

SEQ ID NO: 35330 - DNA, 20 bp, human
ggcccagctacgcgacgcgg

SEQ ID NO: 35331 - DNA, 20 bp, human
gtgcgggcctttgtgacccc

SEQ ID NO: 35332 - DNA, 20 bp, human
gttcggagcactacaggttg

SEQ ID NO: 35333 - DNA, 20 bp, human
ggccctcggcgagcatcagg

SEQ ID NO: 35334 - DNA, 20 bp, human
gcgcgtacggcggcagagtc

SEQ ID NO: 35335 - DNA, 20 bp, human
gagcatcaggtggtcggcca

SEQ ID NO: 35336 - DNA, 20 bp, human
gacaggccccggagtagcag

SEQ ID NO: 35337 - DNA, 20 bp, human
ggccgccagaaatggagaga

SEQ ID NO: 35338 - DNA, 20 bp, human
gccccgggtgtcaataacat

SEQ ID NO: 35339 - DNA, 20 bp, human
ggctgtgagtgaggaagtga

SEQ ID NO: 35340 - DNA, 20 bp, human
gaggatggagccgccagaaa

SEQ ID NO: 35341 - DNA, 20 bp, human
gccccggagtagcagcgggg

SEQ ID NO: 35342 - DNA, 20 bp, human
ggctcgtaaggcccaaatgc

SEQ ID NO: 35343 - DNA, 20 bp, human
ggggttgcggtattgaaaag

SEQ ID NO: 35344 - DNA, 20 bp, human
gcatcccgcggggcatcgag

SEQ ID NO: 35345 - DNA, 20 bp, human
gttgggccttacgagcccac

SEQ ID NO: 35346 - DNA, 20 bp, human
gttagccgcggtgcagactg

SEQ ID NO: 35347 - DNA, 20 bp, human
gtcgctagggacctaagagg

SEQ ID NO: 35348 - DNA, 20 bp, human
ggccgccgcagtctgcaccg

SEQ ID NO: 35349 - DNA, 20 bp, human
gctgcggcggcggtggtctg

SEQ ID NO: 35350 - DNA, 20 bp, human
ggcacagtaacaccacgcag

SEQ ID NO: 35351 - DNA, 20 bp, human
gcagggatctcacagagcgg

SEQ ID NO: 35352 - DNA, 20 bp, human
gtcacgcaggaaccaatggg

SEQ ID NO: 35353 - DNA, 20 bp, human
gccgcccccaagcggaccca

SEQ ID NO: 35354 - DNA, 20 bp, human
gaattcgctagggacctaag

SEQ ID NO: 35355 - DNA, 20 bp, human
gctcaggccggggtcggtgt

SEQ ID NO: 35356 - DNA, 20 bp, human
gcggtcgtactcaccgacag

SEQ ID NO: 35357 - DNA, 20 bp, human
ggtcactgaagagtcatggt

SEQ ID NO: 35358 - DNA, 20 bp, human
gcggcagcagcggtaggccc

SEQ ID NO: 35359 - DNA, 20 bp, human
gctctgcctggagccaaatg

SEQ ID NO: 35360 - DNA, 20 bp, human
gctgagaataacgggaacag

SEQ ID NO: 35361 - DNA, 20 bp, human
ggagcgcagacgggaccccc

SEQ ID NO: 35362 - DNA, 20 bp, human
gggacccagacgtctacctg

SEQ ID NO: 35363 - DNA, 20 bp, human
gccggtcctggctacaggcg

SEQ ID NO: 35364 - DNA, 20 bp, human
gaactgtcactgaagagtca

SEQ ID NO: 35365 - DNA, 20 bp, human
ggacccccaggtagacgtct

SEQ ID NO: 35366 - DNA, 20 bp, human
gcggcccgggaaacttgcag

SEQ ID NO: 35367 - DNA, 20 bp, human
gtccgcgccgcccgacgggt

SEQ ID NO: 35368 - DNA, 20 bp, human
gtgctcgcgcaggctcggca

SEQ ID NO: 35369 - DNA, 20 bp, human
gcaggggctcccccgggact

SEQ ID NO: 35370 - DNA, 20 bp, human
gtcccccgggactgggcgag

SEQ ID NO: 35371 - DNA, 20 bp, human
gggaggaggtccagcaggtc

SEQ ID NO: 35372 - DNA, 20 bp, human
gtgccgctcgcccagtcccg

SEQ ID NO: 35373 - DNA, 20 bp, human
gacgcgggcgctgctggcgt

SEQ ID NO: 35374 - DNA, 20 bp, human
gagaagggtgcccacccgtc

SEQ ID NO: 35375 - DNA, 20 bp, human
gaccaggcgcacggcaaggg

SEQ ID NO: 35376 - DNA, 20 bp, human
gcggcccaagcggtttcaaa

SEQ ID NO: 35377 - DNA, 20 bp, human
gcagctgggtcagaaccaag

SEQ ID NO: 35378 - DNA, 20 bp, human
gcccagctgaggtgagtggt

SEQ ID NO: 35379 - DNA, 20 bp, human
gcaaccaccacagccctcgt

SEQ ID NO: 35380 - DNA, 20 bp, human
gctgacccagctgaggtgag

SEQ ID NO: 35381 - DNA, 20 bp, human
gccagccgcccaggattcag

SEQ ID NO: 35382 - DNA, 20 bp, human
ggctgaggtgagtggtcggt

SEQ ID NO: 35383 - DNA, 20 bp, human
gctgcactcgagggcctcgc

SEQ ID NO: 35384 - DNA, 20 bp, human
gcgcgagaggcactctagca

SEQ ID NO: 35385 - DNA, 20 bp, human
ggcgcgatgcctgcactcga

SEQ ID NO: 35386 - DNA, 20 bp, human
gaggaatacccggcaggcgg

SEQ ID NO: 35387 - DNA, 20 bp, human
gggagaggtcagggaagcta

SEQ ID NO: 35388 - DNA, 20 bp, human
gatcagcaggaatacccggc

SEQ ID NO: 35389 - DNA, 20 bp, human
gcggaggaggcgtttcccag

SEQ ID NO: 35390 - DNA, 20 bp, human
gagcaggaatacccggcagg

SEQ ID NO: 35391 - DNA, 20 bp, human
gaggtccgagcaggatcagc

SEQ ID NO: 35392 - DNA, 20 bp, human
ggactttgctggcctatcag

SEQ ID NO: 35393 - DNA, 20 bp, human
gggcagcagcattggtgctg

SEQ ID NO: 35394 - DNA, 20 bp, human
ggctggcctatcagaggcta

SEQ ID NO: 35395 - DNA, 20 bp, human
gggtggtgacagcagccgta

SEQ ID NO: 35396 - DNA, 20 bp, human
gagctccgcgtacagctcgg

SEQ ID NO: 35397 - DNA, 20 bp, human
gtccgggagctgccgacgga

SEQ ID NO: 35398 - DNA, 20 bp, human
gtgttgtgggcgctcaggtc

SEQ ID NO: 35399 - DNA, 20 bp, human
ggcgccaagagcacgccgag

SEQ ID NO: 35400 - DNA, 20 bp, human
gtcgctccgggagctgccga

SEQ ID NO: 35401 - DNA, 20 bp, human
gtccgtccgtcggcagctcc

SEQ ID NO: 35402 - DNA, 20 bp, human
gcgctcccgcggctcttaag

SEQ ID NO: 35403 - DNA, 20 bp, human
gcccgggcccactcaccggg

SEQ ID NO: 35404 - DNA, 20 bp, human
ggtgccggtcctcgatgatg

SEQ ID NO: 35405 - DNA, 20 bp, human
ggcccacggtcatgatgtac

SEQ ID NO: 35406 - DNA, 20 bp, human
gcgagctgggcgagaagtag

SEQ ID NO: 35407 - DNA, 20 bp, human
gcgcttcgcagaacctactc

SEQ ID NO: 35408 - DNA, 20 bp, human
ggcgatagcaaccgccaccg

SEQ ID NO: 35409 - DNA, 20 bp, human
gggagggcggtgctccgccg

SEQ ID NO: 35410 - DNA, 20 bp, human
gatagcaaccgccaccgcgg

SEQ ID NO: 35411 - DNA, 20 bp, human
ggagagcgggaagccgagct

SEQ ID NO: 35412 - DNA, 20 bp, human
gcactgtcctccccttagga

SEQ ID NO: 35413 - DNA, 20 bp, human
gtgtccctaaaccctcctaa

SEQ ID NO: 35414 - DNA, 20 bp, human
gtcatgaaaaccagagaggg

SEQ ID NO: 35415 - DNA, 20 bp, human
gcctaaaccctcctaagggg

SEQ ID NO: 35416 - DNA, 20 bp, human
gcgagctgggcgagaagtag

SEQ ID NO: 35417 - DNA, 20 bp, human
gcgcttcgcagaacctactc

SEQ ID NO: 35418 - DNA, 20 bp, human
ggcgatagcaaccgccaccg

SEQ ID NO: 35419 - DNA, 20 bp, human
gggagggcggtgctccgccg

SEQ ID NO: 35420 - DNA, 20 bp, human
gatagcaaccgccaccgcgg

SEQ ID NO: 35421 - DNA, 20 bp, human
ggagagcgggaagccgagct

SEQ ID NO: 35422 - DNA, 20 bp, human
gcactgtcctccccttagga

SEQ ID NO: 35423 - DNA, 20 bp, human
gtgtccctaaaccctcctaa

SEQ ID NO: 35424 - DNA, 20 bp, human
gtcatgaaaaccagagaggg

SEQ ID NO: 35425 - DNA, 20 bp, human
gcctaaaccctcctaagggg

SEQ ID NO: 35426 - DNA, 20 bp, human
gccccgtgcagtacctggct

SEQ ID NO: 35427 - DNA, 20 bp, human
gtggcgccacaagccgtggg

SEQ ID NO: 35428 - DNA, 20 bp, human
gcggcttgtggcgccagtgt

SEQ ID NO: 35429 - DNA, 20 bp, human
gagcccagccaggtactgca

SEQ ID NO: 35430 - DNA, 20 bp, human
gggaggcccctccatctgtg

SEQ ID NO: 35431 - DNA, 20 bp, human
gtcccgccccgtgcagtacc

SEQ ID NO: 35432 - DNA, 20 bp, human
gaatcacaggtcccagtggg

SEQ ID NO: 35433 - DNA, 20 bp, human
gacggggcgggaatctgggt

SEQ ID NO: 35434 - DNA, 20 bp, human
gaggggggctgtctgtatcc

SEQ ID NO: 35435 - DNA, 20 bp, human
ggtgacactgacccaaagga

SEQ ID NO: 35436 - DNA, 20 bp, human
ggcggtgtaggagacctgat

SEQ ID NO: 35437 - DNA, 20 bp, human
gtaatgtgagatccccaagg

SEQ ID NO: 35438 - DNA, 20 bp, human
gcactgaaggggctacatgg

SEQ ID NO: 35439 - DNA, 20 bp, human
gtgttgtgggtgttaccgaa

SEQ ID NO: 35440 - DNA, 20 bp, human
ggaataatgtgagatcccca

SEQ ID NO: 35441 - DNA, 20 bp, human
gttcagcttgaacttgttgt

SEQ ID NO: 35442 - DNA, 20 bp, human
ggtaggagacctgatgggca

SEQ ID NO: 35443 - DNA, 20 bp, human
ggtgttaccgaatggcatgg

SEQ ID NO: 35444 - DNA, 20 bp, human
gaatggcatggtggcggtgt

SEQ ID NO: 35445 - DNA, 20 bp, human
gtgggtgttaccgaatggca

SEQ ID NO: 35446 - DNA, 20 bp, human
gatgcaaccggatagaccga

SEQ ID NO: 35447 - DNA, 20 bp, human
ggctggcgcaagataagatc

SEQ ID NO: 35448 - DNA, 20 bp, human
ggataagatccggaacaggg

SEQ ID NO: 35449 - DNA, 20 bp, human
gcttaaaccgaggggtgtgg

SEQ ID NO: 35450 - DNA, 20 bp, human
gtgcacacccacagggtaga

SEQ ID NO: 35451 - DNA, 20 bp, human
ggctaggtgcgcgagggcag

SEQ ID NO: 35452 - DNA, 20 bp, human
gagatccggaacagggaggg

SEQ ID NO: 35453 - DNA, 20 bp, human
gtcacccttgcacacccaca

SEQ ID NO: 35454 - DNA, 20 bp, human
gcaagataagatccggaaca

SEQ ID NO: 35455 - DNA, 20 bp, human
gcgaggctgcagccgaaatg

SEQ ID NO: 35456 - DNA, 20 bp, human
gagagaagccaagggagagg

SEQ ID NO: 35457 - DNA, 20 bp, human
gctacggagagagaagccaa

SEQ ID NO: 35458 - DNA, 20 bp, human
gtgtaaggcgtgcacagagg

SEQ ID NO: 35459 - DNA, 20 bp, human
gtggaggagaaggtaaagtg

SEQ ID NO: 35460 - DNA, 20 bp, human
gaggggacgtggaggaaagt

SEQ ID NO: 35461 - DNA, 20 bp, human
gtaaagtgaggtgaagggtg

SEQ ID NO: 35462 - DNA, 20 bp, human
ggcagaggcaggaaataaca

SEQ ID NO: 35463 - DNA, 20 bp, human
gagggtgtggtgagatgact

SEQ ID NO: 35464 - DNA, 20 bp, human
ggaaggtaaagtgaggtgaa

SEQ ID NO: 35465 - DNA, 20 bp, human
gagaaccaggaagaggagca

SEQ ID NO: 35466 - DNA, 20 bp, human
gagagaagccaagggagagg

SEQ ID NO: 35467 - DNA, 20 bp, human
gctacggagagagaagccaa

SEQ ID NO: 35468 - DNA, 20 bp, human
gtgtaaggcgtgcacagagg

SEQ ID NO: 35469 - DNA, 20 bp, human
gtggaggagaaggtaaagtg

SEQ ID NO: 35470 - DNA, 20 bp, human
gaggggacgtggaggaaagt

SEQ ID NO: 35471 - DNA, 20 bp, human
gtaaagtgaggtgaagggtg

SEQ ID NO: 35472 - DNA, 20 bp, human
ggcagaggcaggaaataaca

SEQ ID NO: 35473 - DNA, 20 bp, human
gagggtgtggtgagatgact

SEQ ID NO: 35474 - DNA, 20 bp, human
ggaaggtaaagtgaggtgaa

SEQ ID NO: 35475 - DNA, 20 bp, human
gctttgtaaggcgtgcacag

SEQ ID NO: 35476 - DNA, 20 bp, human
ggctaggtgcgcgagggcag

SEQ ID NO: 35477 - DNA, 20 bp, human
ggcacccgccaggtaattag

SEQ ID NO: 35478 - DNA, 20 bp, human
gcaccgcgctaggtgcgcga

SEQ ID NO: 35479 - DNA, 20 bp, human
gggtcccgctaattacctgg

SEQ ID NO: 35480 - DNA, 20 bp, human
gagctcgtacaggttccggt

SEQ ID NO: 35481 - DNA, 20 bp, human
gcaggagcctgagtcccggg

SEQ ID NO: 35482 - DNA, 20 bp, human
gacgagctgccagtgaacga

SEQ ID NO: 35483 - DNA, 20 bp, human
ggcggctagagaccccgctc

SEQ ID NO: 35484 - DNA, 20 bp, human
gagctgccagtgaacgacgg

SEQ ID NO: 35485 - DNA, 20 bp, human
gtcaggtcccgctaattacc

SEQ ID NO: 35486 - DNA, 20 bp, human
ggaggctccggcttcaaggt

SEQ ID NO: 35487 - DNA, 20 bp, human
gagcaggacgtgggaggctc

SEQ ID NO: 35488 - DNA, 20 bp, human
gtaggacgctgactgcgagg

SEQ ID NO: 35489 - DNA, 20 bp, human
gctcctccctgcacacaggt

SEQ ID NO: 35490 - DNA, 20 bp, human
ggggtcgcttcggccaaggg

SEQ ID NO: 35491 - DNA, 20 bp, human
gtatgcagggcgagctggtc

SEQ ID NO: 35492 - DNA, 20 bp, human
ggtgggaggctccggcttca

SEQ ID NO: 35493 - DNA, 20 bp, human
gcagccaagaagtgtatgca

SEQ ID NO: 35494 - DNA, 20 bp, human
gcccggcatccactcctcca

SEQ ID NO: 35495 - DNA, 20 bp, human
ggaggggtcgcttcggccaa

SEQ ID NO: 35496 - DNA, 20 bp, human
ggggcgacccaggcatagta

SEQ ID NO: 35497 - DNA, 20 bp, human
gttagtacctgggtaggaac

SEQ ID NO: 35498 - DNA, 20 bp, human
ggtactaaatgcggcccggt

SEQ ID NO: 35499 - DNA, 20 bp, human
gtccaggacacggaaccgtt

SEQ ID NO: 35500 - DNA, 20 bp, human
gggtggagtgaggtatcacg

SEQ ID NO: 35501 - DNA, 20 bp, human
gcgggccgcatttagtacct

SEQ ID NO: 35502 - DNA, 20 bp, human
gccaggcatagtagggtcgg

SEQ ID NO: 35503 - DNA, 20 bp, human
ggaaacgagagcgcgaagag

SEQ ID NO: 35504 - DNA, 20 bp, human
gctccgcgcacaccgaacaa

SEQ ID NO: 35505 - DNA, 20 bp, human
ggactgcggtcgttagtctc

SEQ ID NO: 35506 - DNA, 20 bp, human
ggcggctctctggtccgcag

SEQ ID NO: 35507 - DNA, 20 bp, human
gcacccggcaggggagactc

SEQ ID NO: 35508 - DNA, 20 bp, human
gcaagcgcttaacctcattg

SEQ ID NO: 35509 - DNA, 20 bp, human
ggatggggcggccctgaggt

SEQ ID NO: 35510 - DNA, 20 bp, human
gggagaagccagcgagcccg

SEQ ID NO: 35511 - DNA, 20 bp, human
gggcttctcccacccggcag

SEQ ID NO: 35512 - DNA, 20 bp, human
ggcgcttaacctcattgggg

SEQ ID NO: 35513 - DNA, 20 bp, human
gtaggaagggggcccgggtg

SEQ ID NO: 35514 - DNA, 20 bp, human
gtaagtacccggtcaggggg

SEQ ID NO: 35515 - DNA, 20 bp, human
gggcaggggagactcgggtt

SEQ ID NO: 35516 - DNA, 20 bp, human
ggcggccgcggcctctgaag

SEQ ID NO: 35517 - DNA, 20 bp, human
gaagcgggctggggatcggg

SEQ ID NO: 35518 - DNA, 20 bp, human
gacgcgctcaccggctgggt

SEQ ID NO: 35519 - DNA, 20 bp, human
gactaccgggtaagcgacgg

SEQ ID NO: 35520 - DNA, 20 bp, human
ggtgggttcgagcaactacc

SEQ ID NO: 35521 - DNA, 20 bp, human
gcagcccgcttcagaggccg

SEQ ID NO: 35522 - DNA, 20 bp, human
ggctcgcgtccgggattaaa

SEQ ID NO: 35523 - DNA, 20 bp, human
ggggctggtcacgccctccg

SEQ ID NO: 35524 - DNA, 20 bp, human
gagacagtcgacgcgctcac

SEQ ID NO: 35525 - DNA, 20 bp, human
ggtcgacgcgctcaccggct

SEQ ID NO: 35526 - DNA, 20 bp, human
ggctcagtgcctgcgccact

SEQ ID NO: 35527 - DNA, 20 bp, human
gcagtgctccgggtgtctgc

SEQ ID NO: 35528 - DNA, 20 bp, human
gtcttggtggtagatatgaa

SEQ ID NO: 35529 - DNA, 20 bp, human
gaatatgtgcagaagcttag

SEQ ID NO: 35530 - DNA, 20 bp, human
gaagcaagcttcagtcttgg

SEQ ID NO: 35531 - DNA, 20 bp, human
gggtagatatgaagggatat

SEQ ID NO: 35532 - DNA, 20 bp, human
gatagccattagatggtcca

SEQ ID NO: 35533 - DNA, 20 bp, human
gagggatattggaagaaacg

SEQ ID NO: 35534 - DNA, 20 bp, human
gaaatctgtcattcctccaa

SEQ ID NO: 35535 - DNA, 20 bp, human
gagaggaagaacattgcctt

SEQ ID NO: 35536 - DNA, 20 bp, human
gagagcgtagagcctgagag

SEQ ID NO: 35537 - DNA, 20 bp, human
gctggctgacaggagggcgt

SEQ ID NO: 35538 - DNA, 20 bp, human
gggcctgcccgaaaaccggg

SEQ ID NO: 35539 - DNA, 20 bp, human
ggggccgcgcgcgagcgcag

SEQ ID NO: 35540 - DNA, 20 bp, human
gcgcgcgcgagcgcagcggt

SEQ ID NO: 35541 - DNA, 20 bp, human
ggcgaccagccggtgagtgc

SEQ ID NO: 35542 - DNA, 20 bp, human
gggcggagctggctgacagg

SEQ ID NO: 35543 - DNA, 20 bp, human
gcaccggaagcggaaatgaa

SEQ ID NO: 35544 - DNA, 20 bp, human
ggtgggaggcggcgaccagc

SEQ ID NO: 35545 - DNA, 20 bp, human
gtgaggcctgcccgaaaacc

SEQ ID NO: 35546 - DNA, 20 bp, human
gggccctccaggatatgggt

SEQ ID NO: 35547 - DNA, 20 bp, human
gccagaggcagggctgatag

SEQ ID NO: 35548 - DNA, 20 bp, human
ggtatggccctccaggatat

SEQ ID NO: 35549 - DNA, 20 bp, human
gtgctacccgtgagttaaaa

SEQ ID NO: 35550 - DNA, 20 bp, human
gctcagataccatagcccta

SEQ ID NO: 35551 - DNA, 20 bp, human
gtctcaggtcacacagaaaa

SEQ ID NO: 35552 - DNA, 20 bp, human
gaagagagaccctagggcta

SEQ ID NO: 35553 - DNA, 20 bp, human
gtacacacccacccatatcc

SEQ ID NO: 35554 - DNA, 20 bp, human
gaccctctgtgagcatgtga

SEQ ID NO: 35555 - DNA, 20 bp, human
gtgagatgctcctggggtag

SEQ ID NO: 35556 - DNA, 20 bp, human
gtatattcagttatccctca

SEQ ID NO: 35557 - DNA, 20 bp, human
ggtgtcgtgcagctggaata

SEQ ID NO: 35558 - DNA, 20 bp, human
gacagggagatgtacagcaa

SEQ ID NO: 35559 - DNA, 20 bp, human
gttccaaagagagaaatcac

SEQ ID NO: 35560 - DNA, 20 bp, human
gtggaaaatgcgggttacga

SEQ ID NO: 35561 - DNA, 20 bp, human
gactcagagtgatatactgt

SEQ ID NO: 35562 - DNA, 20 bp, human
gtctgacacaagaatcctaa

SEQ ID NO: 35563 - DNA, 20 bp, human
gtaataacaagttaaccatt

SEQ ID NO: 35564 - DNA, 20 bp, human
gattatttagttctatagta

SEQ ID NO: 35565 - DNA, 20 bp, human
gttctctctttggaaaatgc

SEQ ID NO: 35566 - DNA, 20 bp, human
gctcagtgtgagtgaactgg

SEQ ID NO: 35567 - DNA, 20 bp, human
gctgctgcatacattgtgtc

SEQ ID NO: 35568 - DNA, 20 bp, human
gtctctacaacatgacccaa

SEQ ID NO: 35569 - DNA, 20 bp, human
gtctgattctcaggtacctg

SEQ ID NO: 35570 - DNA, 20 bp, human
ggctacaggtctgatcaaat

SEQ ID NO: 35571 - DNA, 20 bp, human
gagatgaggttctgattctc

SEQ ID NO: 35572 - DNA, 20 bp, human
gccaacaataacaaaataga

SEQ ID NO: 35573 - DNA, 20 bp, human
gggtagttagcttctaaata

SEQ ID NO: 35574 - DNA, 20 bp, human
ggagtacagcttcaagacaa

SEQ ID NO: 35575 - DNA, 20 bp, human
gttgtgtcaggttttcaata

SEQ ID NO: 35576 - DNA, 20 bp, human
gtaactagagaggaacaatg

SEQ ID NO: 35577 - DNA, 20 bp, human
ggagccaggaataactagag

SEQ ID NO: 35578 - DNA, 20 bp, human
ggaacaatggggttattcag

SEQ ID NO: 35579 - DNA, 20 bp, human
gattagaggctgcaaaggat

SEQ ID NO: 35580 - DNA, 20 bp, human
ggttcctctctagttattcc

SEQ ID NO: 35581 - DNA, 20 bp, human
gtacttattagaggctgcaa

SEQ ID NO: 35582 - DNA, 20 bp, human
gcatatgcaggaactaaacc

SEQ ID NO: 35583 - DNA, 20 bp, human
gactaaaccagggtatctta

SEQ ID NO: 35584 - DNA, 20 bp, human
gagtatttgactggtgcagc

SEQ ID NO: 35585 - DNA, 20 bp, human
gaatgaaggaagtatttgac

SEQ ID NO: 35586 - DNA, 20 bp, human
gagcacgctgaaaccctggg

SEQ ID NO: 35587 - DNA, 20 bp, human
gggaagcacgctgaaaccct

SEQ ID NO: 35588 - DNA, 20 bp, human
gcccaggccggccgcagaag

SEQ ID NO: 35589 - DNA, 20 bp, human
gtacggagaaggcacagcga

SEQ ID NO: 35590 - DNA, 20 bp, human
gagctgtgcgacctcttctg

SEQ ID NO: 35591 - DNA, 20 bp, human
gcacagcttgccgccgccca

SEQ ID NO: 35592 - DNA, 20 bp, human
gatcccctgcctgcctctcg

SEQ ID NO: 35593 - DNA, 20 bp, human
gaggagcccggggcacccac

SEQ ID NO: 35594 - DNA, 20 bp, human
ggggcacccacaggccgcag

SEQ ID NO: 35595 - DNA, 20 bp, human
gtggacccgccagggcgtaa

SEQ ID NO: 35596 - DNA, 20 bp, human
gaacctgcgagtgggcctgg

SEQ ID NO: 35597 - DNA, 20 bp, human
gccggacgatcgcagacctg

SEQ ID NO: 35598 - DNA, 20 bp, human
ggggagcagggacctcgcac

SEQ ID NO: 35599 - DNA, 20 bp, human
gcctacggcccgcctcgctg

SEQ ID NO: 35600 - DNA, 20 bp, human
ggagccccgcgcaccagtcg

SEQ ID NO: 35601 - DNA, 20 bp, human
ggacgatcgcagacctgggg

SEQ ID NO: 35602 - DNA, 20 bp, human
gggagtgggagggcgagccg

SEQ ID NO: 35603 - DNA, 20 bp, human
ggacagcgccggcttcgggt

SEQ ID NO: 35604 - DNA, 20 bp, human
ggcgagtgggcctggcggat

SEQ ID NO: 35605 - DNA, 20 bp, human
gcccgcccggcccctctcga

SEQ ID NO: 35606 - DNA, 20 bp, human
gttggggacagcaagagcag

SEQ ID NO: 35607 - DNA, 20 bp, human
gggcttaaggagctacactg

SEQ ID NO: 35608 - DNA, 20 bp, human
gctacactgggggaaggaca

SEQ ID NO: 35609 - DNA, 20 bp, human
ggctgtccccaaggcgtctg

SEQ ID NO: 35610 - DNA, 20 bp, human
gggaggcccccattctcaga

SEQ ID NO: 35611 - DNA, 20 bp, human
gctccagcacaggctccgga

SEQ ID NO: 35612 - DNA, 20 bp, human
gatgctgccccagacgcctt

SEQ ID NO: 35613 - DNA, 20 bp, human
ggaggggagccatggatgag

SEQ ID NO: 35614 - DNA, 20 bp, human
gctgtgtggggtggacgttg

SEQ ID NO: 35615 - DNA, 20 bp, human
gtcccggtcacagcagcgtg

SEQ ID NO: 35616 - DNA, 20 bp, human
gcggcccgcaaagtccgcgc

SEQ ID NO: 35617 - DNA, 20 bp, human
gtgcagaggacaaggacacc

SEQ ID NO: 35618 - DNA, 20 bp, human
gtgggaagcgcgaggaccag

SEQ ID NO: 35619 - DNA, 20 bp, human
ggtcccggagcgcactcctg

SEQ ID NO: 35620 - DNA, 20 bp, human
gctgaggctgcagggccgaa

SEQ ID NO: 35621 - DNA, 20 bp, human
gaccgccgagggaggcgaga

SEQ ID NO: 35622 - DNA, 20 bp, human
ggacaccaggtacttgtctc

SEQ ID NO: 35623 - DNA, 20 bp, human
gctgcagtacgagcagaccc

SEQ ID NO: 35624 - DNA, 20 bp, human
ggagtgcggcgggcccccgg

SEQ ID NO: 35625 - DNA, 20 bp, human
gccctgctccaggttaccct

SEQ ID NO: 35626 - DNA, 20 bp, human
gccggaccggccctgaccca

SEQ ID NO: 35627 - DNA, 20 bp, human
gccggccctgacccacggaa

SEQ ID NO: 35628 - DNA, 20 bp, human
gggtcagggccggtccggtc

SEQ ID NO: 35629 - DNA, 20 bp, human
gtgcaggttccggaccggac

SEQ ID NO: 35630 - DNA, 20 bp, human
gcaggagtcaggagcccgaa

SEQ ID NO: 35631 - DNA, 20 bp, human
gggggctgcaggttccggac

SEQ ID NO: 35632 - DNA, 20 bp, human
gaactagaacactgggaaag

SEQ ID NO: 35633 - DNA, 20 bp, human
gagagacatagcaaaatcgg

SEQ ID NO: 35634 - DNA, 20 bp, human
gcttccccttccgtgggtca

SEQ ID NO: 35635 - DNA, 20 bp, human
gttcttcggtggagctccga

SEQ ID NO: 35636 - DNA, 20 bp, human
ggatgcggcactgcaggtaa

SEQ ID NO: 35637 - DNA, 20 bp, human
ggctgaagaaaggatgctcg

SEQ ID NO: 35638 - DNA, 20 bp, human
ggggccagacagaaagacgg

SEQ ID NO: 35639 - DNA, 20 bp, human
gggcggccgcgggcgcgatg

SEQ ID NO: 35640 - DNA, 20 bp, human
ggcattctaagtagacagag

SEQ ID NO: 35641 - DNA, 20 bp, human
ggcgccgtgacatcaccagg

SEQ ID NO: 35642 - DNA, 20 bp, human
gctcgaggatgctgtccagg

SEQ ID NO: 35643 - DNA, 20 bp, human
ggggagggaaaaaaccgctc

SEQ ID NO: 35644 - DNA, 20 bp, human
ggtgcccgccccgagaaagc

SEQ ID NO: 35645 - DNA, 20 bp, human
gcaagacccaagtcacgcgt

SEQ ID NO: 35646 - DNA, 20 bp, human
gtgggttgagggtctaatgg

SEQ ID NO: 35647 - DNA, 20 bp, human
gtgatcgctgtgagagtcaa

SEQ ID NO: 35648 - DNA, 20 bp, human
gccttcagggctgtgagcaa

SEQ ID NO: 35649 - DNA, 20 bp, human
gatttcagcccggagggccc

SEQ ID NO: 35650 - DNA, 20 bp, human
gtgaaatcgacatttgcctc

SEQ ID NO: 35651 - DNA, 20 bp, human
gatgtcgatttcagcccgga

SEQ ID NO: 35652 - DNA, 20 bp, human
gggagggaatcacggtataa

SEQ ID NO: 35653 - DNA, 20 bp, human
gggccagggttaaatataga

SEQ ID NO: 35654 - DNA, 20 bp, human
gagaaggacacgaaagctga

SEQ ID NO: 35655 - DNA, 20 bp, human
gaccctcaacccaaaggagc

SEQ ID NO: 35656 - DNA, 20 bp, human
gaggtccctacaccagggat

SEQ ID NO: 35657 - DNA, 20 bp, human
gcagaggacaagtcgtacaa

SEQ ID NO: 35658 - DNA, 20 bp, human
gggtatttcagtttatggaa

SEQ ID NO: 35659 - DNA, 20 bp, human
gggagccaatccctggtgta

SEQ ID NO: 35660 - DNA, 20 bp, human
gaggacaagtcgtacaatgg

SEQ ID NO: 35661 - DNA, 20 bp, human
gcgtacaatggtggaggaat

SEQ ID NO: 35662 - DNA, 20 bp, human
gaaggaggttggagcagctt

SEQ ID NO: 35663 - DNA, 20 bp, human
gtttatggaagggagacaaa

SEQ ID NO: 35664 - DNA, 20 bp, human
ggaacatccattacattcag

SEQ ID NO: 35665 - DNA, 20 bp, human
gacaagtcgtacaatggtgg

SEQ ID NO: 35666 - DNA, 20 bp, human
gtggcgtttgttgctgtgaa

SEQ ID NO: 35667 - DNA, 20 bp, human
gagtctgaagtgctttagaa

SEQ ID NO: 35668 - DNA, 20 bp, human
gacactggtagttctttagg

SEQ ID NO: 35669 - DNA, 20 bp, human
gtaaggaaaccagactacaa

SEQ ID NO: 35670 - DNA, 20 bp, human
ggcatgccccccgggagcag

SEQ ID NO: 35671 - DNA, 20 bp, human
gaactaccagtgttccctgg

SEQ ID NO: 35672 - DNA, 20 bp, human
gcccacctttaaggatatta

SEQ ID NO: 35673 - DNA, 20 bp, human
gggaaaccagactacaaagg

SEQ ID NO: 35674 - DNA, 20 bp, human
gcaggcccctctcaaagagc

SEQ ID NO: 35675 - DNA, 20 bp, human
gggactgaagcatgcccccc

SEQ ID NO: 35676 - DNA, 20 bp, human
ggggtccagagtggcagtaa

SEQ ID NO: 35677 - DNA, 20 bp, human
gtccagagtggcagtaaagg

SEQ ID NO: 35678 - DNA, 20 bp, human
gttggtagaggggtccagag

SEQ ID NO: 35679 - DNA, 20 bp, human
gtcacgtgaggcgcagatcc

SEQ ID NO: 35680 - DNA, 20 bp, human
gtgaggcgcagatcctggct

SEQ ID NO: 35681 - DNA, 20 bp, human
ggagaaaagaccccagactt

SEQ ID NO: 35682 - DNA, 20 bp, human
ggccaatctgggcccgcagg

SEQ ID NO: 35683 - DNA, 20 bp, human
ggtaaaggaggaagatggcg

SEQ ID NO: 35684 - DNA, 20 bp, human
ggactgtcagtgacccagaa

SEQ ID NO: 35685 - DNA, 20 bp, human
ggtagacgcttcgagagccc

SEQ ID NO: 35686 - DNA, 20 bp, human
ggtcacgagaacaaacacgg

SEQ ID NO: 35687 - DNA, 20 bp, human
ggcccgccgcggagcgacac

SEQ ID NO: 35688 - DNA, 20 bp, human
ggccgccagaaggctcacga

SEQ ID NO: 35689 - DNA, 20 bp, human
gcgggtcacgagaacaaaca

SEQ ID NO: 35690 - DNA, 20 bp, human
gcgggaccgggacgacgagg

SEQ ID NO: 35691 - DNA, 20 bp, human
gccgcggagcgacaccggcc

SEQ ID NO: 35692 - DNA, 20 bp, human
gcgttggccatggcccgccg

SEQ ID NO: 35693 - DNA, 20 bp, human
ggacaccttcttagagacgt

SEQ ID NO: 35694 - DNA, 20 bp, human
gtggggtctggagtcttcgg

SEQ ID NO: 35695 - DNA, 20 bp, human
gccgggctcggtggccggga

SEQ ID NO: 35696 - DNA, 20 bp, human
gctcaactgggtatgactga

SEQ ID NO: 35697 - DNA, 20 bp, human
gtccagcgggtagaacccgt

SEQ ID NO: 35698 - DNA, 20 bp, human
gtggggtgagcccctcaact

SEQ ID NO: 35699 - DNA, 20 bp, human
gccccaccagggtgacacct

SEQ ID NO: 35700 - DNA, 20 bp, human
ggagattgagaggagaattg

SEQ ID NO: 35701 - DNA, 20 bp, human
gagcagagctccccacctgg

SEQ ID NO: 35702 - DNA, 20 bp, human
gccaggcgggtaggtgatgg

SEQ ID NO: 35703 - DNA, 20 bp, human
gctcctcgggatgtaggaaa

SEQ ID NO: 35704 - DNA, 20 bp, human
gaccgaggcaaggactggtg

SEQ ID NO: 35705 - DNA, 20 bp, human
ggagggcagaggaatcacgc

SEQ ID NO: 35706 - DNA, 20 bp, human
gtgacaggtgaggggtctct

SEQ ID NO: 35707 - DNA, 20 bp, human
gagggcataggggatggtag

SEQ ID NO: 35708 - DNA, 20 bp, human
gcgagattggcagggagagt

SEQ ID NO: 35709 - DNA, 20 bp, human
gcccacccaaatgaagagga

SEQ ID NO: 35710 - DNA, 20 bp, human
gggggtctctgggcgtggac

SEQ ID NO: 35711 - DNA, 20 bp, human
gactggagtatgaacctgga

SEQ ID NO: 35712 - DNA, 20 bp, human
ggccaggcaggcagggcata

SEQ ID NO: 35713 - DNA, 20 bp, human
gaaggagggtgctccgagat

SEQ ID NO: 35714 - DNA, 20 bp, human
gtctccccacccaaatgaag

SEQ ID NO: 35715 - DNA, 20 bp, human
gcgcttggtgcttccactac

SEQ ID NO: 35716 - DNA, 20 bp, human
gggagcggctgccaccgaag

SEQ ID NO: 35717 - DNA, 20 bp, human
gagagccccttccccttcgg

SEQ ID NO: 35718 - DNA, 20 bp, human
ggggtgctcataggtggaca

SEQ ID NO: 35719 - DNA, 20 bp, human
gggtcaggggtgctcatagg

SEQ ID NO: 35720 - DNA, 20 bp, human
gccagcagcagactgggcac

SEQ ID NO: 35721 - DNA, 20 bp, human
gtggggtcaggggtgctcat

SEQ ID NO: 35722 - DNA, 20 bp, human
ggctgccaccgaaggggaag

SEQ ID NO: 35723 - DNA, 20 bp, human
ggcacccctgaccccagctc

SEQ ID NO: 35724 - DNA, 20 bp, human
gttggaacacacacctgtcc

SEQ ID NO: 35725 - DNA, 20 bp, human
gctgggcccaggcgggaaag

SEQ ID NO: 35726 - DNA, 20 bp, human
ggtctggatactagaagctg

SEQ ID NO: 35727 - DNA, 20 bp, human
gccggggcggcgctggagtc

SEQ ID NO: 35728 - DNA, 20 bp, human
gagaagctgcggttgctccc

SEQ ID NO: 35729 - DNA, 20 bp, human
gccgcccaggccatgtacga

SEQ ID NO: 35730 - DNA, 20 bp, human
gaggagtaaatcctccactg

SEQ ID NO: 35731 - DNA, 20 bp, human
gctggagaagctctgggtcg

SEQ ID NO: 35732 - DNA, 20 bp, human
gggccccgcggaggaagtta

SEQ ID NO: 35733 - DNA, 20 bp, human
gctgcgtgtcgcagagcacc

SEQ ID NO: 35734 - DNA, 20 bp, human
gcctcacagcggccgtccag

SEQ ID NO: 35735 - DNA, 20 bp, human
gactgagacgcagaaccgct

SEQ ID NO: 35736 - DNA, 20 bp, human
gctcagaggagtccagtcta

SEQ ID NO: 35737 - DNA, 20 bp, human
ggcgagacagccatcaggag

SEQ ID NO: 35738 - DNA, 20 bp, human
gcacgcagacaggcccgggt

SEQ ID NO: 35739 - DNA, 20 bp, human
gcggggtcccaggctcgaac

SEQ ID NO: 35740 - DNA, 20 bp, human
gcgggcaccaggagcgtccc

SEQ ID NO: 35741 - DNA, 20 bp, human
ggagcgtccctggctcccta

SEQ ID NO: 35742 - DNA, 20 bp, human
ggccggcggcatggctagca

SEQ ID NO: 35743 - DNA, 20 bp, human
ggccgtgctagccatgccgc

SEQ ID NO: 35744 - DNA, 20 bp, human
gcccagcgggacccctagac

SEQ ID NO: 35745 - DNA, 20 bp, human
gggcatggctagcacggctt

SEQ ID NO: 35746 - DNA, 20 bp, human
gcgaggcgggacactggagg

SEQ ID NO: 35747 - DNA, 20 bp, human
gacggcccgaggcgggacac

SEQ ID NO: 35748 - DNA, 20 bp, human
gacgctcgcgagccgctgga

SEQ ID NO: 35749 - DNA, 20 bp, human
gaaggacccgagcttggcgg

SEQ ID NO: 35750 - DNA, 20 bp, human
gtatcccgctctctacccag

SEQ ID NO: 35751 - DNA, 20 bp, human
gtcgggccgtcgccctccag

SEQ ID NO: 35752 - DNA, 20 bp, human
gccaagctcgggtccttacc

SEQ ID NO: 35753 - DNA, 20 bp, human
gtagagagcgggatattaga

SEQ ID NO: 35754 - DNA, 20 bp, human
ggctctctacccagaggata

SEQ ID NO: 35755 - DNA, 20 bp, human
gagcggcgaagggcgcacgg

SEQ ID NO: 35756 - DNA, 20 bp, human
gtgtgtggtagacccagacc

SEQ ID NO: 35757 - DNA, 20 bp, human
gctgcgtgtgagaagcaggt

SEQ ID NO: 35758 - DNA, 20 bp, human
gtcccagcgaggtacaccgg

SEQ ID NO: 35759 - DNA, 20 bp, human
gccattggctctaactagta

SEQ ID NO: 35760 - DNA, 20 bp, human
gcacttcctgggacgctgag

SEQ ID NO: 35761 - DNA, 20 bp, human
gcgttcccagcgaggtacac

SEQ ID NO: 35762 - DNA, 20 bp, human
ggccggagccgccaaggact

SEQ ID NO: 35763 - DNA, 20 bp, human
ggtctccctctcagcgtccc

SEQ ID NO: 35764 - DNA, 20 bp, human
ggcctccggtgtacctcgct

SEQ ID NO: 35765 - DNA, 20 bp, human
gcagcaaagctcccagtcct

SEQ ID NO: 35766 - DNA, 20 bp, human
gctcccaggaaatgtctcat

SEQ ID NO: 35767 - DNA, 20 bp, human
gtgcaggatgtcttgtgtgg

SEQ ID NO: 35768 - DNA, 20 bp, human
gatttgcaggatgtcttgtg

SEQ ID NO: 35769 - DNA, 20 bp, human
gagaaaacctgcgtgactgt

SEQ ID NO: 35770 - DNA, 20 bp, human
ggcacctgagagcaggattt

SEQ ID NO: 35771 - DNA, 20 bp, human
gtggcaatggtgagatagag

SEQ ID NO: 35772 - DNA, 20 bp, human
gagaagtcctacagtcacgc

SEQ ID NO: 35773 - DNA, 20 bp, human
gtttcccaacgacagcatct

SEQ ID NO: 35774 - DNA, 20 bp, human
gcattccaagatgctgtcgt

SEQ ID NO: 35775 - DNA, 20 bp, human
gtgtgcatcgtgactctccc

SEQ ID NO: 35776 - DNA, 20 bp, human
gagcagtccccggagcgctg

SEQ ID NO: 35777 - DNA, 20 bp, human
ggtgtgcagccgcccaggag

SEQ ID NO: 35778 - DNA, 20 bp, human
ggcagcccccgagcagtccc

SEQ ID NO: 35779 - DNA, 20 bp, human
gcgctccggggactgctcgg

SEQ ID NO: 35780 - DNA, 20 bp, human
gtatgagccttgctctccca

SEQ ID NO: 35781 - DNA, 20 bp, human
gcagtgaaagaaaccccccg

SEQ ID NO: 35782 - DNA, 20 bp, human
gttccgggcagcgtgagaag

SEQ ID NO: 35783 - DNA, 20 bp, human
gccctatggcaccagtctgt

SEQ ID NO: 35784 - DNA, 20 bp, human
ggcagagtcccccagcgctc

SEQ ID NO: 35785 - DNA, 20 bp, human
gcaggctgtagcctacagac

SEQ ID NO: 35786 - DNA, 20 bp, human
gtagacgcccagggagtcgg

SEQ ID NO: 35787 - DNA, 20 bp, human
gctgcttcctggcaggtcag

SEQ ID NO: 35788 - DNA, 20 bp, human
ggctgtgccaccgactccct

SEQ ID NO: 35789 - DNA, 20 bp, human
gcgtccatgctggccctctc

SEQ ID NO: 35790 - DNA, 20 bp, human
gcagcagttgtagacgccca

SEQ ID NO: 35791 - DNA, 20 bp, human
ggggaggggcagaaccccta

SEQ ID NO: 35792 - DNA, 20 bp, human
gttgtagacgcccagggagt

SEQ ID NO: 35793 - DNA, 20 bp, human
gcggctaaggagggttgtcc

SEQ ID NO: 35794 - DNA, 20 bp, human
ggcggcagctgttgacgaga

SEQ ID NO: 35795 - DNA, 20 bp, human
gatgctggccctctctggta

SEQ ID NO: 35796 - DNA, 20 bp, human
gagccctggccccacttaag

SEQ ID NO: 35797 - DNA, 20 bp, human
gggctaatgataccaaaaat

SEQ ID NO: 35798 - DNA, 20 bp, human
gaatgctgatgactctctgg

SEQ ID NO: 35799 - DNA, 20 bp, human
gcatgggcagacaccagccc

SEQ ID NO: 35800 - DNA, 20 bp, human
gatccaacagtcagtccagg

SEQ ID NO: 35801 - DNA, 20 bp, human
gacaggctgtaaccaacagt

SEQ ID NO: 35802 - DNA, 20 bp, human
gaccatccaacagtcagtcc

SEQ ID NO: 35803 - DNA, 20 bp, human
ggggctgcttgccacaatga

SEQ ID NO: 35804 - DNA, 20 bp, human
gataccaaaaataggcaaca

SEQ ID NO: 35805 - DNA, 20 bp, human
gtcctcatagttaatttatg

SEQ ID NO: 35806 - DNA, 20 bp, human
gccaataagcagggcgatca

SEQ ID NO: 35807 - DNA, 20 bp, human
ggcaacagccacacacatga

SEQ ID NO: 35808 - DNA, 20 bp, human
gaagctgatactctccactg

SEQ ID NO: 35809 - DNA, 20 bp, human
gccctgcttattggcatctg

SEQ ID NO: 35810 - DNA, 20 bp, human
gcatccgacaagccagggtc

SEQ ID NO: 35811 - DNA, 20 bp, human
gcagtagctgtgactgaact

SEQ ID NO: 35812 - DNA, 20 bp, human
gcactgaggcagaagggttg

SEQ ID NO: 35813 - DNA, 20 bp, human
gatttggactaaaacgttat

SEQ ID NO: 35814 - DNA, 20 bp, human
gtgggttccttggcatggtg

SEQ ID NO: 35815 - DNA, 20 bp, human
gtcagtcacagctactgatt

SEQ ID NO: 35816 - DNA, 20 bp, human
gcaggaggaacgccaccact

SEQ ID NO: 35817 - DNA, 20 bp, human
gagctggctcgtgtctaata

SEQ ID NO: 35818 - DNA, 20 bp, human
gcacaccttcggcagcagga

SEQ ID NO: 35819 - DNA, 20 bp, human
gcagtcatgcaggagaaaat

SEQ ID NO: 35820 - DNA, 20 bp, human
gggcggcagcttctcgcagg

SEQ ID NO: 35821 - DNA, 20 bp, human
gtcatgcaggagaaaatggg

SEQ ID NO: 35822 - DNA, 20 bp, human
gcacctctgggtgaggaccc

SEQ ID NO: 35823 - DNA, 20 bp, human
gcagccccaggatggacagg

SEQ ID NO: 35824 - DNA, 20 bp, human
gagctctggctcagaatgaa

SEQ ID NO: 35825 - DNA, 20 bp, human
gcagcttctcgcaggcggca

SEQ ID NO: 35826 - DNA, 20 bp, human
gcaggcagtcacggccatgg

SEQ ID NO: 35827 - DNA, 20 bp, human
ggcaacagccacctgcacca

SEQ ID NO: 35828 - DNA, 20 bp, human
gtaggaggacgggaacctta

SEQ ID NO: 35829 - DNA, 20 bp, human
gacgaaccccaagccctgac

SEQ ID NO: 35830 - DNA, 20 bp, human
gtgacaggcagtcacggcca

SEQ ID NO: 35831 - DNA, 20 bp, human
gcagacacctggcccttacc

SEQ ID NO: 35832 - DNA, 20 bp, human
gacagccacctgcaccaggg

SEQ ID NO: 35833 - DNA, 20 bp, human
gcagcagggtgaagtagccc

SEQ ID NO: 35834 - DNA, 20 bp, human
ggaaactgcaggctctgtct

SEQ ID NO: 35835 - DNA, 20 bp, human
gcacagagccacacgacaag

SEQ ID NO: 35836 - DNA, 20 bp, human
ggggggagcagcgagaagga

SEQ ID NO: 35837 - DNA, 20 bp, human
gggcagggggagcagcgaga

SEQ ID NO: 35838 - DNA, 20 bp, human
ggcgcagatagcagactgtg

SEQ ID NO: 35839 - DNA, 20 bp, human
gctggactccagaatgcagg

SEQ ID NO: 35840 - DNA, 20 bp, human
gtggacggtaggccccaggc

SEQ ID NO: 35841 - DNA, 20 bp, human
ggctgctcgccctggacggt

SEQ ID NO: 35842 - DNA, 20 bp, human
ggcccaggagagaggaccga

SEQ ID NO: 35843 - DNA, 20 bp, human
gtgccgtgggcctctatgaa

SEQ ID NO: 35844 - DNA, 20 bp, human
gcctgggccatggccaactc

SEQ ID NO: 35845 - DNA, 20 bp, human
gcagggccaagaagtagccc

SEQ ID NO: 35846 - DNA, 20 bp, human
gaggaggagagaagtcagcc

SEQ ID NO: 35847 - DNA, 20 bp, human
ggccacaagcagcctcaaga

SEQ ID NO: 35848 - DNA, 20 bp, human
gcccacagacacttgtaagg

SEQ ID NO: 35849 - DNA, 20 bp, human
gacagagataatgcaggcca

SEQ ID NO: 35850 - DNA, 20 bp, human
gcaggctgcccaggccatga

SEQ ID NO: 35851 - DNA, 20 bp, human
gggcctgcccgctgacatcc

SEQ ID NO: 35852 - DNA, 20 bp, human
gacagagtggcggtagcagg

SEQ ID NO: 35853 - DNA, 20 bp, human
gcagagagactctgaaatga

SEQ ID NO: 35854 - DNA, 20 bp, human
gagcttcagcctgaagacaa

SEQ ID NO: 35855 - DNA, 20 bp, human
ggagggattagaggtgttca

SEQ ID NO: 35856 - DNA, 20 bp, human
ggcgaagtacaaggggccac

SEQ ID NO: 35857 - DNA, 20 bp, human
gtcctcagtcccctacactt

SEQ ID NO: 35858 - DNA, 20 bp, human
ggaggggagcgaagtacaag

SEQ ID NO: 35859 - DNA, 20 bp, human
gagccaggctgggccacctt

SEQ ID NO: 35860 - DNA, 20 bp, human
ggaaagggatcctgagggag

SEQ ID NO: 35861 - DNA, 20 bp, human
gcccctctgcctaagtgtag

SEQ ID NO: 35862 - DNA, 20 bp, human
gggactgggataaaaattgg

SEQ ID NO: 35863 - DNA, 20 bp, human
gggtatgggaggggaaactc

SEQ ID NO: 35864 - DNA, 20 bp, human
gcaggatggagatacttaca

SEQ ID NO: 35865 - DNA, 20 bp, human
ggtcccctacacttaggcag

SEQ ID NO: 35866 - DNA, 20 bp, human
gccattagaggacaagatag

SEQ ID NO: 35867 - DNA, 20 bp, human
gttcgaagtgggatgatcac

SEQ ID NO: 35868 - DNA, 20 bp, human
gggggaaaccaagcatccgg

SEQ ID NO: 35869 - DNA, 20 bp, human
gtcactgtcgggtaaaacaa

SEQ ID NO: 35870 - DNA, 20 bp, human
gaagagcaagcagacactgg

SEQ ID NO: 35871 - DNA, 20 bp, human
gaagcagacactggagggtg

SEQ ID NO: 35872 - DNA, 20 bp, human
gactgtcattagcttggtgg

SEQ ID NO: 35873 - DNA, 20 bp, human
gggcccgtgatgtcctaaag

SEQ ID NO: 35874 - DNA, 20 bp, human
ggtccactttaggacatcac

SEQ ID NO: 35875 - DNA, 20 bp, human
gggagcaagatgagtgcctc

SEQ ID NO: 35876 - DNA, 20 bp, human
gcgaagggcaggagttagtt

SEQ ID NO: 35877 - DNA, 20 bp, human
gggcgactgctgatcctggg

SEQ ID NO: 35878 - DNA, 20 bp, human
gccaggacagaattcctccc

SEQ ID NO: 35879 - DNA, 20 bp, human
gtcttttcacagcaaccgaa

SEQ ID NO: 35880 - DNA, 20 bp, human
gaagaggcgactgctgatcc

SEQ ID NO: 35881 - DNA, 20 bp, human
ggaactgtagctcaactagc

SEQ ID NO: 35882 - DNA, 20 bp, human
gtacaaactacctgccacac

SEQ ID NO: 35883 - DNA, 20 bp, human
gtcattatctttgctgggat

SEQ ID NO: 35884 - DNA, 20 bp, human
gggagtttcattatctttgc

SEQ ID NO: 35885 - DNA, 20 bp, human
gagctctcaggacattataa

SEQ ID NO: 35886 - DNA, 20 bp, human
gcacggcagggagaagacga

SEQ ID NO: 35887 - DNA, 20 bp, human
gaggcgacagcggagaagga

SEQ ID NO: 35888 - DNA, 20 bp, human
gggcagggagaagacgacgg

SEQ ID NO: 35889 - DNA, 20 bp, human
ggcccgcggcaggtgagatg

SEQ ID NO: 35890 - DNA, 20 bp, human
gacggcggagaaggcgacag

SEQ ID NO: 35891 - DNA, 20 bp, human
gaccccaccttgcagccggg

SEQ ID NO: 35892 - DNA, 20 bp, human
gagccgcccggctgcaaggt

SEQ ID NO: 35893 - DNA, 20 bp, human
gtgcccagcgtcatcaccac

SEQ ID NO: 35894 - DNA, 20 bp, human
gtcgattagggccagtagga

SEQ ID NO: 35895 - DNA, 20 bp, human
gctccggccgtgagcagtcc

SEQ ID NO: 35896 - DNA, 20 bp, human
ggaacagcaatgcaatctgt

SEQ ID NO: 35897 - DNA, 20 bp, human
ggtcctaagacctgtcgcaa

SEQ ID NO: 35898 - DNA, 20 bp, human
gaatggataaaatccatccc

SEQ ID NO: 35899 - DNA, 20 bp, human
gggcgactgctcattctggg

SEQ ID NO: 35900 - DNA, 20 bp, human
ggacttttactatctctcct

SEQ ID NO: 35901 - DNA, 20 bp, human
gagccattgcgacaggtctt

SEQ ID NO: 35902 - DNA, 20 bp, human
gggcaaataagttgtaataa

SEQ ID NO: 35903 - DNA, 20 bp, human
gaagaggcgactgctcattc

SEQ ID NO: 35904 - DNA, 20 bp, human
gtacaacttatttgccacac

SEQ ID NO: 35905 - DNA, 20 bp, human
gagattaaagccattgcgac

SEQ ID NO: 35906 - DNA, 20 bp, human
ggagcagacccagccaagga

SEQ ID NO: 35907 - DNA, 20 bp, human
gtctgtggtgggagtgacta

SEQ ID NO: 35908 - DNA, 20 bp, human
gaaagaaaaggagcacgagt

SEQ ID NO: 35909 - DNA, 20 bp, human
gctcctgggaaggactttgg

SEQ ID NO: 35910 - DNA, 20 bp, human
gtgcaaaagtccagctcggg

SEQ ID NO: 35911 - DNA, 20 bp, human
ggaggtctgcgtggatcgag

SEQ ID NO: 35912 - DNA, 20 bp, human
gaggagggtagtggctgaag

SEQ ID NO: 35913 - DNA, 20 bp, human
gcctcatggtagcctcccat

SEQ ID NO: 35914 - DNA, 20 bp, human
ggcacgagtgggtcagtgac

SEQ ID NO: 35915 - DNA, 20 bp, human
gtcaaaggccttgcacacag

SEQ ID NO: 35916 - DNA, 20 bp, human
gggacggactgactcaccga

SEQ ID NO: 35917 - DNA, 20 bp, human
gcagccgcggcgagagcgta

SEQ ID NO: 35918 - DNA, 20 bp, human
ggccactagcagcccgaagg

SEQ ID NO: 35919 - DNA, 20 bp, human
gccgcggcagccatgtccat

SEQ ID NO: 35920 - DNA, 20 bp, human
gcaccgacggcgcgcgctaa

SEQ ID NO: 35921 - DNA, 20 bp, human
ggctccatacgctctcgccg

SEQ ID NO: 35922 - DNA, 20 bp, human
gcaaggcccgctccaccggg

SEQ ID NO: 35923 - DNA, 20 bp, human
gacggcgcgcgctaacggct

SEQ ID NO: 35924 - DNA, 20 bp, human
gccgggtgcggggagacgag

SEQ ID NO: 35925 - DNA, 20 bp, human
gggcaacgcgcagcacacga

SEQ ID NO: 35926 - DNA, 20 bp, human
ggctgtcggctggaaggaac

SEQ ID NO: 35927 - DNA, 20 bp, human
gttccagccgacagctgcca

SEQ ID NO: 35928 - DNA, 20 bp, human
gtgccagggcactctctctc

SEQ ID NO: 35929 - DNA, 20 bp, human
gctggcttgcgcatcaggac

SEQ ID NO: 35930 - DNA, 20 bp, human
gccatggggctacaggtaat

SEQ ID NO: 35931 - DNA, 20 bp, human
gtcccgtggacgctgaacaa

SEQ ID NO: 35932 - DNA, 20 bp, human
gacggccagccagcccagga

SEQ ID NO: 35933 - DNA, 20 bp, human
gctggtctgctcacacttgc

SEQ ID NO: 35934 - DNA, 20 bp, human
ggtcacctcgcagaccatct

SEQ ID NO: 35935 - DNA, 20 bp, human
gctgggcgtgctgctgtccg

SEQ ID NO: 35936 - DNA, 20 bp, human
gccccctacgagggcctcta

SEQ ID NO: 35937 - DNA, 20 bp, human
gcctacgagggcctctacgg

SEQ ID NO: 35938 - DNA, 20 bp, human
gggcaggagctggcagaccc

SEQ ID NO: 35939 - DNA, 20 bp, human
gctggagagcccccctacga

SEQ ID NO: 35940 - DNA, 20 bp, human
gccgcagcgttggagatcct

SEQ ID NO: 35941 - DNA, 20 bp, human
ggccgggagcgcgggcgcaa

SEQ ID NO: 35942 - DNA, 20 bp, human
gaggcaccagggcccgccca

SEQ ID NO: 35943 - DNA, 20 bp, human
gcttcaaagagggtaccccc

SEQ ID NO: 35944 - DNA, 20 bp, human
gaggaggtgcgacagacccg

SEQ ID NO: 35945 - DNA, 20 bp, human
gacccgcggggcaaacggac

SEQ ID NO: 35946 - DNA, 20 bp, human
gtcacctgcgaaggagataa

SEQ ID NO: 35947 - DNA, 20 bp, human
gaggccgagtgtcgggacag

SEQ ID NO: 35948 - DNA, 20 bp, human
gggcaggggcacactcagag

SEQ ID NO: 35949 - DNA, 20 bp, human
gtccttcgcaggtgagtccg

SEQ ID NO: 35950 - DNA, 20 bp, human
gcagctatagaacccctcca

SEQ ID NO: 35951 - DNA, 20 bp, human
gcaggctggggtggtcgggt

SEQ ID NO: 35952 - DNA, 20 bp, human
gccggggctagtgtgcgtgt

SEQ ID NO: 35953 - DNA, 20 bp, human
gccgagaggcaaggcaggtg

SEQ ID NO: 35954 - DNA, 20 bp, human
gcagtgcatgaaaaagaaag

SEQ ID NO: 35955 - DNA, 20 bp, human
gccgagtgtcgggacagggg

SEQ ID NO: 35956 - DNA, 20 bp, human
gccgaaggtgggatcgacca

SEQ ID NO: 35957 - DNA, 20 bp, human
ggcaagtcccaaagtatcct

SEQ ID NO: 35958 - DNA, 20 bp, human
gcatcaaggctcctaactgg

SEQ ID NO: 35959 - DNA, 20 bp, human
gcggcgccgaggcttgtcag

SEQ ID NO: 35960 - DNA, 20 bp, human
gaggtgggatcgaccagggt

SEQ ID NO: 35961 - DNA, 20 bp, human
gcgcagcagaggtggctcgg

SEQ ID NO: 35962 - DNA, 20 bp, human
gcggcatcaaggctcctaac

SEQ ID NO: 35963 - DNA, 20 bp, human
gcgccctcagaaaacactgg

SEQ ID NO: 35964 - DNA, 20 bp, human
gctgcggtgcgcagcagagg

SEQ ID NO: 35965 - DNA, 20 bp, human
gggctgtaggtccgaggctg

SEQ ID NO: 35966 - DNA, 20 bp, human
gtaatgaactcggaacccag

SEQ ID NO: 35967 - DNA, 20 bp, human
gggggacaatgagaaggtga

SEQ ID NO: 35968 - DNA, 20 bp, human
gtgcacgggggacaatgaga

SEQ ID NO: 35969 - DNA, 20 bp, human
gaaatgcaccaggtgcacgg

SEQ ID NO: 35970 - DNA, 20 bp, human
gctttcatgatggccatcct

SEQ ID NO: 35971 - DNA, 20 bp, human
gcgtgaggcaggctaacatc

SEQ ID NO: 35972 - DNA, 20 bp, human
ggttttagccagctggactc

SEQ ID NO: 35973 - DNA, 20 bp, human
gcggacctacaggcagccag

SEQ ID NO: 35974 - DNA, 20 bp, human
ggttccgagttcattactac

SEQ ID NO: 35975 - DNA, 20 bp, human
ggctctttctccggacctac

SEQ ID NO: 35976 - DNA, 20 bp, human
gcgccagccggcaggagacg

SEQ ID NO: 35977 - DNA, 20 bp, human
gcgaccggcttagaactgct

SEQ ID NO: 35978 - DNA, 20 bp, human
ggagagcccgcagagtcccc

SEQ ID NO: 35979 - DNA, 20 bp, human
gggcggcctaggtgactcag

SEQ ID NO: 35980 - DNA, 20 bp, human
ggagtcacctaggccgcctg

SEQ ID NO: 35981 - DNA, 20 bp, human
gactgtcagagtcgctcagt

SEQ ID NO: 35982 - DNA, 20 bp, human
ggctgagaagacctaaccga

SEQ ID NO: 35983 - DNA, 20 bp, human
ggaactgctgggcatgaccc

SEQ ID NO: 35984 - DNA, 20 bp, human
gacctaaccgaggggccaga

SEQ ID NO: 35985 - DNA, 20 bp, human
ggaccagaaacacctgcaag

SEQ ID NO: 35986 - DNA, 20 bp, human
gaggaggcgcggggagagta

SEQ ID NO: 35987 - DNA, 20 bp, human
gcccagggccgagccctcta

SEQ ID NO: 35988 - DNA, 20 bp, human
ggtgctgtggtctgagctag

SEQ ID NO: 35989 - DNA, 20 bp, human
gcagggaagtgcgtcagagg

SEQ ID NO: 35990 - DNA, 20 bp, human
gctgcagggaagtgcgtcag

SEQ ID NO: 35991 - DNA, 20 bp, human
ggaccaggccccgccctaga

SEQ ID NO: 35992 - DNA, 20 bp, human
gggatgggcggtgagtgagc

SEQ ID NO: 35993 - DNA, 20 bp, human
gttgagagcaccaggatgaa

SEQ ID NO: 35994 - DNA, 20 bp, human
ggtcccagcactgggaacgg

SEQ ID NO: 35995 - DNA, 20 bp, human
ggacctgcgtcgccgggcag

SEQ ID NO: 35996 - DNA, 20 bp, human
gctgtgtctaaggagcccta

SEQ ID NO: 35997 - DNA, 20 bp, human
gactcacacccagtgcccta

SEQ ID NO: 35998 - DNA, 20 bp, human
gctgcagccgggggccacaa

SEQ ID NO: 35999 - DNA, 20 bp, human
gcactgggtgtgagtcactt

SEQ ID NO: 36000 - DNA, 20 bp, human
gtaaggagccctagggcact

SEQ ID NO: 36001 - DNA, 20 bp, human
gacagagcccagagagacgg

SEQ ID NO: 36002 - DNA, 20 bp, human
gtctctgggctctgtgtcta

SEQ ID NO: 36003 - DNA, 20 bp, human
gtcacttaggtgggcctgtg

SEQ ID NO: 36004 - DNA, 20 bp, human
ggagcagaatgcccccactc

SEQ ID NO: 36005 - DNA, 20 bp, human
gctgtgtggaggggtgtctg

SEQ ID NO: 36006 - DNA, 20 bp, human
gtgggatgtcccagatgata

SEQ ID NO: 36007 - DNA, 20 bp, human
gactaagactccgggagctg

SEQ ID NO: 36008 - DNA, 20 bp, human
gcccaggagccctatcatct

SEQ ID NO: 36009 - DNA, 20 bp, human
gcggtgccggtgagacccag

SEQ ID NO: 36010 - DNA, 20 bp, human
ggtcttgggtctgaaatccc

SEQ ID NO: 36011 - DNA, 20 bp, human
gcctgtcccctgggtctcac

SEQ ID NO: 36012 - DNA, 20 bp, human
ggagctggggtagaggtgac

SEQ ID NO: 36013 - DNA, 20 bp, human
gtacctgtgggaggtctgga

SEQ ID NO: 36014 - DNA, 20 bp, human
gtcctggagagctggggtag

SEQ ID NO: 36015 - DNA, 20 bp, human
gtgctgcaaggaccagaggt

SEQ ID NO: 36016 - DNA, 20 bp, human
gaccggacagagacgaggag

SEQ ID NO: 36017 - DNA, 20 bp, human
gtagtctcagaggagtggga

SEQ ID NO: 36018 - DNA, 20 bp, human
gaacggaccggacagagacg

SEQ ID NO: 36019 - DNA, 20 bp, human
ggcgattgggatagtctcag

SEQ ID NO: 36020 - DNA, 20 bp, human
gggctagtgacctgcacaca

SEQ ID NO: 36021 - DNA, 20 bp, human
ggggagaatcgggaacctgg

SEQ ID NO: 36022 - DNA, 20 bp, human
gtggacaatgaggagcgatt

SEQ ID NO: 36023 - DNA, 20 bp, human
gagtgtcagggagctatggg

SEQ ID NO: 36024 - DNA, 20 bp, human
gggcactcggcagttcccag

SEQ ID NO: 36025 - DNA, 20 bp, human
ggtgcaggtcactagccccc

SEQ ID NO: 36026 - DNA, 20 bp, human
gtatgggtgattggtacagt

SEQ ID NO: 36027 - DNA, 20 bp, human
gggctcatttgcagacatat

SEQ ID NO: 36028 - DNA, 20 bp, human
gatgagccaaatctcatctg

SEQ ID NO: 36029 - DNA, 20 bp, human
gttgcagacatatgggtgat

SEQ ID NO: 36030 - DNA, 20 bp, human
ggtctcttatgtttaagcaa

SEQ ID NO: 36031 - DNA, 20 bp, human
gtaagtttgtataatagaag

SEQ ID NO: 36032 - DNA, 20 bp, human
gacagagctgaatgttaaac

SEQ ID NO: 36033 - DNA, 20 bp, human
gccagaaattggcaaatttg

SEQ ID NO: 36034 - DNA, 20 bp, human
ggggattttttccatctcac

SEQ ID NO: 36035 - DNA, 20 bp, human
gaaggtaagattttgagtta

SEQ ID NO: 36036 - DNA, 20 bp, human
gctaatctgcctggagacat

SEQ ID NO: 36037 - DNA, 20 bp, human
gtatctctaaggagaatatt

SEQ ID NO: 36038 - DNA, 20 bp, human
gtaacctaagaaaaagaggt

SEQ ID NO: 36039 - DNA, 20 bp, human
gtctaatgagaatatctcta

SEQ ID NO: 36040 - DNA, 20 bp, human
gcctctaccccgaggatcat

SEQ ID NO: 36041 - DNA, 20 bp, human
gagagacatggtgttggtaa

SEQ ID NO: 36042 - DNA, 20 bp, human
gcttgctgtgcagcaaagaa

SEQ ID NO: 36043 - DNA, 20 bp, human
gggaattcccatgatcctcg

SEQ ID NO: 36044 - DNA, 20 bp, human
ggaaataacctaagaaaaag

SEQ ID NO: 36045 - DNA, 20 bp, human
ggaagaccagctgtgtcctt

SEQ ID NO: 36046 - DNA, 20 bp, human
gagcgggacagatccaagtt

SEQ ID NO: 36047 - DNA, 20 bp, human
gacgccggcctcattctctg

SEQ ID NO: 36048 - DNA, 20 bp, human
ggccaggagaaaccccgcaa

SEQ ID NO: 36049 - DNA, 20 bp, human
ggggccagagcgcctgccag

SEQ ID NO: 36050 - DNA, 20 bp, human
ggcgcggtgcaggagcgttg

SEQ ID NO: 36051 - DNA, 20 bp, human
gggaggcacagggcgaacgc

SEQ ID NO: 36052 - DNA, 20 bp, human
ggcaccacgctaccatgaag

SEQ ID NO: 36053 - DNA, 20 bp, human
ggacacgctgcagtgggtgg

SEQ ID NO: 36054 - DNA, 20 bp, human
gggctgtcctccgaccccgg

SEQ ID NO: 36055 - DNA, 20 bp, human
gcgcagagctgctcccaact

SEQ ID NO: 36056 - DNA, 20 bp, human
ggtagcacaagcggaggatg

SEQ ID NO: 36057 - DNA, 20 bp, human
gcccgcggcggtagcacaag

SEQ ID NO: 36058 - DNA, 20 bp, human
ggcggcggtagcacaagcgg

SEQ ID NO: 36059 - DNA, 20 bp, human
gcacacagccaagagcgacg

SEQ ID NO: 36060 - DNA, 20 bp, human
gcgcgagcggccaaacatgt

SEQ ID NO: 36061 - DNA, 20 bp, human
ggctctaggaggcgtgagag

SEQ ID NO: 36062 - DNA, 20 bp, human
gtcatgccggaccagcagag

SEQ ID NO: 36063 - DNA, 20 bp, human
gccggctgaatgtcagtgct

SEQ ID NO: 36064 - DNA, 20 bp, human
gtccgggtcggggctctagg

SEQ ID NO: 36065 - DNA, 20 bp, human
ggaccacctcaagtgagtgt

SEQ ID NO: 36066 - DNA, 20 bp, human
gacctgacaagtggcagcca

SEQ ID NO: 36067 - DNA, 20 bp, human
ggcctgagtcggagagacag

SEQ ID NO: 36068 - DNA, 20 bp, human
gcagactgacaggtcgtcct

SEQ ID NO: 36069 - DNA, 20 bp, human
ggccctggctgccacttgtc

SEQ ID NO: 36070 - DNA, 20 bp, human
ggggtccgggtacccagtga

SEQ ID NO: 36071 - DNA, 20 bp, human
gattatgcatgtctagcaca

SEQ ID NO: 36072 - DNA, 20 bp, human
gtaggtgtggtcaggaccca

SEQ ID NO: 36073 - DNA, 20 bp, human
gcgacctgtcagtctgatgg

SEQ ID NO: 36074 - DNA, 20 bp, human
gggtacagaatccccaccat

SEQ ID NO: 36075 - DNA, 20 bp, human
gctgggtacccggacccacc

SEQ ID NO: 36076 - DNA, 20 bp, human
gcactcctcagagctcgtaa

SEQ ID NO: 36077 - DNA, 20 bp, human
ggctggtggacaaaagaggg

SEQ ID NO: 36078 - DNA, 20 bp, human
gctgggctggtggacaaaag

SEQ ID NO: 36079 - DNA, 20 bp, human
gaagccctgggacagcccgg

SEQ ID NO: 36080 - DNA, 20 bp, human
gtcatgccagcgccaacagg

SEQ ID NO: 36081 - DNA, 20 bp, human
gaggggtggatgctggactg

SEQ ID NO: 36082 - DNA, 20 bp, human
ggcgccaacaggaggctgtc

SEQ ID NO: 36083 - DNA, 20 bp, human
ggccctccttggcaccgcct

SEQ ID NO: 36084 - DNA, 20 bp, human
gaccagcccagcctgactcc

SEQ ID NO: 36085 - DNA, 20 bp, human
gtccaggagtcaggctgggc

SEQ ID NO: 36086 - DNA, 20 bp, human
gtgcagcactggaatgtccg

SEQ ID NO: 36087 - DNA, 20 bp, human
gagagacctcccctggccgg

SEQ ID NO: 36088 - DNA, 20 bp, human
ggggagcggaagccatcagt

SEQ ID NO: 36089 - DNA, 20 bp, human
gcaatcagcggggtctctgg

SEQ ID NO: 36090 - DNA, 20 bp, human
gatgtccgcgggccaatcag

SEQ ID NO: 36091 - DNA, 20 bp, human
gagatgcccccggccagggg

SEQ ID NO: 36092 - DNA, 20 bp, human
ggccctccttggcaccgcct

SEQ ID NO: 36093 - DNA, 20 bp, human
ggctggtggacaaaagaggg

SEQ ID NO: 36094 - DNA, 20 bp, human
gcacagccaggagatgcccc

SEQ ID NO: 36095 - DNA, 20 bp, human
ggctgcagattagtgaccga

SEQ ID NO: 36096 - DNA, 20 bp, human
ggctggtgaacaaaagaagg

SEQ ID NO: 36097 - DNA, 20 bp, human
ggggctggtggacaaaagag

SEQ ID NO: 36098 - DNA, 20 bp, human
ggtgaacaaaagaaggaggc

SEQ ID NO: 36099 - DNA, 20 bp, human
ggccctccttggcaccacct

SEQ ID NO: 36100 - DNA, 20 bp, human
gggggctggtgaacaaaaga

SEQ ID NO: 36101 - DNA, 20 bp, human
gaccagggctggggtcaagg

SEQ ID NO: 36102 - DNA, 20 bp, human
gaggggtggatgctggactg

SEQ ID NO: 36103 - DNA, 20 bp, human
gaagccctgggacagcccgg

SEQ ID NO: 36104 - DNA, 20 bp, human
ggcctgagaaacaagccggg

SEQ ID NO: 36105 - DNA, 20 bp, human
ggggtcaaggaggaacgccg

SEQ ID NO: 36106 - DNA, 20 bp, human
gcttctggtgagcagaaact

SEQ ID NO: 36107 - DNA, 20 bp, human
gctgtgcacggagtgcctga

SEQ ID NO: 36108 - DNA, 20 bp, human
ggcagcactggaatgtccgc

SEQ ID NO: 36109 - DNA, 20 bp, human
ggctggtggacaaaagaggg

SEQ ID NO: 36110 - DNA, 20 bp, human
gaaactgggcaagaccccag

SEQ ID NO: 36111 - DNA, 20 bp, human
gagccgaggtcctcctccca

SEQ ID NO: 36112 - DNA, 20 bp, human
ggcctgagaaacaagccggg

SEQ ID NO: 36113 - DNA, 20 bp, human
gaccagaaggaccatagccg

SEQ ID NO: 36114 - DNA, 20 bp, human
ggggagcggaagccatcagt

SEQ ID NO: 36115 - DNA, 20 bp, human
gcccccgacagcaggcagag

SEQ ID NO: 36116 - DNA, 20 bp, human
gatgcaaaggtggacactgt

SEQ ID NO: 36117 - DNA, 20 bp, human
ggtccaggattgctctccta

SEQ ID NO: 36118 - DNA, 20 bp, human
gaagcctctctcctccactc

SEQ ID NO: 36119 - DNA, 20 bp, human
gctagaaagttgggtcgcaa

SEQ ID NO: 36120 - DNA, 20 bp, human
ggaccctaggagagcaatcc

SEQ ID NO: 36121 - DNA, 20 bp, human
ggtggaggagagaggctttt

SEQ ID NO: 36122 - DNA, 20 bp, human
gaactttctagaagaagctg

SEQ ID NO: 36123 - DNA, 20 bp, human
gttgctctcctagggtcaga

SEQ ID NO: 36124 - DNA, 20 bp, human
gatcagtccaggtaagtgca

SEQ ID NO: 36125 - DNA, 20 bp, human
gaggcagataagataacatg

SEQ ID NO: 36126 - DNA, 20 bp, human
gtgcatctggattcctacag

SEQ ID NO: 36127 - DNA, 20 bp, human
gctagctcacagtagcccgg

SEQ ID NO: 36128 - DNA, 20 bp, human
gacagtagcccggcggccca

SEQ ID NO: 36129 - DNA, 20 bp, human
gtgagaatgcaggctcatgg

SEQ ID NO: 36130 - DNA, 20 bp, human
ggccaagtacagcagcacga

SEQ ID NO: 36131 - DNA, 20 bp, human
ggaactagctcacagtagcc

SEQ ID NO: 36132 - DNA, 20 bp, human
gtggtaatatacacaggact

SEQ ID NO: 36133 - DNA, 20 bp, human
gggctctggatgccgagttg

SEQ ID NO: 36134 - DNA, 20 bp, human
gagcagcacgagggacatgc

SEQ ID NO: 36135 - DNA, 20 bp, human
gaggttctaggtcctaaacc

SEQ ID NO: 36136 - DNA, 20 bp, human
gtcgagggcatagaagtcaa

SEQ ID NO: 36137 - DNA, 20 bp, human
gagtactcgggaagccatgc

SEQ ID NO: 36138 - DNA, 20 bp, human
gtcttaccggagatgagagc

SEQ ID NO: 36139 - DNA, 20 bp, human
gtgagctcagttgcagtact

SEQ ID NO: 36140 - DNA, 20 bp, human
gatagaagtcaaggggataa

SEQ ID NO: 36141 - DNA, 20 bp, human
ggatcttcctgtctttagta

SEQ ID NO: 36142 - DNA, 20 bp, human
gagggtagaaccatgtgaga

SEQ ID NO: 36143 - DNA, 20 bp, human
gtatccatcttcatcctgca

SEQ ID NO: 36144 - DNA, 20 bp, human
gaagcaattatttatggcat

SEQ ID NO: 36145 - DNA, 20 bp, human
gcctggaaaacaataagcaa

SEQ ID NO: 36146 - DNA, 20 bp, human
gcgcagctctggattaatca

SEQ ID NO: 36147 - DNA, 20 bp, human
gcgatggagatcagtaggag

SEQ ID NO: 36148 - DNA, 20 bp, human
gatggcaaggcgctaaccga

SEQ ID NO: 36149 - DNA, 20 bp, human
gttaatccagagctgcggga

SEQ ID NO: 36150 - DNA, 20 bp, human
gctaaccgatggagatcagt

SEQ ID NO: 36151 - DNA, 20 bp, human
gctaaagtaagtgagggatg

SEQ ID NO: 36152 - DNA, 20 bp, human
gatggcttcatacatcggat

SEQ ID NO: 36153 - DNA, 20 bp, human
gagctgatggcttcatacat

SEQ ID NO: 36154 - DNA, 20 bp, human
gctctgccatcccgcagctc

SEQ ID NO: 36155 - DNA, 20 bp, human
gctctggattaatcatggca

SEQ ID NO: 36156 - DNA, 20 bp, human
gcagcacagctccaaactag

SEQ ID NO: 36157 - DNA, 20 bp, human
gaagtggtatacctctagtt

SEQ ID NO: 36158 - DNA, 20 bp, human
gtgagaactgtatgagtatc

SEQ ID NO: 36159 - DNA, 20 bp, human
gcttgagcagttttaagtca

SEQ ID NO: 36160 - DNA, 20 bp, human
gaatttaattcttttctcga

SEQ ID NO: 36161 - DNA, 20 bp, human
gaagtaagtctgaatttatt

SEQ ID NO: 36162 - DNA, 20 bp, human
gttgagttactcttcaaaag

SEQ ID NO: 36163 - DNA, 20 bp, human
gtacattatttgaattacaa

SEQ ID NO: 36164 - DNA, 20 bp, human
gtcacaatttcaataaataa

SEQ ID NO: 36165 - DNA, 20 bp, human
gacgctgattaaaagaagca

SEQ ID NO: 36166 - DNA, 20 bp, human
ggatcactcatagaaactgg

SEQ ID NO: 36167 - DNA, 20 bp, human
ggttgagtagaaacttagta

SEQ ID NO: 36168 - DNA, 20 bp, human
gagagcccagcttcttacct

SEQ ID NO: 36169 - DNA, 20 bp, human
ggctctacagagtaagtgtg

SEQ ID NO: 36170 - DNA, 20 bp, human
gatgcatgacagtaacaatg

SEQ ID NO: 36171 - DNA, 20 bp, human
ggataccatcattattacat

SEQ ID NO: 36172 - DNA, 20 bp, human
gataggtagaaaacctatca

SEQ ID NO: 36173 - DNA, 20 bp, human
gtgatgggctcacacaggaa

SEQ ID NO: 36174 - DNA, 20 bp, human
gggtagaaaatagtatgtaa

SEQ ID NO: 36175 - DNA, 20 bp, human
gggtttgcaggcaattcaga

SEQ ID NO: 36176 - DNA, 20 bp, human
ggatccgggtcgggctacga

SEQ ID NO: 36177 - DNA, 20 bp, human
gcggctgtgcgtggaggctg

SEQ ID NO: 36178 - DNA, 20 bp, human
gtgaggcccgcggccccgag

SEQ ID NO: 36179 - DNA, 20 bp, human
gctgctgcggcgatccgggt

SEQ ID NO: 36180 - DNA, 20 bp, human
ggctccgcgcttaccctcca

SEQ ID NO: 36181 - DNA, 20 bp, human
gccccaggccggcctcgggt

SEQ ID NO: 36182 - DNA, 20 bp, human
gctacgagggcagcaccagc

SEQ ID NO: 36183 - DNA, 20 bp, human
gggcccgacccgcgacccgg

SEQ ID NO: 36184 - DNA, 20 bp, human
gccgcggcgctggcaggccg

SEQ ID NO: 36185 - DNA, 20 bp, human
gctcgggtgggctaggaccg

SEQ ID NO: 36186 - DNA, 20 bp, human
gagcccccttagagcagcta

SEQ ID NO: 36187 - DNA, 20 bp, human
gcgtcgagtgagaggtaatg

SEQ ID NO: 36188 - DNA, 20 bp, human
gtccttccatagctgctcta

SEQ ID NO: 36189 - DNA, 20 bp, human
gttctaggcttagacagtgt

SEQ ID NO: 36190 - DNA, 20 bp, human
gtctaagggggctggcaaca

SEQ ID NO: 36191 - DNA, 20 bp, human
gaccgaagatagtctcctgg

SEQ ID NO: 36192 - DNA, 20 bp, human
ggtggtctggtccaggagta

SEQ ID NO: 36193 - DNA, 20 bp, human
gtcctccaggagactatctt

SEQ ID NO: 36194 - DNA, 20 bp, human
gatcaccgaagatagtctcc

SEQ ID NO: 36195 - DNA, 20 bp, human
gatcttgctctgggatgcct

SEQ ID NO: 36196 - DNA, 20 bp, human
ggtgcagctctccctggtaa

SEQ ID NO: 36197 - DNA, 20 bp, human
gcatgctgctgcgcgggcgg

SEQ ID NO: 36198 - DNA, 20 bp, human
gccgaacgcagtgacagcca

SEQ ID NO: 36199 - DNA, 20 bp, human
gagacgtgcagcctgggccg

SEQ ID NO: 36200 - DNA, 20 bp, human
gcagcagcatggagctctgg

SEQ ID NO: 36201 - DNA, 20 bp, human
ggtggtgacctgggtcagga

SEQ ID NO: 36202 - DNA, 20 bp, human
ggcccaggctgcacgtctta

SEQ ID NO: 36203 - DNA, 20 bp, human
ggactcccaggccaaaggtt

SEQ ID NO: 36204 - DNA, 20 bp, human
ggcgcagcagcatggagctc

SEQ ID NO: 36205 - DNA, 20 bp, human
gagccctgtgccatcttcca

SEQ ID NO: 36206 - DNA, 20 bp, human
gaatcacttatgctgaagtg

SEQ ID NO: 36207 - DNA, 20 bp, human
gactctgcttactgaaacag

SEQ ID NO: 36208 - DNA, 20 bp, human
gctcaactagtggagagcag

SEQ ID NO: 36209 - DNA, 20 bp, human
gccttagctcagaactggag

SEQ ID NO: 36210 - DNA, 20 bp, human
gccccctgcatctggattga

SEQ ID NO: 36211 - DNA, 20 bp, human
gtgatttccgaagtcataat

SEQ ID NO: 36212 - DNA, 20 bp, human
gactcgccttagctcagaac

SEQ ID NO: 36213 - DNA, 20 bp, human
gagagtcccagaagattgag

SEQ ID NO: 36214 - DNA, 20 bp, human
gaggcacatatcctcaagag

SEQ ID NO: 36215 - DNA, 20 bp, human
ggcaggccactcaatcttct

SEQ ID NO: 36216 - DNA, 20 bp, human
gagggtgtgcgcacacacaa

SEQ ID NO: 36217 - DNA, 20 bp, human
gaagaagagcctcaagaccg

SEQ ID NO: 36218 - DNA, 20 bp, human
gagtgcttacctcggtcttg

SEQ ID NO: 36219 - DNA, 20 bp, human
gcctttggacttcctctatc

SEQ ID NO: 36220 - DNA, 20 bp, human
gacccaagatacttggatca

SEQ ID NO: 36221 - DNA, 20 bp, human
gactcatcttctcagttcta

SEQ ID NO: 36222 - DNA, 20 bp, human
gatcttctcagttctaggga

SEQ ID NO: 36223 - DNA, 20 bp, human
gtagtaggagcaggatggag

SEQ ID NO: 36224 - DNA, 20 bp, human
gaacaggcattgaggtgata

SEQ ID NO: 36225 - DNA, 20 bp, human
ggaggtgatagggatgactt

SEQ ID NO: 36226 - DNA, 20 bp, human
gatgtatattggaccaagag

SEQ ID NO: 36227 - DNA, 20 bp, human
gtgatacattccgggagatg

SEQ ID NO: 36228 - DNA, 20 bp, human
gagagactaattagacaatg

SEQ ID NO: 36229 - DNA, 20 bp, human
gtcttgttcaatggtcagga

SEQ ID NO: 36230 - DNA, 20 bp, human
gtgagctaactttcttatac

SEQ ID NO: 36231 - DNA, 20 bp, human
gccacagaaatatactctgg

SEQ ID NO: 36232 - DNA, 20 bp, human
gtatccacagaaatatactc

SEQ ID NO: 36233 - DNA, 20 bp, human
gtatattttatctcccctct

SEQ ID NO: 36234 - DNA, 20 bp, human
gaaaaatgacgttggtgaag

SEQ ID NO: 36235 - DNA, 20 bp, human
gaaggaaataaaaatgacgt

SEQ ID NO: 36236 - DNA, 20 bp, human
gcctgctggcctctagctaa

SEQ ID NO: 36237 - DNA, 20 bp, human
ggttttgttggtaagattca

SEQ ID NO: 36238 - DNA, 20 bp, human
gttggaacaagtgataaata

SEQ ID NO: 36239 - DNA, 20 bp, human
gctgtaaaatgtttaatggg

SEQ ID NO: 36240 - DNA, 20 bp, human
gctcctcaggagtgttttgt

SEQ ID NO: 36241 - DNA, 20 bp, human
gcaatgtattgcagaaaggg

SEQ ID NO: 36242 - DNA, 20 bp, human
gtagaggccagcaggctttc

SEQ ID NO: 36243 - DNA, 20 bp, human
ggacacaatgtattgcagaa

SEQ ID NO: 36244 - DNA, 20 bp, human
gcatctgaaacacaatgcac

SEQ ID NO: 36245 - DNA, 20 bp, human
gatagctctcccttagctag

SEQ ID NO: 36246 - DNA, 20 bp, human
ggagcagtgctggaggatca

SEQ ID NO: 36247 - DNA, 20 bp, human
gcagccactggctcctggaa

SEQ ID NO: 36248 - DNA, 20 bp, human
ggggccgtcccgtggaccaa

SEQ ID NO: 36249 - DNA, 20 bp, human
gcagcactgctcccagccac

SEQ ID NO: 36250 - DNA, 20 bp, human
gctgccattggtccacggga

SEQ ID NO: 36251 - DNA, 20 bp, human
gtccacgggacggcccttcc

SEQ ID NO: 36252 - DNA, 20 bp, human
gccccaaggacaagggtctg

SEQ ID NO: 36253 - DNA, 20 bp, human
gccagagctagatgtggata

SEQ ID NO: 36254 - DNA, 20 bp, human
gggcaggctactccctcact

SEQ ID NO: 36255 - DNA, 20 bp, human
gtcctggaagggccgtcccg

SEQ ID NO: 36256 - DNA, 20 bp, human
gggagtaactcaggcctcca

SEQ ID NO: 36257 - DNA, 20 bp, human
gatacctccggggacctcct

SEQ ID NO: 36258 - DNA, 20 bp, human
gctgggtgcctgcatcgcca

SEQ ID NO: 36259 - DNA, 20 bp, human
gtgttgcatccggcccccct

SEQ ID NO: 36260 - DNA, 20 bp, human
ggcgtaggtccagtgagaac

SEQ ID NO: 36261 - DNA, 20 bp, human
gctggtcaccacagtccttt

SEQ ID NO: 36262 - DNA, 20 bp, human
gagcaggagacccctcttct

SEQ ID NO: 36263 - DNA, 20 bp, human
gttatatctctgcccaggac

SEQ ID NO: 36264 - DNA, 20 bp, human
gcgagacaggccagggttgt

SEQ ID NO: 36265 - DNA, 20 bp, human
ggggagggaagagtcgagac

SEQ ID NO: 36266 - DNA, 20 bp, human
gggactcctgggacctacag

SEQ ID NO: 36267 - DNA, 20 bp, human
gagtgactccaaggaaccaa

SEQ ID NO: 36268 - DNA, 20 bp, human
gcaggagtcctgaacatctg

SEQ ID NO: 36269 - DNA, 20 bp, human
gctgggacctacagaggtgg

SEQ ID NO: 36270 - DNA, 20 bp, human
gagagttagggagcagatag

SEQ ID NO: 36271 - DNA, 20 bp, human
ggaactcctcacacctgggg

SEQ ID NO: 36272 - DNA, 20 bp, human
gctacaggtaggcaagagtt

SEQ ID NO: 36273 - DNA, 20 bp, human
gtcctgaagaggacggggta

SEQ ID NO: 36274 - DNA, 20 bp, human
gcctgaacatctggggacag

SEQ ID NO: 36275 - DNA, 20 bp, human
gttccaacccccacctctgt

SEQ ID NO: 36276 - DNA, 20 bp, human
gggtaggtgacagacaggac

SEQ ID NO: 36277 - DNA, 20 bp, human
gaaggcagagactgtgaaga

SEQ ID NO: 36278 - DNA, 20 bp, human
gccaggaggtgacccagcgt

SEQ ID NO: 36279 - DNA, 20 bp, human
gatttaggaggccacaaata

SEQ ID NO: 36280 - DNA, 20 bp, human
gggaggccacaaatagggca

SEQ ID NO: 36281 - DNA, 20 bp, human
gagaaggaagaacgttgctt

SEQ ID NO: 36282 - DNA, 20 bp, human
gtttcttggggatgctacca

SEQ ID NO: 36283 - DNA, 20 bp, human
gcacaaatagggcaaggctg

SEQ ID NO: 36284 - DNA, 20 bp, human
ggagcaggcggggcaaagaa

SEQ ID NO: 36285 - DNA, 20 bp, human
gtgcttggtgtggcaggcag

SEQ ID NO: 36286 - DNA, 20 bp, human
gccctgtgttgagaaggtcc

SEQ ID NO: 36287 - DNA, 20 bp, human
gcagggaaataactgattat

SEQ ID NO: 36288 - DNA, 20 bp, human
gaactgctacacactcttat

SEQ ID NO: 36289 - DNA, 20 bp, human
gtggaaagagtactgcttcc

SEQ ID NO: 36290 - DNA, 20 bp, human
gagcagcaacctcaaagtac

SEQ ID NO: 36291 - DNA, 20 bp, human
gaccaatatagtagactcaa

SEQ ID NO: 36292 - DNA, 20 bp, human
gtttgaggtacacttaatgt

SEQ ID NO: 36293 - DNA, 20 bp, human
gtctctgggcaacatcttta

SEQ ID NO: 36294 - DNA, 20 bp, human
gtttaaagaagctagagctc

SEQ ID NO: 36295 - DNA, 20 bp, human
gagctcttcaatctgttctt

SEQ ID NO: 36296 - DNA, 20 bp, human
ggtccacagacagtcatctc

SEQ ID NO: 36297 - DNA, 20 bp, human
gtctctgagtcaaatcatgt

SEQ ID NO: 36298 - DNA, 20 bp, human
gatgtgggctaggtacttac

SEQ ID NO: 36299 - DNA, 20 bp, human
gtttcaaacgggagagctaa

SEQ ID NO: 36300 - DNA, 20 bp, human
gaaatgctatatctattcag

SEQ ID NO: 36301 - DNA, 20 bp, human
gcgactctcaaagcaatacc

SEQ ID NO: 36302 - DNA, 20 bp, human
gtctgaaacaacagctatcc

SEQ ID NO: 36303 - DNA, 20 bp, human
gtttgaaaagatataagggg

SEQ ID NO: 36304 - DNA, 20 bp, human
gagcttaatttgttaaactc

SEQ ID NO: 36305 - DNA, 20 bp, human
gcccgtttgaaaagatataa

SEQ ID NO: 36306 - DNA, 20 bp, human
gggaaagggcattctaggtt

SEQ ID NO: 36307 - DNA, 20 bp, human
gcagaagaggtaagaaccac

SEQ ID NO: 36308 - DNA, 20 bp, human
gtgccacagccgggtacaaa

SEQ ID NO: 36309 - DNA, 20 bp, human
ggtaagaaccactggcagta

SEQ ID NO: 36310 - DNA, 20 bp, human
gcgggacttccgtttgtacc

SEQ ID NO: 36311 - DNA, 20 bp, human
gaccacagattgccacagcc

SEQ ID NO: 36312 - DNA, 20 bp, human
gttccgtttgtacccggctg

SEQ ID NO: 36313 - DNA, 20 bp, human
gagaaccactggcagtaggg

SEQ ID NO: 36314 - DNA, 20 bp, human
gccactggcagtagggtgga

SEQ ID NO: 36315 - DNA, 20 bp, human
gataagaaaggcatgattaa

SEQ ID NO: 36316 - DNA, 20 bp, human
ggggctatcccactgaagag

SEQ ID NO: 36317 - DNA, 20 bp, human
ggtggagaaggattaagtaa

SEQ ID NO: 36318 - DNA, 20 bp, human
gaaaactggcaagatctcat

SEQ ID NO: 36319 - DNA, 20 bp, human
gtccgagataatctacctaa

SEQ ID NO: 36320 - DNA, 20 bp, human
gctcattggcctagagttgt

SEQ ID NO: 36321 - DNA, 20 bp, human
ggttggaagacagacatttc

SEQ ID NO: 36322 - DNA, 20 bp, human
gcactatagccaacaactct

SEQ ID NO: 36323 - DNA, 20 bp, human
gaatatacacctctcttcag

SEQ ID NO: 36324 - DNA, 20 bp, human
gcggacattacagtaccctt

SEQ ID NO: 36325 - DNA, 20 bp, human
gacccttaggtagattatct

SEQ ID NO: 36326 - DNA, 20 bp, human
gttccttctgctccccaagt

SEQ ID NO: 36327 - DNA, 20 bp, human
gaggaagtccaccacccact

SEQ ID NO: 36328 - DNA, 20 bp, human
gggaaacgcgagttctaacg

SEQ ID NO: 36329 - DNA, 20 bp, human
ggcttaccagatctctgaag

SEQ ID NO: 36330 - DNA, 20 bp, human
ggtaaaatcttaattctcaa

SEQ ID NO: 36331 - DNA, 20 bp, human
gctacatattaaaaccaaag

SEQ ID NO: 36332 - DNA, 20 bp, human
gtgttcagtcttactaatca

SEQ ID NO: 36333 - DNA, 20 bp, human
gtggttttgtcatttattca

SEQ ID NO: 36334 - DNA, 20 bp, human
gatctggtaagctggattta

SEQ ID NO: 36335 - DNA, 20 bp, human
gcgctgacatcaaaactgtt

SEQ ID NO: 36336 - DNA, 20 bp, human
gtaacggcctcggctcccgg

SEQ ID NO: 36337 - DNA, 20 bp, human
gaagagacgcggggaccaag

SEQ ID NO: 36338 - DNA, 20 bp, human
gggactggtctgaagagacg

SEQ ID NO: 36339 - DNA, 20 bp, human
gtggctcctcaagcccgcag

SEQ ID NO: 36340 - DNA, 20 bp, human
ggccgaggccgttattccag

SEQ ID NO: 36341 - DNA, 20 bp, human
gaccggtcggggccaagtga

SEQ ID NO: 36342 - DNA, 20 bp, human
gttcagaccagtcccgccgg

SEQ ID NO: 36343 - DNA, 20 bp, human
gggaccaagtggcaacgact

SEQ ID NO: 36344 - DNA, 20 bp, human
ggaccggttcagccctctgg

SEQ ID NO: 36345 - DNA, 20 bp, human
gcccgaccggttcagccctc

SEQ ID NO: 36346 - DNA, 20 bp, human
gacgctccttgggccttcaa

SEQ ID NO: 36347 - DNA, 20 bp, human
ggactggaggtaggatgaag

SEQ ID NO: 36348 - DNA, 20 bp, human
gtaggctgggagagactcgg

SEQ ID NO: 36349 - DNA, 20 bp, human
gcccagcctagggaagagtc

SEQ ID NO: 36350 - DNA, 20 bp, human
ggatagtaactagggaatct

SEQ ID NO: 36351 - DNA, 20 bp, human
gtatctctaagcactgaagt

SEQ ID NO: 36352 - DNA, 20 bp, human
gtgcttagagatagtaacta

SEQ ID NO: 36353 - DNA, 20 bp, human
gtgtttggagaaaaggactc

SEQ ID NO: 36354 - DNA, 20 bp, human
ggtaggatgaagcggaataa

SEQ ID NO: 36355 - DNA, 20 bp, human
gattaaagcgtgtcacacta

SEQ ID NO: 36356 - DNA, 20 bp, human
ggggatttgattggcgcagt

SEQ ID NO: 36357 - DNA, 20 bp, human
gggtgtttcaaataaataag

SEQ ID NO: 36358 - DNA, 20 bp, human
gctctgatccagcccgggag

SEQ ID NO: 36359 - DNA, 20 bp, human
ggggccggtcggtgagtcag

SEQ ID NO: 36360 - DNA, 20 bp, human
gcgggagaggaccgagctgg

SEQ ID NO: 36361 - DNA, 20 bp, human
gagagtgcacgtgggattgg

SEQ ID NO: 36362 - DNA, 20 bp, human
ggcccgggagaggaccgagc

SEQ ID NO: 36363 - DNA, 20 bp, human
gctggtccccgacgcaacca

SEQ ID NO: 36364 - DNA, 20 bp, human
gaggaagtggccgtccctgg

SEQ ID NO: 36365 - DNA, 20 bp, human
ggtgagtagtgcagtaggag

SEQ ID NO: 36366 - DNA, 20 bp, human
gtagtggactgagtcagacc

SEQ ID NO: 36367 - DNA, 20 bp, human
gctgcggcccggcactcaag

SEQ ID NO: 36368 - DNA, 20 bp, human
ggtattgtggactctacagg

SEQ ID NO: 36369 - DNA, 20 bp, human
gaagaccgtctagcttgtag

SEQ ID NO: 36370 - DNA, 20 bp, human
gagatgtcaggcctgcggcc

SEQ ID NO: 36371 - DNA, 20 bp, human
gccacatttgggctagagat

SEQ ID NO: 36372 - DNA, 20 bp, human
gcagtccactacaagctaga

SEQ ID NO: 36373 - DNA, 20 bp, human
gtgaaaaaggcaaggtgata

SEQ ID NO: 36374 - DNA, 20 bp, human
gggactctacaggaggcagg

SEQ ID NO: 36375 - DNA, 20 bp, human
gccaaagactcaagtaatgt

SEQ ID NO: 36376 - DNA, 20 bp, human
ggactcaggcagccctacag

SEQ ID NO: 36377 - DNA, 20 bp, human
gcaacagtggagcttacggt

SEQ ID NO: 36378 - DNA, 20 bp, human
gccccacccgcgcctgaccg

SEQ ID NO: 36379 - DNA, 20 bp, human
gccaagcaggctgccaacag

SEQ ID NO: 36380 - DNA, 20 bp, human
gcccgacctgagagctgatg

SEQ ID NO: 36381 - DNA, 20 bp, human
ggcttggtctccgccatggt

SEQ ID NO: 36382 - DNA, 20 bp, human
gacagggagtccaacaccgc

SEQ ID NO: 36383 - DNA, 20 bp, human
gcaagtcaagggccctcact

SEQ ID NO: 36384 - DNA, 20 bp, human
gtggagcttggtctccgcca

SEQ ID NO: 36385 - DNA, 20 bp, human
gcgctgtcatagagcaggat

SEQ ID NO: 36386 - DNA, 20 bp, human
gtgggtcgggaagagcccac

SEQ ID NO: 36387 - DNA, 20 bp, human
gtccagcgcgtaggcatcgg

SEQ ID NO: 36388 - DNA, 20 bp, human
gagtccagcgagcagcacgg

SEQ ID NO: 36389 - DNA, 20 bp, human
ggcaggcaagtcccgcccgt

SEQ ID NO: 36390 - DNA, 20 bp, human
ggtctccagcgcgtaggcat

SEQ ID NO: 36391 - DNA, 20 bp, human
ggccaccgtctccagcgcgt

SEQ ID NO: 36392 - DNA, 20 bp, human
ggccgtggccagctcgacgc

SEQ ID NO: 36393 - DNA, 20 bp, human
gtgctgctcgctggactgtc

SEQ ID NO: 36394 - DNA, 20 bp, human
gcctccgagggcccgtcgag

SEQ ID NO: 36395 - DNA, 20 bp, human
gtcccgcgcccgggtgggtc

SEQ ID NO: 36396 - DNA, 20 bp, human
ggcgcaccccgagccctggt

SEQ ID NO: 36397 - DNA, 20 bp, human
gccgccgggctcacccacca

SEQ ID NO: 36398 - DNA, 20 bp, human
gcgtgggagcaacaagtgcc

SEQ ID NO: 36399 - DNA, 20 bp, human
ggggaatgacaacaggtcgt

SEQ ID NO: 36400 - DNA, 20 bp, human
gggctgcccggaggtgtcac

SEQ ID NO: 36401 - DNA, 20 bp, human
ggcgggatcgctgacagtcg

SEQ ID NO: 36402 - DNA, 20 bp, human
ggcggatcctgtgacacctc

SEQ ID NO: 36403 - DNA, 20 bp, human
gccagcggggctcctcttca

SEQ ID NO: 36404 - DNA, 20 bp, human
gccgccctcctgggagggtc

SEQ ID NO: 36405 - DNA, 20 bp, human
gaaggccacgggggagcaca

SEQ ID NO: 36406 - DNA, 20 bp, human
ggcgggccgggcacttccaa

SEQ ID NO: 36407 - DNA, 20 bp, human
ggccgcggaggtgcagtgca

SEQ ID NO: 36408 - DNA, 20 bp, human
ggtgcagtgcacggctggag

SEQ ID NO: 36409 - DNA, 20 bp, human
gggttgccccgggtccccag

SEQ ID NO: 36410 - DNA, 20 bp, human
gctggtcaaccccaggacag

SEQ ID NO: 36411 - DNA, 20 bp, human
gaccccaggacagcggacag

SEQ ID NO: 36412 - DNA, 20 bp, human
gcggaggtgcagtgcacggc

SEQ ID NO: 36413 - DNA, 20 bp, human
gcgggcacttccaaaggcgc

SEQ ID NO: 36414 - DNA, 20 bp, human
gggagtcccgatcaaggaca

SEQ ID NO: 36415 - DNA, 20 bp, human
gcgccggctccgggatcctg

SEQ ID NO: 36416 - DNA, 20 bp, human
ggcctggaactgccccggta

SEQ ID NO: 36417 - DNA, 20 bp, human
gccccggcctggaactgccc

SEQ ID NO: 36418 - DNA, 20 bp, human
gcaaaggaaggagctgactg

SEQ ID NO: 36419 - DNA, 20 bp, human
gtgactgggggagttcgagg

SEQ ID NO: 36420 - DNA, 20 bp, human
gccgctgctgtggcaaagga

SEQ ID NO: 36421 - DNA, 20 bp, human
gcgtctcgacgtgtcaccgg

SEQ ID NO: 36422 - DNA, 20 bp, human
gccaaagcgtcggcacccag

SEQ ID NO: 36423 - DNA, 20 bp, human
gacaaagcgtgagtatcggg

SEQ ID NO: 36424 - DNA, 20 bp, human
ggagccagggggcgtgacgt

SEQ ID NO: 36425 - DNA, 20 bp, human
gagctgactgggggagttcg

SEQ ID NO: 36426 - DNA, 20 bp, human
gtgggccccggggcggatgt

SEQ ID NO: 36427 - DNA, 20 bp, human
gtgggacaggtggcggcgac

SEQ ID NO: 36428 - DNA, 20 bp, human
gggatcggccggaccccggg

SEQ ID NO: 36429 - DNA, 20 bp, human
gcggccacccgagactcccg

SEQ ID NO: 36430 - DNA, 20 bp, human
gtcctccgcccgcctcaaga

SEQ ID NO: 36431 - DNA, 20 bp, human
ggcccggcttcggcctcccg

SEQ ID NO: 36432 - DNA, 20 bp, human
gaggggaccgcgggagtctc

SEQ ID NO: 36433 - DNA, 20 bp, human
gtcgcgcgccggagccgtcc

SEQ ID NO: 36434 - DNA, 20 bp, human
gcgatcccacatccgccccg

SEQ ID NO: 36435 - DNA, 20 bp, human
ggagtccaagctccatcttg

SEQ ID NO: 36436 - DNA, 20 bp, human
gcgcgcccgggcccgagagg

SEQ ID NO: 36437 - DNA, 20 bp, human
gtcgcgcgggcaacaaagga

SEQ ID NO: 36438 - DNA, 20 bp, human
gcgcccgtacccccttccaa

SEQ ID NO: 36439 - DNA, 20 bp, human
ggagggtagggaccccgatg

SEQ ID NO: 36440 - DNA, 20 bp, human
gacgcgccgcagggctctct

SEQ ID NO: 36441 - DNA, 20 bp, human
gggggtcgcgcgggcaacaa

SEQ ID NO: 36442 - DNA, 20 bp, human
gaaggacggagagatgcggg

SEQ ID NO: 36443 - DNA, 20 bp, human
gctccgggagggaacaaaag

SEQ ID NO: 36444 - DNA, 20 bp, human
gaggagggggtgcagccggt

SEQ ID NO: 36445 - DNA, 20 bp, human
ggggcgaccctccaacagaa

SEQ ID NO: 36446 - DNA, 20 bp, human
ggccttcaggcaaatcctgg

SEQ ID NO: 36447 - DNA, 20 bp, human
gggagactgtgggagcaatg

SEQ ID NO: 36448 - DNA, 20 bp, human
ggcgtcaggcccctcagtcg

SEQ ID NO: 36449 - DNA, 20 bp, human
gaggcccagacgccgacagg

SEQ ID NO: 36450 - DNA, 20 bp, human
ggcacctgcccccctcccta

SEQ ID NO: 36451 - DNA, 20 bp, human
ggccccgccaccccgaggag

SEQ ID NO: 36452 - DNA, 20 bp, human
ggcagccttcaggcaaatcc

SEQ ID NO: 36453 - DNA, 20 bp, human
gcggtgtcaggggacgtgat

SEQ ID NO: 36454 - DNA, 20 bp, human
ggggaccaaagtggagactg

SEQ ID NO: 36455 - DNA, 20 bp, human
gctccagggtccaagcccct

SEQ ID NO: 36456 - DNA, 20 bp, human
gcgacaccggtgcccacggg

SEQ ID NO: 36457 - DNA, 20 bp, human
gcagcgacaccggtgcccac

SEQ ID NO: 36458 - DNA, 20 bp, human
ggcgcggaggaaaggccgag

SEQ ID NO: 36459 - DNA, 20 bp, human
gccgctccgagaggacccgg

SEQ ID NO: 36460 - DNA, 20 bp, human
gtccccgcggccagcgacac

SEQ ID NO: 36461 - DNA, 20 bp, human
gcacgcgctggggactcggt

SEQ ID NO: 36462 - DNA, 20 bp, human
gctccgagaggacccggagg

SEQ ID NO: 36463 - DNA, 20 bp, human
gaggctccgtgggcggccac

SEQ ID NO: 36464 - DNA, 20 bp, human
ggcgcgcgcccaccccgcgt

SEQ ID NO: 36465 - DNA, 20 bp, human
gccgcggggaggccttctcg

SEQ ID NO: 36466 - DNA, 20 bp, human
gcggcggagctgtaagatgg

SEQ ID NO: 36467 - DNA, 20 bp, human
gcctcggcggagctgtaaga

SEQ ID NO: 36468 - DNA, 20 bp, human
gtgtgcagcctgggagtgaa

SEQ ID NO: 36469 - DNA, 20 bp, human
gaagcttgtaacgcaatcac

SEQ ID NO: 36470 - DNA, 20 bp, human
gcgcctgacgcgggacggtc

SEQ ID NO: 36471 - DNA, 20 bp, human
ggccgaggcggttcacaaca

SEQ ID NO: 36472 - DNA, 20 bp, human
gtcggccgcgcaggaaagag

SEQ ID NO: 36473 - DNA, 20 bp, human
gggcggcgccgcttcctcag

SEQ ID NO: 36474 - DNA, 20 bp, human
ggacaaagactccaagtcga

SEQ ID NO: 36475 - DNA, 20 bp, human
ggagggcagaagctccaaga

SEQ ID NO: 36476 - DNA, 20 bp, human
gcgtacgtgctcgctcacgg

SEQ ID NO: 36477 - DNA, 20 bp, human
gcggagaccgagctgggatc

SEQ ID NO: 36478 - DNA, 20 bp, human
ggtgcgtacgtgctcgctca

SEQ ID NO: 36479 - DNA, 20 bp, human
gacgtgctcgctcacggcgg

SEQ ID NO: 36480 - DNA, 20 bp, human
gacgggggcgagatttggag

SEQ ID NO: 36481 - DNA, 20 bp, human
ggaagacctgtaggaagctt

SEQ ID NO: 36482 - DNA, 20 bp, human
gggcgccaagcagatcttag

SEQ ID NO: 36483 - DNA, 20 bp, human
gtgctcgctcacggcggcgg

SEQ ID NO: 36484 - DNA, 20 bp, human
ggacctgtaggaagcttggg

SEQ ID NO: 36485 - DNA, 20 bp, human
gatgtaccaagaagacctgt

SEQ ID NO: 36486 - DNA, 20 bp, human
gcctgggagacggtaagtgt

SEQ ID NO: 36487 - DNA, 20 bp, human
gcttaccgtctcccaggctc

SEQ ID NO: 36488 - DNA, 20 bp, human
ggcggaagaggcgctcggag

SEQ ID NO: 36489 - DNA, 20 bp, human
gctgcagtgaccgccctccg

SEQ ID NO: 36490 - DNA, 20 bp, human
gtcaaactccaggccgccaa

SEQ ID NO: 36491 - DNA, 20 bp, human
gagaggtcgcggcccgatat

SEQ ID NO: 36492 - DNA, 20 bp, human
gaactccaggccgccaaggg

SEQ ID NO: 36493 - DNA, 20 bp, human
gacagagggaaagccggact

SEQ ID NO: 36494 - DNA, 20 bp, human
gaggcgctcggagcggggag

SEQ ID NO: 36495 - DNA, 20 bp, human
gggagtaggccgagaccgaa

SEQ ID NO: 36496 - DNA, 20 bp, human
gccaggggtgcccctcgcag

SEQ ID NO: 36497 - DNA, 20 bp, human
ggcagaggcgcagcctgtag

SEQ ID NO: 36498 - DNA, 20 bp, human
ggcggagggagatccactac

SEQ ID NO: 36499 - DNA, 20 bp, human
gggtgtgcggaggagcccaa

SEQ ID NO: 36500 - DNA, 20 bp, human
ggggtctctgggaaacggaa

SEQ ID NO: 36501 - DNA, 20 bp, human
gctctgggaaacggaatgga

SEQ ID NO: 36502 - DNA, 20 bp, human
ggtgcccctcgcaggggcag

SEQ ID NO: 36503 - DNA, 20 bp, human
ggccgggcttggacacagtg

SEQ ID NO: 36504 - DNA, 20 bp, human
gtctcctcactgggcggggt

SEQ ID NO: 36505 - DNA, 20 bp, human
gccgaagccagtcaggctaa

SEQ ID NO: 36506 - DNA, 20 bp, human
ggcccaggccaggaatccag

SEQ ID NO: 36507 - DNA, 20 bp, human
gggcgactcgggggattcta

SEQ ID NO: 36508 - DNA, 20 bp, human
ggctggaagaggtcccgaca

SEQ ID NO: 36509 - DNA, 20 bp, human
ggcgggcgctaggacctgtc

SEQ ID NO: 36510 - DNA, 20 bp, human
gttgtcgcagcggccgagga

SEQ ID NO: 36511 - DNA, 20 bp, human
gaggtctccgagccaggtgt

SEQ ID NO: 36512 - DNA, 20 bp, human
ggccagagacggctctcgaa

SEQ ID NO: 36513 - DNA, 20 bp, human
gtctcgaagggtctcccgac

SEQ ID NO: 36514 - DNA, 20 bp, human
gcgacaaacaccccacaaaa

SEQ ID NO: 36515 - DNA, 20 bp, human
gggtgctagaggcgactcgg

SEQ ID NO: 36516 - DNA, 20 bp, human
gggtttgctctaatttcttc

SEQ ID NO: 36517 - DNA, 20 bp, human
gactgtgcatatgaatcccg

SEQ ID NO: 36518 - DNA, 20 bp, human
gtgccgagggcttgttaaaa

SEQ ID NO: 36519 - DNA, 20 bp, human
gcagcatcagaatctgccga

SEQ ID NO: 36520 - DNA, 20 bp, human
gatgtgatttgtggaatctg

SEQ ID NO: 36521 - DNA, 20 bp, human
gtgcctttttaacaagccct

SEQ ID NO: 36522 - DNA, 20 bp, human
gagtaggatataacatattt

SEQ ID NO: 36523 - DNA, 20 bp, human
gtttcattgcagttagctaa

SEQ ID NO: 36524 - DNA, 20 bp, human
gtataacatatttgggttga

SEQ ID NO: 36525 - DNA, 20 bp, human
gtgagaaatagaaatatcag

SEQ ID NO: 36526 - DNA, 20 bp, human
gcttaccagtggcagtctta

SEQ ID NO: 36527 - DNA, 20 bp, human
gctgccactggtaagtaaca

SEQ ID NO: 36528 - DNA, 20 bp, human
gcactgtagaccctcactgt

SEQ ID NO: 36529 - DNA, 20 bp, human
gttggggcacaacgaactta

SEQ ID NO: 36530 - DNA, 20 bp, human
gtaattagaaccccacagtg

SEQ ID NO: 36531 - DNA, 20 bp, human
ggctctatttctgctggtat

SEQ ID NO: 36532 - DNA, 20 bp, human
gttagcttatgttcatgatt

SEQ ID NO: 36533 - DNA, 20 bp, human
gaacccctgttacttaccag

SEQ ID NO: 36534 - DNA, 20 bp, human
gaatgccttaagactgccac

SEQ ID NO: 36535 - DNA, 20 bp, human
ggttcatctgtagaaggggt

SEQ ID NO: 36536 - DNA, 20 bp, human
gggtggcccaggttagggag

SEQ ID NO: 36537 - DNA, 20 bp, human
ggggagagcccgggccagcg

SEQ ID NO: 36538 - DNA, 20 bp, human
ggcccaggctcgccccggga

SEQ ID NO: 36539 - DNA, 20 bp, human
gcgagcgcccagccatcccg

SEQ ID NO: 36540 - DNA, 20 bp, human
ggagttgccaagtgtcggag

SEQ ID NO: 36541 - DNA, 20 bp, human
gcaggtttacagttgcccag

SEQ ID NO: 36542 - DNA, 20 bp, human
gtacagttgcccagggggtg

SEQ ID NO: 36543 - DNA, 20 bp, human
gcgccgcgactccagctccg

SEQ ID NO: 36544 - DNA, 20 bp, human
gcccacaacacacacacgtg

SEQ ID NO: 36545 - DNA, 20 bp, human
gcgcgcgagcggcacgcacc

SEQ ID NO: 36546 - DNA, 20 bp, human
gaaaagccggctgactccag

SEQ ID NO: 36547 - DNA, 20 bp, human
gggaaaagtgttccacgaag

SEQ ID NO: 36548 - DNA, 20 bp, human
gcagctcgcccgaggtccgt

SEQ ID NO: 36549 - DNA, 20 bp, human
gaggaaaacgcgaggcgaaa

SEQ ID NO: 36550 - DNA, 20 bp, human
gctgcgtccgggaaagacgc

SEQ ID NO: 36551 - DNA, 20 bp, human
gaaaaggcgctaccgcttcg

SEQ ID NO: 36552 - DNA, 20 bp, human
gctaggtgagtgcctctggg

SEQ ID NO: 36553 - DNA, 20 bp, human
gcaccagctggcgcccggac

SEQ ID NO: 36554 - DNA, 20 bp, human
gaaagacgccggttctgacc

SEQ ID NO: 36555 - DNA, 20 bp, human
gctcgcccgaggtccgtcgg

SEQ ID NO: 36556 - DNA, 20 bp, human
gagggtccctgctgtagacg

SEQ ID NO: 36557 - DNA, 20 bp, human
gcggtcgtgcacctgagagt

SEQ ID NO: 36558 - DNA, 20 bp, human
ggtgggctgcgagccagagg

SEQ ID NO: 36559 - DNA, 20 bp, human
gctcatggaacgaccacctc

SEQ ID NO: 36560 - DNA, 20 bp, human
gcttaaaggtacaggcctca

SEQ ID NO: 36561 - DNA, 20 bp, human
gcaggtgggctgcgagccag

SEQ ID NO: 36562 - DNA, 20 bp, human
ggctcccacgggagggatga

SEQ ID NO: 36563 - DNA, 20 bp, human
gggctcgcagcccacctgag

SEQ ID NO: 36564 - DNA, 20 bp, human
gccccgccccgtctacagca

SEQ ID NO: 36565 - DNA, 20 bp, human
ggctctcattcccctcaggt

SEQ ID NO: 36566 - DNA, 20 bp, human
gctgccgcaagtgaccagag

SEQ ID NO: 36567 - DNA, 20 bp, human
gggcacagggcgccgagatg

SEQ ID NO: 36568 - DNA, 20 bp, human
gcagggctgcacgtaacgag

SEQ ID NO: 36569 - DNA, 20 bp, human
ggagaggctccggaagtact

SEQ ID NO: 36570 - DNA, 20 bp, human
ggaggggacgaaaggtccca

SEQ ID NO: 36571 - DNA, 20 bp, human
gaggaggtagacacggcaca

SEQ ID NO: 36572 - DNA, 20 bp, human
gtcaggacagtcctgaatcg

SEQ ID NO: 36573 - DNA, 20 bp, human
gagtactgggtgcagcctga

SEQ ID NO: 36574 - DNA, 20 bp, human
gacagggcgccgagatgcgg

SEQ ID NO: 36575 - DNA, 20 bp, human
gggtcacttgcggcagactc

SEQ ID NO: 36576 - DNA, 20 bp, human
ggacagagaaggaaacgcgg

SEQ ID NO: 36577 - DNA, 20 bp, human
ggcctttccgaggaagagac

SEQ ID NO: 36578 - DNA, 20 bp, human
ggcttcgccgttgctcgggt

SEQ ID NO: 36579 - DNA, 20 bp, human
gaccggtctcttcctcggaa

SEQ ID NO: 36580 - DNA, 20 bp, human
gtggaggcgcgctaccgtgg

SEQ ID NO: 36581 - DNA, 20 bp, human
gcaggctccccagacagaga

SEQ ID NO: 36582 - DNA, 20 bp, human
gccgcgctgggaatttgcgg

SEQ ID NO: 36583 - DNA, 20 bp, human
gggtcgctggaacgcgggaa

SEQ ID NO: 36584 - DNA, 20 bp, human
ggccccgcgctgggaatttg

SEQ ID NO: 36585 - DNA, 20 bp, human
ggctcctcccacccgagcaa

SEQ ID NO: 36586 - DNA, 20 bp, human
gcgcgggcggtgtttgaggc

SEQ ID NO: 36587 - DNA, 20 bp, human
ggaagcccgggtgaggggac

SEQ ID NO: 36588 - DNA, 20 bp, human
gaggccggccagtcgtgact

SEQ ID NO: 36589 - DNA, 20 bp, human
gccggccagtcgtgactggg

SEQ ID NO: 36590 - DNA, 20 bp, human
ggcgtggagcccaggcgagg

SEQ ID NO: 36591 - DNA, 20 bp, human
ggtgccgcacgcccaccgga

SEQ ID NO: 36592 - DNA, 20 bp, human
gcccagccctgccttccggt

SEQ ID NO: 36593 - DNA, 20 bp, human
gtcgtgactgggcggcaatg

SEQ ID NO: 36594 - DNA, 20 bp, human
ggcacgcccaccggaaggca

SEQ ID NO: 36595 - DNA, 20 bp, human
gtgactgccgggagtcctgc

SEQ ID NO: 36596 - DNA, 20 bp, human
gacagcgtggagagcaccaa

SEQ ID NO: 36597 - DNA, 20 bp, human
gcggcagtgcagagaccttg

SEQ ID NO: 36598 - DNA, 20 bp, human
gcgtctcctgtgaggagggg

SEQ ID NO: 36599 - DNA, 20 bp, human
gcaccaagggatctaggctg

SEQ ID NO: 36600 - DNA, 20 bp, human
gggagagcaccaagggatct

SEQ ID NO: 36601 - DNA, 20 bp, human
ggaggtgtccgtctcctgtg

SEQ ID NO: 36602 - DNA, 20 bp, human
ggccaggaaagccagccatg

SEQ ID NO: 36603 - DNA, 20 bp, human
gatctaaagaccaggcccca

SEQ ID NO: 36604 - DNA, 20 bp, human
gtagagggcttacttaatga

SEQ ID NO: 36605 - DNA, 20 bp, human
ggcactggaaattagtaagg

SEQ ID NO: 36606 - DNA, 20 bp, human
gagctcatagcagcagagtg

SEQ ID NO: 36607 - DNA, 20 bp, human
ggctggagcaggcggtgcga

SEQ ID NO: 36608 - DNA, 20 bp, human
gcagcagagtgcggcaacac

SEQ ID NO: 36609 - DNA, 20 bp, human
gctggaagaggcagtcaccc

SEQ ID NO: 36610 - DNA, 20 bp, human
gagagaatggaagactccgg

SEQ ID NO: 36611 - DNA, 20 bp, human
gcccgctacaggtatccctg

SEQ ID NO: 36612 - DNA, 20 bp, human
gacgggaagggcctcggcac

SEQ ID NO: 36613 - DNA, 20 bp, human
gctgcctcttccagggcggg

SEQ ID NO: 36614 - DNA, 20 bp, human
ggcctcagggatacctgtag

SEQ ID NO: 36615 - DNA, 20 bp, human
gtaccctttacatcgctgag

SEQ ID NO: 36616 - DNA, 20 bp, human
gccgggcgggcgcctctcac

SEQ ID NO: 36617 - DNA, 20 bp, human
gtcaccgggagcgctcgcgg

SEQ ID NO: 36618 - DNA, 20 bp, human
gcgagagcgcgaaggaaatc

SEQ ID NO: 36619 - DNA, 20 bp, human
ggggagctgaagcccaagtt

SEQ ID NO: 36620 - DNA, 20 bp, human
gccggagagcgagagcgcga

SEQ ID NO: 36621 - DNA, 20 bp, human
gcgccgccaaggaagccaac

SEQ ID NO: 36622 - DNA, 20 bp, human
gctctcaccgggagcgctcg

SEQ ID NO: 36623 - DNA, 20 bp, human
gagaacgacacgccaaactt

SEQ ID NO: 36624 - DNA, 20 bp, human
gcgcagcgggagacctgggt

SEQ ID NO: 36625 - DNA, 20 bp, human
ggccgcaagccacacggtga

SEQ ID NO: 36626 - DNA, 20 bp, human
ggcaagaaccgcttgtagtt

SEQ ID NO: 36627 - DNA, 20 bp, human
gttccagtcgacagcttcaa

SEQ ID NO: 36628 - DNA, 20 bp, human
gagttacagagacgaggatt

SEQ ID NO: 36629 - DNA, 20 bp, human
gactagtagttacagagacg

SEQ ID NO: 36630 - DNA, 20 bp, human
ggcgcagccaggagcccaac

SEQ ID NO: 36631 - DNA, 20 bp, human
gggagctagagctgcagtcc

SEQ ID NO: 36632 - DNA, 20 bp, human
gggaaagggcgtctgaaata

SEQ ID NO: 36633 - DNA, 20 bp, human
gcccaacaggtaaactcaga

SEQ ID NO: 36634 - DNA, 20 bp, human
gttcttgcccggacccacgc

SEQ ID NO: 36635 - DNA, 20 bp, human
gttgtttccggcgtgggtcc

SEQ ID NO: 36636 - DNA, 20 bp, human
gagcagctgtcaagatgctg

SEQ ID NO: 36637 - DNA, 20 bp, human
gacgtggtcagcacaggggc

SEQ ID NO: 36638 - DNA, 20 bp, human
gcacaggggccggcaccacg

SEQ ID NO: 36639 - DNA, 20 bp, human
gtccccagcagggccggact

SEQ ID NO: 36640 - DNA, 20 bp, human
ggtgctgaccacgtccaaca

SEQ ID NO: 36641 - DNA, 20 bp, human
gggacaggacagctggaacg

SEQ ID NO: 36642 - DNA, 20 bp, human
ggctgagggtagccaccggg

SEQ ID NO: 36643 - DNA, 20 bp, human
ggcggcagccatgttggacg

SEQ ID NO: 36644 - DNA, 20 bp, human
ggagtctcggggagccgcag

SEQ ID NO: 36645 - DNA, 20 bp, human
gccaggaaggcgtccccaag

SEQ ID NO: 36646 - DNA, 20 bp, human
gtggcccggaatattggtag

SEQ ID NO: 36647 - DNA, 20 bp, human
ggggatgtggcccggaatat

SEQ ID NO: 36648 - DNA, 20 bp, human
gggcgcttgggagagtcctg

SEQ ID NO: 36649 - DNA, 20 bp, human
gcagcggtgcctgcacgcga

SEQ ID NO: 36650 - DNA, 20 bp, human
gcgtggtggagcagacggta

SEQ ID NO: 36651 - DNA, 20 bp, human
gcctgggggtagaaagatgg

SEQ ID NO: 36652 - DNA, 20 bp, human
gatcggacggaagccgaccg

SEQ ID NO: 36653 - DNA, 20 bp, human
gagccgcgagtagatgtcat

SEQ ID NO: 36654 - DNA, 20 bp, human
gggagtgtcggcaggcgctt

SEQ ID NO: 36655 - DNA, 20 bp, human
gcaggtgtcaggaaggaagt

SEQ ID NO: 36656 - DNA, 20 bp, human
ggctgcataggccacagaga

SEQ ID NO: 36657 - DNA, 20 bp, human
gtgagtgggacagctggtgt

SEQ ID NO: 36658 - DNA, 20 bp, human
ggtgggacagctggtgtggg

SEQ ID NO: 36659 - DNA, 20 bp, human
gggcgacaagcaggaggatc

SEQ ID NO: 36660 - DNA, 20 bp, human
gagagagggcgacaagcagg

SEQ ID NO: 36661 - DNA, 20 bp, human
gcacagagagggcgacaagc

SEQ ID NO: 36662 - DNA, 20 bp, human
gcgggggccaggagctgcat

SEQ ID NO: 36663 - DNA, 20 bp, human
gccatggtgagtgggacagc

SEQ ID NO: 36664 - DNA, 20 bp, human
gaggacatggaagtaaacag

SEQ ID NO: 36665 - DNA, 20 bp, human
gagaggcataggacaggaca

SEQ ID NO: 36666 - DNA, 20 bp, human
gggtcgtggtggcttttcta

SEQ ID NO: 36667 - DNA, 20 bp, human
gcatcatggcccacaggtcg

SEQ ID NO: 36668 - DNA, 20 bp, human
gtcctgcacgccgaccatgt

SEQ ID NO: 36669 - DNA, 20 bp, human
gtggtgttcccacagctggg

SEQ ID NO: 36670 - DNA, 20 bp, human
gagctgggaggacacccaca

SEQ ID NO: 36671 - DNA, 20 bp, human
gccatgcgcacatgtggtaa

SEQ ID NO: 36672 - DNA, 20 bp, human
gtgggtgtcctcccagctgt

SEQ ID NO: 36673 - DNA, 20 bp, human
gggccatgatgctaccccaa

SEQ ID NO: 36674 - DNA, 20 bp, human
gacagcagcagcagccattg

SEQ ID NO: 36675 - DNA, 20 bp, human
gcaggccttaggacagtgga

SEQ ID NO: 36676 - DNA, 20 bp, human
gcagggtggtctctacgtgg

SEQ ID NO: 36677 - DNA, 20 bp, human
gggaggaaagaagggtaggt

SEQ ID NO: 36678 - DNA, 20 bp, human
gggtaagtctgtgcagacgg

SEQ ID NO: 36679 - DNA, 20 bp, human
gagacggtggatgcctggag

SEQ ID NO: 36680 - DNA, 20 bp, human
gaatatggtagcccacccta

SEQ ID NO: 36681 - DNA, 20 bp, human
gtggaggtgcagtcccacgg

SEQ ID NO: 36682 - DNA, 20 bp, human
gacgtagagaccaccctgcc

SEQ ID NO: 36683 - DNA, 20 bp, human
ggatggtgggagcagagtct

SEQ ID NO: 36684 - DNA, 20 bp, human
ggagcctggaattcccccgt

SEQ ID NO: 36685 - DNA, 20 bp, human
ggcaattgtctggagcacgt

SEQ ID NO: 36686 - DNA, 20 bp, human
gacccccgccacgagcgcca

SEQ ID NO: 36687 - DNA, 20 bp, human
gactagacagtgagaggagg

SEQ ID NO: 36688 - DNA, 20 bp, human
ggcagcggcggggttccgag

SEQ ID NO: 36689 - DNA, 20 bp, human
gagaatcactagacagtgag

SEQ ID NO: 36690 - DNA, 20 bp, human
ggcagccctggcgctcgtgg

SEQ ID NO: 36691 - DNA, 20 bp, human
gaaaccagagcatgcagggt

SEQ ID NO: 36692 - DNA, 20 bp, human
ggtgattcttccaggcacga

SEQ ID NO: 36693 - DNA, 20 bp, human
gttgcggaagcgcgctccag

SEQ ID NO: 36694 - DNA, 20 bp, human
gccaccaggggaaagtgaag

SEQ ID NO: 36695 - DNA, 20 bp, human
gggcgccgggcagcctgaaa

SEQ ID NO: 36696 - DNA, 20 bp, human
gaggcagctccggtcaggta

SEQ ID NO: 36697 - DNA, 20 bp, human
ggtccaaacctcgcatccgt

SEQ ID NO: 36698 - DNA, 20 bp, human
ggcctcagagcatggaatcg

SEQ ID NO: 36699 - DNA, 20 bp, human
gcctcccccggccgccacca

SEQ ID NO: 36700 - DNA, 20 bp, human
gggccgttcctagagtggtc

SEQ ID NO: 36701 - DNA, 20 bp, human
ggtggttcgaagccgtacag

SEQ ID NO: 36702 - DNA, 20 bp, human
gcgcatgcgcgttccctcag

SEQ ID NO: 36703 - DNA, 20 bp, human
ggctaggcagggcagtccga

SEQ ID NO: 36704 - DNA, 20 bp, human
gctgaacgccagaccactct

SEQ ID NO: 36705 - DNA, 20 bp, human
ggtgtatcatagggtctcat

SEQ ID NO: 36706 - DNA, 20 bp, human
ggaatcccgcggcgccaggt

SEQ ID NO: 36707 - DNA, 20 bp, human
ggctccgaactgggacggga

SEQ ID NO: 36708 - DNA, 20 bp, human
gcacagctccgaactgggac

SEQ ID NO: 36709 - DNA, 20 bp, human
ggcggggccggcgaatcccg

SEQ ID NO: 36710 - DNA, 20 bp, human
ggacgggaaggcgacgtctg

SEQ ID NO: 36711 - DNA, 20 bp, human
ggcggccacagctccgaact

SEQ ID NO: 36712 - DNA, 20 bp, human
gacacctgctgggtcatgta

SEQ ID NO: 36713 - DNA, 20 bp, human
ggcggcggctctccagtgag

SEQ ID NO: 36714 - DNA, 20 bp, human
gctgcggccgctccacatgg

SEQ ID NO: 36715 - DNA, 20 bp, human
ggccgctggggaaccaggaa

SEQ ID NO: 36716 - DNA, 20 bp, human
gggcaggtgaactctccacg

SEQ ID NO: 36717 - DNA, 20 bp, human
gtgagcaacggctgctccag

SEQ ID NO: 36718 - DNA, 20 bp, human
gtcgcgggccctagaccccg

SEQ ID NO: 36719 - DNA, 20 bp, human
gattccacggggaaagtggt

SEQ ID NO: 36720 - DNA, 20 bp, human
gggcagagccccattccacg

SEQ ID NO: 36721 - DNA, 20 bp, human
ggaggacctccgggtcacag

SEQ ID NO: 36722 - DNA, 20 bp, human
gtctggtgaatagacggctg

SEQ ID NO: 36723 - DNA, 20 bp, human
gacgaggcctgctgcacccg

SEQ ID NO: 36724 - DNA, 20 bp, human
gtgcgcggaggcgagtgagg

SEQ ID NO: 36725 - DNA, 20 bp, human
ggcagagaagcgtgaaggcc

SEQ ID NO: 36726 - DNA, 20 bp, human
gtgagaaacggcttctgtga

SEQ ID NO: 36727 - DNA, 20 bp, human
gaaggctgtcacaactccga

SEQ ID NO: 36728 - DNA, 20 bp, human
gagaaattgctcagagtcat

SEQ ID NO: 36729 - DNA, 20 bp, human
gcagtggctttgatccacaa

SEQ ID NO: 36730 - DNA, 20 bp, human
gcatgcaaaactgaacactc

SEQ ID NO: 36731 - DNA, 20 bp, human
gtatgggtgaaatgcagtac

SEQ ID NO: 36732 - DNA, 20 bp, human
gtacgggcttttccacggag

SEQ ID NO: 36733 - DNA, 20 bp, human
gctgcctcacaccctctccg

SEQ ID NO: 36734 - DNA, 20 bp, human
gcctttgtgagcaatgggaa

SEQ ID NO: 36735 - DNA, 20 bp, human
gaggagctggacaagtttat

SEQ ID NO: 36736 - DNA, 20 bp, human
gtgggtgcaggtcatcccca

SEQ ID NO: 36737 - DNA, 20 bp, human
gtggctgctgcctcaacgtc

SEQ ID NO: 36738 - DNA, 20 bp, human
ggctgctgctcggagacctt

SEQ ID NO: 36739 - DNA, 20 bp, human
gagccagtggggcactacca

SEQ ID NO: 36740 - DNA, 20 bp, human
ggacattatgcctgacgttg

SEQ ID NO: 36741 - DNA, 20 bp, human
gatccactccagtctgacaa

SEQ ID NO: 36742 - DNA, 20 bp, human
ggtgtaaagtgcggcagtgt

SEQ ID NO: 36743 - DNA, 20 bp, human
gtgccctggtagtgccccac

SEQ ID NO: 36744 - DNA, 20 bp, human
gaaagtccacagtgagccaa

SEQ ID NO: 36745 - DNA, 20 bp, human
gtaccagggcaacgatgatc

SEQ ID NO: 36746 - DNA, 20 bp, human
gtaccagacttcaaaagata

SEQ ID NO: 36747 - DNA, 20 bp, human
gattagcataacccttcctc

SEQ ID NO: 36748 - DNA, 20 bp, human
gtaaaatctcactcttcctg

SEQ ID NO: 36749 - DNA, 20 bp, human
gacaatgaaggacccaaggc

SEQ ID NO: 36750 - DNA, 20 bp, human
gacaggaaaataagttctct

SEQ ID NO: 36751 - DNA, 20 bp, human
gggacattgaactctgaaca

SEQ ID NO: 36752 - DNA, 20 bp, human
gtattcttgggacacaagca

SEQ ID NO: 36753 - DNA, 20 bp, human
gtgtaatttgctctattctt

SEQ ID NO: 36754 - DNA, 20 bp, human
gtacctgcaaactttttctt

SEQ ID NO: 36755 - DNA, 20 bp, human
ggtttatgtcattctatatt

SEQ ID NO: 36756 - DNA, 20 bp, human
gcctcccctgcgctccacta

SEQ ID NO: 36757 - DNA, 20 bp, human
ggccgctgctctccggctga

SEQ ID NO: 36758 - DNA, 20 bp, human
gggaaacgcgccaaagggga

SEQ ID NO: 36759 - DNA, 20 bp, human
ggctttcagagcaccctgag

SEQ ID NO: 36760 - DNA, 20 bp, human
ggagacagctccgtccctag

SEQ ID NO: 36761 - DNA, 20 bp, human
ggacaggaaacgcgccaaag

SEQ ID NO: 36762 - DNA, 20 bp, human
ggggtcagcggggtctaccc

SEQ ID NO: 36763 - DNA, 20 bp, human
gggcaggaaccggctgaaga

SEQ ID NO: 36764 - DNA, 20 bp, human
gaaccggctgaagaggggct

SEQ ID NO: 36765 - DNA, 20 bp, human
gcgtccctagtggagcgcag

SEQ ID NO: 36766 - DNA, 20 bp, human
ggcaagacgctgctctgagg

SEQ ID NO: 36767 - DNA, 20 bp, human
gcgctgctctgaggcgggga

SEQ ID NO: 36768 - DNA, 20 bp, human
gcgcatcccggctcgaatcc

SEQ ID NO: 36769 - DNA, 20 bp, human
gcagagcagcgtcttgctga

SEQ ID NO: 36770 - DNA, 20 bp, human
ggcgcggcccagcgtcacgg

SEQ ID NO: 36771 - DNA, 20 bp, human
ggcgcagcatcgccagcccg

SEQ ID NO: 36772 - DNA, 20 bp, human
ggaatcccgcaccgacccag

SEQ ID NO: 36773 - DNA, 20 bp, human
ggagctccgggggtccaagg

SEQ ID NO: 36774 - DNA, 20 bp, human
gcggacccgaatccccgcac

SEQ ID NO: 36775 - DNA, 20 bp, human
ggacccgactccccgcatcc

SEQ ID NO: 36776 - DNA, 20 bp, human
gagctgcggcaagggagggt

SEQ ID NO: 36777 - DNA, 20 bp, human
gacagaggccaaagaagctg

SEQ ID NO: 36778 - DNA, 20 bp, human
gcggcgagctagcggcgcag

SEQ ID NO: 36779 - DNA, 20 bp, human
ggctgctgccggcgagctag

SEQ ID NO: 36780 - DNA, 20 bp, human
gaactgacttcgggaatcca

SEQ ID NO: 36781 - DNA, 20 bp, human
gggacgtcaactcaacccct

SEQ ID NO: 36782 - DNA, 20 bp, human
gcactggcgcggacccggag

SEQ ID NO: 36783 - DNA, 20 bp, human
gtgcgcagggaactgacttc

SEQ ID NO: 36784 - DNA, 20 bp, human
ggtgaaagcggcaaggacct

SEQ ID NO: 36785 - DNA, 20 bp, human
gcctcctcgcggctaaaggt

SEQ ID NO: 36786 - DNA, 20 bp, human
gtgaggcggtggacttgcag

SEQ ID NO: 36787 - DNA, 20 bp, human
gcctgggcagatcccaatct

SEQ ID NO: 36788 - DNA, 20 bp, human
gagcaggtctgagaacggat

SEQ ID NO: 36789 - DNA, 20 bp, human
gagagggccagacacctgtc

SEQ ID NO: 36790 - DNA, 20 bp, human
gacgctgggctgggggaaac

SEQ ID NO: 36791 - DNA, 20 bp, human
gcagcaggagggtcatggtg

SEQ ID NO: 36792 - DNA, 20 bp, human
gatcccaatctgggtagctg

SEQ ID NO: 36793 - DNA, 20 bp, human
gcaaggagcggggtacagca

SEQ ID NO: 36794 - DNA, 20 bp, human
ggtaccgaaagaggggcgtc

SEQ ID NO: 36795 - DNA, 20 bp, human
gaggctccctggcacctgac

SEQ ID NO: 36796 - DNA, 20 bp, human
gtagttggccctggagtgcg

SEQ ID NO: 36797 - DNA, 20 bp, human
gtcagctgccacgcactcca

SEQ ID NO: 36798 - DNA, 20 bp, human
ggggcgctgcagcagggtgt

SEQ ID NO: 36799 - DNA, 20 bp, human
gggagaggggcgctgcagca

SEQ ID NO: 36800 - DNA, 20 bp, human
gaggaaagcccgcagcccca

SEQ ID NO: 36801 - DNA, 20 bp, human
gccagggccaactaggtgtg

SEQ ID NO: 36802 - DNA, 20 bp, human
gacagacagagcagagcgta

SEQ ID NO: 36803 - DNA, 20 bp, human
ggtgacccagctgcccgtaa

SEQ ID NO: 36804 - DNA, 20 bp, human
gaggggtgtgcacccatgtg

SEQ ID NO: 36805 - DNA, 20 bp, human
gtccaggcccagggccctta

SEQ ID NO: 36806 - DNA, 20 bp, human
ggaagccctacccgtgtatc

SEQ ID NO: 36807 - DNA, 20 bp, human
gcttgtcctcctctcccagt

SEQ ID NO: 36808 - DNA, 20 bp, human
gctcccagtcggcaccacag

SEQ ID NO: 36809 - DNA, 20 bp, human
ggccatggcgggcaactgaa

SEQ ID NO: 36810 - DNA, 20 bp, human
gaggaggacaagcgccagga

SEQ ID NO: 36811 - DNA, 20 bp, human
gcgcccggcagccaccgctg

SEQ ID NO: 36812 - DNA, 20 bp, human
gctagaccgaccggatacac

SEQ ID NO: 36813 - DNA, 20 bp, human
gccagtcggcaccacagcgg

SEQ ID NO: 36814 - DNA, 20 bp, human
ggacccaccgacaccacgcc

SEQ ID NO: 36815 - DNA, 20 bp, human
gccgaccggatacacgggta

SEQ ID NO: 36816 - DNA, 20 bp, human
ggcaggagctgggagacgtg

SEQ ID NO: 36817 - DNA, 20 bp, human
ggaccccggccggggcccag

SEQ ID NO: 36818 - DNA, 20 bp, human
ggcctgctctaggccacccg

SEQ ID NO: 36819 - DNA, 20 bp, human
ggcagccgggccccacgagt

SEQ ID NO: 36820 - DNA, 20 bp, human
ggctcagggcgcgcacccgg

SEQ ID NO: 36821 - DNA, 20 bp, human
ggagagcggtgccccggagg

SEQ ID NO: 36822 - DNA, 20 bp, human
ggctgtcacccgagccgcgg

SEQ ID NO: 36823 - DNA, 20 bp, human
ggcgtcggcggggacgggct

SEQ ID NO: 36824 - DNA, 20 bp, human
ggcgcgcacccgggggaccc

SEQ ID NO: 36825 - DNA, 20 bp, human
ggacgctgtcacccgagccg

SEQ ID NO: 36826 - DNA, 20 bp, human
gagagccgcaatggcggaac

SEQ ID NO: 36827 - DNA, 20 bp, human
ggcgcccggttccgccattg

SEQ ID NO: 36828 - DNA, 20 bp, human
ggccaggagagccgcaatgg

SEQ ID NO: 36829 - DNA, 20 bp, human
gacgaaagagctcgggtcgg

SEQ ID NO: 36830 - DNA, 20 bp, human
gggggccaggagagccgcaa

SEQ ID NO: 36831 - DNA, 20 bp, human
gccgggcgcagcgcagactc

SEQ ID NO: 36832 - DNA, 20 bp, human
ggcagcgcagactccggaaa

SEQ ID NO: 36833 - DNA, 20 bp, human
gcaggcagacgaaagagctc

SEQ ID NO: 36834 - DNA, 20 bp, human
gggaccaggcctggatccaa

SEQ ID NO: 36835 - DNA, 20 bp, human
gaaagagctcgggtcggggg

SEQ ID NO: 36836 - DNA, 20 bp, human
gaccgcaggacgccaaggag

SEQ ID NO: 36837 - DNA, 20 bp, human
gtgcaggcagggcaacccaa

SEQ ID NO: 36838 - DNA, 20 bp, human
gggctggtgcgggacctcgg

SEQ ID NO: 36839 - DNA, 20 bp, human
gccgctcagtgcccgcgagg

SEQ ID NO: 36840 - DNA, 20 bp, human
gcctcgcgcgggctgaccgg

SEQ ID NO: 36841 - DNA, 20 bp, human
ggtcagcccgcgcgaggggt

SEQ ID NO: 36842 - DNA, 20 bp, human
gtaaggaccgcaggacgcca

SEQ ID NO: 36843 - DNA, 20 bp, human
gatcacagaggcaaactcag

SEQ ID NO: 36844 - DNA, 20 bp, human
gacagggaggatctgcgcca

SEQ ID NO: 36845 - DNA, 20 bp, human
ggtgctcctgaaagcgaaca

SEQ ID NO: 36846 - DNA, 20 bp, human
ggggacatctcaccggtcag

SEQ ID NO: 36847 - DNA, 20 bp, human
ggtggctctgctcaagggta

SEQ ID NO: 36848 - DNA, 20 bp, human
gctcaagggtagggaagacg

SEQ ID NO: 36849 - DNA, 20 bp, human
ggagccacaccaggacggat

SEQ ID NO: 36850 - DNA, 20 bp, human
gccgcccatccgtcctggtg

SEQ ID NO: 36851 - DNA, 20 bp, human
ggagatccgcatcttcgcag

SEQ ID NO: 36852 - DNA, 20 bp, human
gtggccggagccccatcacc

SEQ ID NO: 36853 - DNA, 20 bp, human
ggagcagagccacaccagga

SEQ ID NO: 36854 - DNA, 20 bp, human
gcctcccagtgcccacaacg

SEQ ID NO: 36855 - DNA, 20 bp, human
ggcctgggtctcccgcaacg

SEQ ID NO: 36856 - DNA, 20 bp, human
ggggctgcctgtgcattcag

SEQ ID NO: 36857 - DNA, 20 bp, human
ggagtagagagggttcgcag

SEQ ID NO: 36858 - DNA, 20 bp, human
gtcagcccagcaggcccatc

SEQ ID NO: 36859 - DNA, 20 bp, human
gcagaaccaacaggacgatg

SEQ ID NO: 36860 - DNA, 20 bp, human
gtcccttcggagagtagaga

SEQ ID NO: 36861 - DNA, 20 bp, human
gcggcccaagtctcccacta

SEQ ID NO: 36862 - DNA, 20 bp, human
gcctgattacttctcatgag

SEQ ID NO: 36863 - DNA, 20 bp, human
gtgctactgagtgtccagat

SEQ ID NO: 36864 - DNA, 20 bp, human
gaatcaggcgcaaagagcca

SEQ ID NO: 36865 - DNA, 20 bp, human
gaagagccagggagcagcgt

SEQ ID NO: 36866 - DNA, 20 bp, human
gtgggcctgtgatcgctgag

SEQ ID NO: 36867 - DNA, 20 bp, human
gccaatacggtagcgaagag

SEQ ID NO: 36868 - DNA, 20 bp, human
gcagcgctcgacgatctcta

SEQ ID NO: 36869 - DNA, 20 bp, human
ggaagacccgcaggtcacag

SEQ ID NO: 36870 - DNA, 20 bp, human
gggcgagcagttgcgaccct

SEQ ID NO: 36871 - DNA, 20 bp, human
gctcgcccctcagcgatcac

SEQ ID NO: 36872 - DNA, 20 bp, human
gtgaggcgcagaggcccgaa

SEQ ID NO: 36873 - DNA, 20 bp, human
gcctgtgtaggcgatccctg

SEQ ID NO: 36874 - DNA, 20 bp, human
ggcgccgtccaagggtccat

SEQ ID NO: 36875 - DNA, 20 bp, human
gacataacgctcaggtcccc

SEQ ID NO: 36876 - DNA, 20 bp, human
ggccacggcgcgcaccacgt

SEQ ID NO: 36877 - DNA, 20 bp, human
gatctcgctggggccttcac

SEQ ID NO: 36878 - DNA, 20 bp, human
ggcacgtgcggtcccgtgga

SEQ ID NO: 36879 - DNA, 20 bp, human
gccgccgagggtgccagccg

SEQ ID NO: 36880 - DNA, 20 bp, human
ggatacaaccgggcccgacg

SEQ ID NO: 36881 - DNA, 20 bp, human
gcgcagggcacttgggttag

SEQ ID NO: 36882 - DNA, 20 bp, human
gtgcgcgccgcggctgctga

SEQ ID NO: 36883 - DNA, 20 bp, human
gcagcctcggctggcaccct

SEQ ID NO: 36884 - DNA, 20 bp, human
gggcacttgggttagtggcg

SEQ ID NO: 36885 - DNA, 20 bp, human
gaaacccgggccgcagccgg

SEQ ID NO: 36886 - DNA, 20 bp, human
gtggcacagacgcctccagg

SEQ ID NO: 36887 - DNA, 20 bp, human
gccggctggaagtcagccga

SEQ ID NO: 36888 - DNA, 20 bp, human
gcagggtgtcagcaacctcc

SEQ ID NO: 36889 - DNA, 20 bp, human
gagggtggaaaccaaccccg

SEQ ID NO: 36890 - DNA, 20 bp, human
gggaagtcagccgagggcac

SEQ ID NO: 36891 - DNA, 20 bp, human
gtcggccttggacttgggag

SEQ ID NO: 36892 - DNA, 20 bp, human
gggagctcggccttggactt

SEQ ID NO: 36893 - DNA, 20 bp, human
gaccatccctgcaaaactac

SEQ ID NO: 36894 - DNA, 20 bp, human
gaaagccgctcccaagtcca

SEQ ID NO: 36895 - DNA, 20 bp, human
gtctggctctccggagaaat

SEQ ID NO: 36896 - DNA, 20 bp, human
gaagctggtggcaacttcac

SEQ ID NO: 36897 - DNA, 20 bp, human
gcgaaggtccttccagaagc

SEQ ID NO: 36898 - DNA, 20 bp, human
gtgtatcgaattaaactcaa

SEQ ID NO: 36899 - DNA, 20 bp, human
gttaaagcagagaaaaacga

SEQ ID NO: 36900 - DNA, 20 bp, human
gactattcacatagcataat

SEQ ID NO: 36901 - DNA, 20 bp, human
gaatgttgatcaaataatgg

SEQ ID NO: 36902 - DNA, 20 bp, human
gagataaatatcccctttgt

SEQ ID NO: 36903 - DNA, 20 bp, human
gattattttaactcccacaa

SEQ ID NO: 36904 - DNA, 20 bp, human
gttaattttcatccgtgtca

SEQ ID NO: 36905 - DNA, 20 bp, human
gaggtccttccagaagctgg

SEQ ID NO: 36906 - DNA, 20 bp, human
gagagctcgggctccacaag

SEQ ID NO: 36907 - DNA, 20 bp, human
ggcccgaacctgccagaata

SEQ ID NO: 36908 - DNA, 20 bp, human
gggaggctcggcaaatacag

SEQ ID NO: 36909 - DNA, 20 bp, human
gcctcgctgctgaactgggt

SEQ ID NO: 36910 - DNA, 20 bp, human
gcctctgccctgcggacctc

SEQ ID NO: 36911 - DNA, 20 bp, human
gacaaagcccgaggtccgca

SEQ ID NO: 36912 - DNA, 20 bp, human
gtgggtgagatcccctattc

SEQ ID NO: 36913 - DNA, 20 bp, human
ggtgtcctcgctgctgaact

SEQ ID NO: 36914 - DNA, 20 bp, human
gggggtgctgatgtgtaagg

SEQ ID NO: 36915 - DNA, 20 bp, human
ggtgcagagggattgcagat

SEQ ID NO: 36916 - DNA, 20 bp, human
gtcccgagcggtccgagtca

SEQ ID NO: 36917 - DNA, 20 bp, human
gtcagccgcggcttcagcag

SEQ ID NO: 36918 - DNA, 20 bp, human
ggagtcagggttgccccacc

SEQ ID NO: 36919 - DNA, 20 bp, human
gctcctggggctctcccgag

SEQ ID NO: 36920 - DNA, 20 bp, human
gtaagcaatgcggcactccc

SEQ ID NO: 36921 - DNA, 20 bp, human
gctgctgctgaaagaggact

SEQ ID NO: 36922 - DNA, 20 bp, human
gaccctgactcggaccgctc

SEQ ID NO: 36923 - DNA, 20 bp, human
gctcctctgggcgggatgga

SEQ ID NO: 36924 - DNA, 20 bp, human
gctaccagcaaacccagagg

SEQ ID NO: 36925 - DNA, 20 bp, human
gcagcggcatcaactcctct

SEQ ID NO: 36926 - DNA, 20 bp, human
ggcgctacgtctgctgcgga

SEQ ID NO: 36927 - DNA, 20 bp, human
gctacgtctgctgcggaggg

SEQ ID NO: 36928 - DNA, 20 bp, human
ggatggcgctacgtctgctg

SEQ ID NO: 36929 - DNA, 20 bp, human
gtgggcgtggctaaaggcaa

SEQ ID NO: 36930 - DNA, 20 bp, human
gggcgcgcgcgtcgggaaga

SEQ ID NO: 36931 - DNA, 20 bp, human
ggaacgcgccagtctttgag

SEQ ID NO: 36932 - DNA, 20 bp, human
gcgagggccctcccaaaggg

SEQ ID NO: 36933 - DNA, 20 bp, human
gcgaggtcgagccagcgcgt

SEQ ID NO: 36934 - DNA, 20 bp, human
ggcggcagcgaccttggacg

SEQ ID NO: 36935 - DNA, 20 bp, human
gtgcggttcgtttaacacag

SEQ ID NO: 36936 - DNA, 20 bp, human
gtgtcctaggctgtagagaa

SEQ ID NO: 36937 - DNA, 20 bp, human
gaggctgcctgagcaaatgc

SEQ ID NO: 36938 - DNA, 20 bp, human
gctgaagctggtgagtatca

SEQ ID NO: 36939 - DNA, 20 bp, human
gtgtgtaggacccactgtcc

SEQ ID NO: 36940 - DNA, 20 bp, human
gtgaccatgctcaagagcta

SEQ ID NO: 36941 - DNA, 20 bp, human
ggagaaagtcacaaagtaat

SEQ ID NO: 36942 - DNA, 20 bp, human
gggaaaaccagcatttgctc

SEQ ID NO: 36943 - DNA, 20 bp, human
gaaaacaggaacctggacag

SEQ ID NO: 36944 - DNA, 20 bp, human
gtgtgctccagagctgaagc

SEQ ID NO: 36945 - DNA, 20 bp, human
ggtagagaatggcagtgggt

SEQ ID NO: 36946 - DNA, 20 bp, human
gatcgggcggcgccgagctg

SEQ ID NO: 36947 - DNA, 20 bp, human
gcgccgagctgaggtggtga

SEQ ID NO: 36948 - DNA, 20 bp, human
gcccggatgtggagaagctg

SEQ ID NO: 36949 - DNA, 20 bp, human
gcagggatgtgcaagatccg

SEQ ID NO: 36950 - DNA, 20 bp, human
ggtggtgagggactagctcc

SEQ ID NO: 36951 - DNA, 20 bp, human
gagggactagctcccggatg

SEQ ID NO: 36952 - DNA, 20 bp, human
ggatggcccccttccaagag

SEQ ID NO: 36953 - DNA, 20 bp, human
gcgtgggaggaagatggact

SEQ ID NO: 36954 - DNA, 20 bp, human
gggtgcgcatgtgcgagagt

SEQ ID NO: 36955 - DNA, 20 bp, human
gggattcaggggccttccag

SEQ ID NO: 36956 - DNA, 20 bp, human
ggcgcggaggccgaacccag

SEQ ID NO: 36957 - DNA, 20 bp, human
gcggacgcatgggatcgtgg

SEQ ID NO: 36958 - DNA, 20 bp, human
ggggagagccaagcccggag

SEQ ID NO: 36959 - DNA, 20 bp, human
ggctccagtcgtagcctcct

SEQ ID NO: 36960 - DNA, 20 bp, human
gtctcccaggaggctacgac

SEQ ID NO: 36961 - DNA, 20 bp, human
gaggtacgtgcgcgtccccg

SEQ ID NO: 36962 - DNA, 20 bp, human
gagagaaatctgcaaagtcg

SEQ ID NO: 36963 - DNA, 20 bp, human
gcgcgagagggacgtggacg

SEQ ID NO: 36964 - DNA, 20 bp, human
ggcttctgaaaacggactat

SEQ ID NO: 36965 - DNA, 20 bp, human
gcggggacgcgagagggacg

SEQ ID NO: 36966 - DNA, 20 bp, human
gcgggaagcggggtttgccg

SEQ ID NO: 36967 - DNA, 20 bp, human
ggtgccccggagccgccaag

SEQ ID NO: 36968 - DNA, 20 bp, human
gaagagggaacgggtcctgg

SEQ ID NO: 36969 - DNA, 20 bp, human
gtgttgcgggaagctcccgg

SEQ ID NO: 36970 - DNA, 20 bp, human
gaaggcgcaggcgcaacggg

SEQ ID NO: 36971 - DNA, 20 bp, human
ggcggcggaagtaggagcct

SEQ ID NO: 36972 - DNA, 20 bp, human
gaggaagagggaacgggtcc

SEQ ID NO: 36973 - DNA, 20 bp, human
ggcccgcggcgtgagacccg

SEQ ID NO: 36974 - DNA, 20 bp, human
ggcttcccgcaacagaaaca

SEQ ID NO: 36975 - DNA, 20 bp, human
gctggatgccgacctgggaa

SEQ ID NO: 36976 - DNA, 20 bp, human
gacccgaaggccggctgcta

SEQ ID NO: 36977 - DNA, 20 bp, human
gcacaccgggagaactgaag

SEQ ID NO: 36978 - DNA, 20 bp, human
ggagcggtggagggcgtcac

SEQ ID NO: 36979 - DNA, 20 bp, human
ggcggagacgcccgacccga

SEQ ID NO: 36980 - DNA, 20 bp, human
gagccgggagcacggtggag

SEQ ID NO: 36981 - DNA, 20 bp, human
gagcacggtggagcggtgga

SEQ ID NO: 36982 - DNA, 20 bp, human
gggaagccccggctccggga

SEQ ID NO: 36983 - DNA, 20 bp, human
gacctcctggggccgacggg

SEQ ID NO: 36984 - DNA, 20 bp, human
gggaatggagccctcaacac

SEQ ID NO: 36985 - DNA, 20 bp, human
gcgccactcactcaactggc

SEQ ID NO: 36986 - DNA, 20 bp, human
ggccccgcccccgtgcccca

SEQ ID NO: 36987 - DNA, 20 bp, human
gggcaaccggaagtggtcca

SEQ ID NO: 36988 - DNA, 20 bp, human
gggcccgcccagcagcacct

SEQ ID NO: 36989 - DNA, 20 bp, human
gagagttgtacgagattcgg

SEQ ID NO: 36990 - DNA, 20 bp, human
ggcaggcgcctcccgagtac

SEQ ID NO: 36991 - DNA, 20 bp, human
gcggcctgacgcccggaccg

SEQ ID NO: 36992 - DNA, 20 bp, human
gggcccgcgcctcataactt

SEQ ID NO: 36993 - DNA, 20 bp, human
gcgcgcacgggtctccttag

SEQ ID NO: 36994 - DNA, 20 bp, human
ggcgggccggcaaccggaag

SEQ ID NO: 36995 - DNA, 20 bp, human
gcacctgggaaacgcccgcg

SEQ ID NO: 36996 - DNA, 20 bp, human
gtgcgggccgccggatccgg

SEQ ID NO: 36997 - DNA, 20 bp, human
ggagaaaggtccgcgggtgc

SEQ ID NO: 36998 - DNA, 20 bp, human
gatgcacccgacgagctagg

SEQ ID NO: 36999 - DNA, 20 bp, human
ggcaaagcagaagagcccgg

SEQ ID NO: 37000 - DNA, 20 bp, human
ggcgacgtgtcggcccccga

SEQ ID NO: 37001 - DNA, 20 bp, human
ggtcgggtgcatgctcgcgg

SEQ ID NO: 37002 - DNA, 20 bp, human
gggcctcggcgcttcctgcg

SEQ ID NO: 37003 - DNA, 20 bp, human
gagaccaagccgctgctggg

SEQ ID NO: 37004 - DNA, 20 bp, human
gagcatgcacccgacgagct

SEQ ID NO: 37005 - DNA, 20 bp, human
ggagctgctggtcacatcca

SEQ ID NO: 37006 - DNA, 20 bp, human
ggaacacccctatcacccgg

SEQ ID NO: 37007 - DNA, 20 bp, human
gggaagcctccgggtgatag

SEQ ID NO: 37008 - DNA, 20 bp, human
gtctgtcccagtcccattca

SEQ ID NO: 37009 - DNA, 20 bp, human
gctggaacacccctatcacc

SEQ ID NO: 37010 - DNA, 20 bp, human
gtgtgactgcaggccactcg

SEQ ID NO: 37011 - DNA, 20 bp, human
gaccctcaggaagaccttcc

SEQ ID NO: 37012 - DNA, 20 bp, human
gccttccgggcagagaccag

SEQ ID NO: 37013 - DNA, 20 bp, human
gcggggctgcttccctgaat

SEQ ID NO: 37014 - DNA, 20 bp, human
gctgcttccctgaatgggac

SEQ ID NO: 37015 - DNA, 20 bp, human
ggcccggaaggtcttcctga

SEQ ID NO: 37016 - DNA, 20 bp, human
gcccacggaaggagacatgg

SEQ ID NO: 37017 - DNA, 20 bp, human
gcaggcactgtgtggagtag

SEQ ID NO: 37018 - DNA, 20 bp, human
gctgtgattctgcccacgga

SEQ ID NO: 37019 - DNA, 20 bp, human
ggagtcccggatccctggag

SEQ ID NO: 37020 - DNA, 20 bp, human
gccggatccctggagtgggt

SEQ ID NO: 37021 - DNA, 20 bp, human
gaagggcttaggaggtggac

SEQ ID NO: 37022 - DNA, 20 bp, human
ggagaggtattcacagtctg

SEQ ID NO: 37023 - DNA, 20 bp, human
gtgggattttagagacactg

SEQ ID NO: 37024 - DNA, 20 bp, human
ggtattcacagtctgagggc

SEQ ID NO: 37025 - DNA, 20 bp, human
gtcaggtatatgctatatga

SEQ ID NO: 37026 - DNA, 20 bp, human
gcgcctcggccggacgctga

SEQ ID NO: 37027 - DNA, 20 bp, human
gacgctgagggagctgacag

SEQ ID NO: 37028 - DNA, 20 bp, human
gcgccgggactcgtagtctg

SEQ ID NO: 37029 - DNA, 20 bp, human
gtccgcggccctgtcggaag

SEQ ID NO: 37030 - DNA, 20 bp, human
gggggaggcggcgggagaaa

SEQ ID NO: 37031 - DNA, 20 bp, human
ggcggggcgcggactagggg

SEQ ID NO: 37032 - DNA, 20 bp, human
gagccgcagactacgagtcc

SEQ ID NO: 37033 - DNA, 20 bp, human
gagagcagaggagaatcggc

SEQ ID NO: 37034 - DNA, 20 bp, human
gcctcaagcggtggccccca

SEQ ID NO: 37035 - DNA, 20 bp, human
gtcggccactgccacgcggg

SEQ ID NO: 37036 - DNA, 20 bp, human
ggcccatggccttcgcccgc

SEQ ID NO: 37037 - DNA, 20 bp, human
gcgagcagcggccccgacag

SEQ ID NO: 37038 - DNA, 20 bp, human
gcgggtgtcagggtcatcca

SEQ ID NO: 37039 - DNA, 20 bp, human
gctgctgggcgcctgtcagg

SEQ ID NO: 37040 - DNA, 20 bp, human
gtcctgcgcgggccactgtc

SEQ ID NO: 37041 - DNA, 20 bp, human
ggcctctgggaggtgcaaga

SEQ ID NO: 37042 - DNA, 20 bp, human
gaggccggcggcgcacagca

SEQ ID NO: 37043 - DNA, 20 bp, human
gcgacccgcgcggccagctg

SEQ ID NO: 37044 - DNA, 20 bp, human
gcctagggcgaagtgagcca

SEQ ID NO: 37045 - DNA, 20 bp, human
gtcccggtccgggaagacca

SEQ ID NO: 37046 - DNA, 20 bp, human
gcggccggcgtagctacacg

SEQ ID NO: 37047 - DNA, 20 bp, human
gtcagctcaggtctcgacgt

SEQ ID NO: 37048 - DNA, 20 bp, human
gcggaggcgacagtgtctag

SEQ ID NO: 37049 - DNA, 20 bp, human
gagggctgaggcgcacggaa

SEQ ID NO: 37050 - DNA, 20 bp, human
gacgggtaggcgaccagctg

SEQ ID NO: 37051 - DNA, 20 bp, human
gaggagcgcgggcacagagt

SEQ ID NO: 37052 - DNA, 20 bp, human
gacgttgtctcaaagccagg

SEQ ID NO: 37053 - DNA, 20 bp, human
gccagaagcgaccagggctg

SEQ ID NO: 37054 - DNA, 20 bp, human
gcgatcgccagaagcgacca

SEQ ID NO: 37055 - DNA, 20 bp, human
ggctccgcgtgtagctacgc

SEQ ID NO: 37056 - DNA, 20 bp, human
gcctctcacaaaggaaatta

SEQ ID NO: 37057 - DNA, 20 bp, human
gtattatactttaacttacg

SEQ ID NO: 37058 - DNA, 20 bp, human
ggttcagtttcctctcacaa

SEQ ID NO: 37059 - DNA, 20 bp, human
ggggaagcaatgaagataat

SEQ ID NO: 37060 - DNA, 20 bp, human
gtggggcctgtagggagtgg

SEQ ID NO: 37061 - DNA, 20 bp, human
gtaataggaatttataagtt

SEQ ID NO: 37062 - DNA, 20 bp, human
gtgtagggagtgggggacta

SEQ ID NO: 37063 - DNA, 20 bp, human
gaggtatatacgcgccatgg

SEQ ID NO: 37064 - DNA, 20 bp, human
gcataggtatatacgcgcca

SEQ ID NO: 37065 - DNA, 20 bp, human
gcactggggcctgtagggag

SEQ ID NO: 37066 - DNA, 20 bp, human
ggtgcctggtgtccaccgag

SEQ ID NO: 37067 - DNA, 20 bp, human
gggacaccaggcactctagt

SEQ ID NO: 37068 - DNA, 20 bp, human
gtgtccaccgagcggctcag

SEQ ID NO: 37069 - DNA, 20 bp, human
gcgcgggagttggcattcgg

SEQ ID NO: 37070 - DNA, 20 bp, human
ggggtgtcgccgctaccggt

SEQ ID NO: 37071 - DNA, 20 bp, human
gcgccctctgagccgctcgg

SEQ ID NO: 37072 - DNA, 20 bp, human
ggagccgctcggtggacacc

SEQ ID NO: 37073 - DNA, 20 bp, human
ggagctaaactggtatccct

SEQ ID NO: 37074 - DNA, 20 bp, human
ggaagacaagaaggacggta

SEQ ID NO: 37075 - DNA, 20 bp, human
ggcacgctgagatcaagatt

SEQ ID NO: 37076 - DNA, 20 bp, human
gcttctcacagcaaagacca

SEQ ID NO: 37077 - DNA, 20 bp, human
gaaagaccacggctcccaca

SEQ ID NO: 37078 - DNA, 20 bp, human
gagcaatcaggtcgttgaag

SEQ ID NO: 37079 - DNA, 20 bp, human
gttgcttgtgcgttccttgt

SEQ ID NO: 37080 - DNA, 20 bp, human
ggactaacctctccaccttc

SEQ ID NO: 37081 - DNA, 20 bp, human
ggggaccctggctttggctg

SEQ ID NO: 37082 - DNA, 20 bp, human
gcctggctagcttcctccaa

SEQ ID NO: 37083 - DNA, 20 bp, human
gtgtttgttgatggggaccc

SEQ ID NO: 37084 - DNA, 20 bp, human
gagtaagtagtggagattca

SEQ ID NO: 37085 - DNA, 20 bp, human
gtattttccacaaaagtctt

SEQ ID NO: 37086 - DNA, 20 bp, human
gcctccgggcgcgagaagag

SEQ ID NO: 37087 - DNA, 20 bp, human
gcccgagcccaggccatccg

SEQ ID NO: 37088 - DNA, 20 bp, human
gcatggcggcggcggcggta

SEQ ID NO: 37089 - DNA, 20 bp, human
gcccgcgagtccagagctgg

SEQ ID NO: 37090 - DNA, 20 bp, human
ggcctcggccgacttctctc

SEQ ID NO: 37091 - DNA, 20 bp, human
ggaaggagggcaggcgacac

SEQ ID NO: 37092 - DNA, 20 bp, human
gcgggtttccgcttccctcc

SEQ ID NO: 37093 - DNA, 20 bp, human
gccaggcgcccgagagaagt

SEQ ID NO: 37094 - DNA, 20 bp, human
gcgactcggccagcaggagg

SEQ ID NO: 37095 - DNA, 20 bp, human
gacagcgccgcggatggcct

SEQ ID NO: 37096 - DNA, 20 bp, human
gcgcccggcacctaccactt

SEQ ID NO: 37097 - DNA, 20 bp, human
gcctcggcagcggaaaggga

SEQ ID NO: 37098 - DNA, 20 bp, human
gtcaaggtcgcccaagtggt

SEQ ID NO: 37099 - DNA, 20 bp, human
gcacttgggcgaccttgagg

SEQ ID NO: 37100 - DNA, 20 bp, human
ggccgcctcggcagcggaaa

SEQ ID NO: 37101 - DNA, 20 bp, human
gcgggcggcagcatgcggag

SEQ ID NO: 37102 - DNA, 20 bp, human
gcgcgccgcgcaggtagtcg

SEQ ID NO: 37103 - DNA, 20 bp, human
gccgcgggcagtcagtcggg

SEQ ID NO: 37104 - DNA, 20 bp, human
ggtgcggctaggccgccctc

SEQ ID NO: 37105 - DNA, 20 bp, human
gctggcgcccgagatcatgg

SEQ ID NO: 37106 - DNA, 20 bp, human
ggcagcagcagaggcactct

SEQ ID NO: 37107 - DNA, 20 bp, human
ggctgggtgagggcccatct

SEQ ID NO: 37108 - DNA, 20 bp, human
gaaggctggccaggagccgg

SEQ ID NO: 37109 - DNA, 20 bp, human
gagagtaggagacgaagaag

SEQ ID NO: 37110 - DNA, 20 bp, human
gggcaggagaggtgtccaga

SEQ ID NO: 37111 - DNA, 20 bp, human
gtaaatgtctccgggtggag

SEQ ID NO: 37112 - DNA, 20 bp, human
gtggggaaggaggctactga

SEQ ID NO: 37113 - DNA, 20 bp, human
gcagccccctagagacccat

SEQ ID NO: 37114 - DNA, 20 bp, human
ggctactgaagggtgagctg

SEQ ID NO: 37115 - DNA, 20 bp, human
gcctccccatgggtctctag

SEQ ID NO: 37116 - DNA, 20 bp, human
gctggagtccgagaagtcaa

SEQ ID NO: 37117 - DNA, 20 bp, human
gctcggactccagaagtccc

SEQ ID NO: 37118 - DNA, 20 bp, human
ggtgagtccgcggtcaggga

SEQ ID NO: 37119 - DNA, 20 bp, human
ggtccgagaagtcaacggcg

SEQ ID NO: 37120 - DNA, 20 bp, human
gagttcgtgggatcccgatg

SEQ ID NO: 37121 - DNA, 20 bp, human
ggaggcgatggagaacggag

SEQ ID NO: 37122 - DNA, 20 bp, human
gggcccgaggcgatggagaa

SEQ ID NO: 37123 - DNA, 20 bp, human
ggcggtgtacagccccacta

SEQ ID NO: 37124 - DNA, 20 bp, human
ggcgggctcaggaaatgcgt

SEQ ID NO: 37125 - DNA, 20 bp, human
ggaggggccgcccggcggaa

SEQ ID NO: 37126 - DNA, 20 bp, human
gtccgcaccacgtgcagcag

SEQ ID NO: 37127 - DNA, 20 bp, human
ggcgaggccgaggttctaca

SEQ ID NO: 37128 - DNA, 20 bp, human
ggccgctgctgcacgtggtg

SEQ ID NO: 37129 - DNA, 20 bp, human
gcagcgcgagccccttggag

SEQ ID NO: 37130 - DNA, 20 bp, human
gcacgtggtgcggacgagcc

SEQ ID NO: 37131 - DNA, 20 bp, human
gcgggtcaggcttcgcaggg

SEQ ID NO: 37132 - DNA, 20 bp, human
gttcagtcagtaggcgggtc

SEQ ID NO: 37133 - DNA, 20 bp, human
ggtcaggcttcgcagggggg

SEQ ID NO: 37134 - DNA, 20 bp, human
gggggccgcgcaatgtcgca

SEQ ID NO: 37135 - DNA, 20 bp, human
gcacgcggccctgctgaaag

SEQ ID NO: 37136 - DNA, 20 bp, human
gtccatcccgagaagcacgg

SEQ ID NO: 37137 - DNA, 20 bp, human
ggggctcccgagctgcgctg

SEQ ID NO: 37138 - DNA, 20 bp, human
gccgcgcaccgaggcgctag

SEQ ID NO: 37139 - DNA, 20 bp, human
gtagggccccagcgcagctc

SEQ ID NO: 37140 - DNA, 20 bp, human
gcacgatctcggccacgatg

SEQ ID NO: 37141 - DNA, 20 bp, human
gcggccacgatgaggaagcc

SEQ ID NO: 37142 - DNA, 20 bp, human
gccgtcggcactcacgatct

SEQ ID NO: 37143 - DNA, 20 bp, human
gctgcccggcttcctcatcg

SEQ ID NO: 37144 - DNA, 20 bp, human
gggctccatcccgagaagca

SEQ ID NO: 37145 - DNA, 20 bp, human
gcgggtgtccctctagtgcg

SEQ ID NO: 37146 - DNA, 20 bp, human
ggctgcgctgcccgcagtac

SEQ ID NO: 37147 - DNA, 20 bp, human
gggacccgagcgcgacggtg

SEQ ID NO: 37148 - DNA, 20 bp, human
gtgtggggaaacgaaactga

SEQ ID NO: 37149 - DNA, 20 bp, human
ggggactggccgggagacat

SEQ ID NO: 37150 - DNA, 20 bp, human
ggtactggacccgagcgcga

SEQ ID NO: 37151 - DNA, 20 bp, human
ggcgctcgggtccagtactg

SEQ ID NO: 37152 - DNA, 20 bp, human
gggggaaacgaaactgaggg

SEQ ID NO: 37153 - DNA, 20 bp, human
gggaggagggaagacataag

SEQ ID NO: 37154 - DNA, 20 bp, human
gctctccctgggcctcggtt

SEQ ID NO: 37155 - DNA, 20 bp, human
ggcagcggcggcgacagtgt

SEQ ID NO: 37156 - DNA, 20 bp, human
gttcgcggagtacagaagct

SEQ ID NO: 37157 - DNA, 20 bp, human
ggccactatggcaacggaag

SEQ ID NO: 37158 - DNA, 20 bp, human
gcgggaagcagccccgagag

SEQ ID NO: 37159 - DNA, 20 bp, human
gggaagccagtcccacctcc

SEQ ID NO: 37160 - DNA, 20 bp, human
gaacggccagtgagtatcca

SEQ ID NO: 37161 - DNA, 20 bp, human
gctgtccggacccgccctcg

SEQ ID NO: 37162 - DNA, 20 bp, human
ggatggtgcgccggactggg

SEQ ID NO: 37163 - DNA, 20 bp, human
ggccccgcagccgcgaatgc

SEQ ID NO: 37164 - DNA, 20 bp, human
gcaaagggagggaccatccc

SEQ ID NO: 37165 - DNA, 20 bp, human
gcgagagcggaagtgcagaa

SEQ ID NO: 37166 - DNA, 20 bp, human
ggcgagtcacaaggagctgg

SEQ ID NO: 37167 - DNA, 20 bp, human
gcaggggccagagcagtcgg

SEQ ID NO: 37168 - DNA, 20 bp, human
gccaggcccgggagaggcga

SEQ ID NO: 37169 - DNA, 20 bp, human
ggggcaggggccagagcagt

SEQ ID NO: 37170 - DNA, 20 bp, human
gggccctgggccgaggagag

SEQ ID NO: 37171 - DNA, 20 bp, human
gacccgagccgcccccgcag

SEQ ID NO: 37172 - DNA, 20 bp, human
gggcgaggaggacgagacgg

SEQ ID NO: 37173 - DNA, 20 bp, human
gacccgggagctggagaccg

SEQ ID NO: 37174 - DNA, 20 bp, human
gaggacctaagtaaatcctc

SEQ ID NO: 37175 - DNA, 20 bp, human
gagaacaccaggcgcggcgc

SEQ ID NO: 37176 - DNA, 20 bp, human
gctgctggaagagaagacat

SEQ ID NO: 37177 - DNA, 20 bp, human
gcggcatcttgatggctcaa

SEQ ID NO: 37178 - DNA, 20 bp, human
gtaagaaccgctgaaaacaa

SEQ ID NO: 37179 - DNA, 20 bp, human
gtagaagatctgctagaaaa

SEQ ID NO: 37180 - DNA, 20 bp, human
gttgcctctcaagcagcctc

SEQ ID NO: 37181 - DNA, 20 bp, human
ggaagacatcggcatcttga

SEQ ID NO: 37182 - DNA, 20 bp, human
ggaaaaaggaacctgatagc

SEQ ID NO: 37183 - DNA, 20 bp, human
gtctactccctaccaagagt

SEQ ID NO: 37184 - DNA, 20 bp, human
gaaccgctgaaaacaatggt

SEQ ID NO: 37185 - DNA, 20 bp, human
gacatgttccaccagctatc

SEQ ID NO: 37186 - DNA, 20 bp, human
gggtacagaacaggactcag

SEQ ID NO: 37187 - DNA, 20 bp, human
gcttccagtagctgatggta

SEQ ID NO: 37188 - DNA, 20 bp, human
gtagctgatggtatggtagg

SEQ ID NO: 37189 - DNA, 20 bp, human
gctcataatagcaggaagag

SEQ ID NO: 37190 - DNA, 20 bp, human
gcttatggcttgcccagtgt

SEQ ID NO: 37191 - DNA, 20 bp, human
gggggggctggtaggctaca

SEQ ID NO: 37192 - DNA, 20 bp, human
gggaaggtcgatgcaggtgt

SEQ ID NO: 37193 - DNA, 20 bp, human
gctggtaggctacagggcag

SEQ ID NO: 37194 - DNA, 20 bp, human
ggcctaccagccccccacac

SEQ ID NO: 37195 - DNA, 20 bp, human
gggaaccatgaggagacata

SEQ ID NO: 37196 - DNA, 20 bp, human
gagaggcgcaggccaaagtg

SEQ ID NO: 37197 - DNA, 20 bp, human
gcccgcgtgtggcgcaggca

SEQ ID NO: 37198 - DNA, 20 bp, human
gaagacggctcgcaaggtag

SEQ ID NO: 37199 - DNA, 20 bp, human
gagcggcgaggtggcgatgg

SEQ ID NO: 37200 - DNA, 20 bp, human
gcgcaggcttagggcagagg

SEQ ID NO: 37201 - DNA, 20 bp, human
gctcggccccaagggcgcac

SEQ ID NO: 37202 - DNA, 20 bp, human
gccgtgtgcagacccgcgtg

SEQ ID NO: 37203 - DNA, 20 bp, human
gtcgcggaatgagggaccga

SEQ ID NO: 37204 - DNA, 20 bp, human
gcgcgaccctcgaagcgtca

SEQ ID NO: 37205 - DNA, 20 bp, human
gagactcggacgcaggcctg

SEQ ID NO: 37206 - DNA, 20 bp, human
gaggttgggaaagttgctag

SEQ ID NO: 37207 - DNA, 20 bp, human
gcccgagtttgggatccatt

SEQ ID NO: 37208 - DNA, 20 bp, human
gtcccaacctccaaaaaatg

SEQ ID NO: 37209 - DNA, 20 bp, human
ggaagaatttgcctaaataa

SEQ ID NO: 37210 - DNA, 20 bp, human
ggcctaatggatcccaaact

SEQ ID NO: 37211 - DNA, 20 bp, human
gccatgaggagcagcatctg

SEQ ID NO: 37212 - DNA, 20 bp, human
ggcccttaagtcgggaacct

SEQ ID NO: 37213 - DNA, 20 bp, human
ggtgcctgccctgcccaact

SEQ ID NO: 37214 - DNA, 20 bp, human
ggtcccatgaaagccccaag

SEQ ID NO: 37215 - DNA, 20 bp, human
gcgggggacaacgtgggtca

SEQ ID NO: 37216 - DNA, 20 bp, human
gttggtggccagggcgaccg

SEQ ID NO: 37217 - DNA, 20 bp, human
gggcgcccacccgggaagga

SEQ ID NO: 37218 - DNA, 20 bp, human
ggtggccgggacacgtggta

SEQ ID NO: 37219 - DNA, 20 bp, human
ggggtcgtggccgggacacg

SEQ ID NO: 37220 - DNA, 20 bp, human
gcctccctggtggagtcgag

SEQ ID NO: 37221 - DNA, 20 bp, human
ggcgcttgctgctggtaaca

SEQ ID NO: 37222 - DNA, 20 bp, human
gtacgcagggacaagctggg

SEQ ID NO: 37223 - DNA, 20 bp, human
ggagtcgagtggaacgaccc

SEQ ID NO: 37224 - DNA, 20 bp, human
gcgagtggaacgacccgggt

SEQ ID NO: 37225 - DNA, 20 bp, human
gccaccagggagggccacgc

SEQ ID NO: 37226 - DNA, 20 bp, human
gcccagaccgcagatctcga

SEQ ID NO: 37227 - DNA, 20 bp, human
ggatctcgaaggttcttgga

SEQ ID NO: 37228 - DNA, 20 bp, human
gtggtcagtcctgtctctag

SEQ ID NO: 37229 - DNA, 20 bp, human
gtcttggaaggaagagcaac

SEQ ID NO: 37230 - DNA, 20 bp, human
gcaagaaccttcgagatctg

SEQ ID NO: 37231 - DNA, 20 bp, human
gctgtctctagtggagactg

SEQ ID NO: 37232 - DNA, 20 bp, human
gagatctgcggtctggggtc

SEQ ID NO: 37233 - DNA, 20 bp, human
gtacttaaacagggtagtga

SEQ ID NO: 37234 - DNA, 20 bp, human
gctggggtctggttgaaaga

SEQ ID NO: 37235 - DNA, 20 bp, human
ggggtctggttgaaagatgg

SEQ ID NO: 37236 - DNA, 20 bp, human
ggagcttgggggcgcgtagg

SEQ ID NO: 37237 - DNA, 20 bp, human
gagcaccgccagcttccgag

SEQ ID NO: 37238 - DNA, 20 bp, human
gggaagctgcgatgcggaca

SEQ ID NO: 37239 - DNA, 20 bp, human
gccagcgagttcatgtcggg

SEQ ID NO: 37240 - DNA, 20 bp, human
ggctccagcgagttcatgtc

SEQ ID NO: 37241 - DNA, 20 bp, human
ggatgcggacagggcagcgg

SEQ ID NO: 37242 - DNA, 20 bp, human
ggcgcgtaggcggccgtacc

SEQ ID NO: 37243 - DNA, 20 bp, human
ggcggggagcggttagaggt

SEQ ID NO: 37244 - DNA, 20 bp, human
gccgcagaggatggagctag

SEQ ID NO: 37245 - DNA, 20 bp, human
ggaaaccaccgcaggaatca

SEQ ID NO: 37246 - DNA, 20 bp, human
gcaaagtgctgggcacatgt

SEQ ID NO: 37247 - DNA, 20 bp, human
gttactggtgacatctctac

SEQ ID NO: 37248 - DNA, 20 bp, human
gagtgatggaggcagacgtg

SEQ ID NO: 37249 - DNA, 20 bp, human
gaaagaagagggctgcggag

SEQ ID NO: 37250 - DNA, 20 bp, human
gcgcccaacctcaaagaaga

SEQ ID NO: 37251 - DNA, 20 bp, human
gtacccgagatagagcttga

SEQ ID NO: 37252 - DNA, 20 bp, human
gctccctcaagctctatctc

SEQ ID NO: 37253 - DNA, 20 bp, human
ggcctgggccgtcagacgtg

SEQ ID NO: 37254 - DNA, 20 bp, human
gaggccaagggggttcatag

SEQ ID NO: 37255 - DNA, 20 bp, human
gctctatctcgggtatgggg

SEQ ID NO: 37256 - DNA, 20 bp, human
ggccgctcccaggcctgcgg

SEQ ID NO: 37257 - DNA, 20 bp, human
gggcttgttgcgaattctca

SEQ ID NO: 37258 - DNA, 20 bp, human
gctgtgataactggtgtatc

SEQ ID NO: 37259 - DNA, 20 bp, human
gggagagtggatggatatag

SEQ ID NO: 37260 - DNA, 20 bp, human
gctccagcagtcgcgccaag

SEQ ID NO: 37261 - DNA, 20 bp, human
ggcagggctctctctagcgg

SEQ ID NO: 37262 - DNA, 20 bp, human
ggggagcggcctgtgataac

SEQ ID NO: 37263 - DNA, 20 bp, human
gagaattcgcaacaagcccc

SEQ ID NO: 37264 - DNA, 20 bp, human
ggaccagagaggagccagaa

SEQ ID NO: 37265 - DNA, 20 bp, human
gccctatgacccagaaaatg

SEQ ID NO: 37266 - DNA, 20 bp, human
ggaagcagcagggtagtggt

SEQ ID NO: 37267 - DNA, 20 bp, human
gggatgaccgaaaaaaccaa

SEQ ID NO: 37268 - DNA, 20 bp, human
gtagtggtgggacccacctg

SEQ ID NO: 37269 - DNA, 20 bp, human
gctgtgcatggagcctgtca

SEQ ID NO: 37270 - DNA, 20 bp, human
ggtgctctggttgtacatgg

SEQ ID NO: 37271 - DNA, 20 bp, human
gtgcatggagcctgtcaggg

SEQ ID NO: 37272 - DNA, 20 bp, human
gtctaagcatgacccaggag

SEQ ID NO: 37273 - DNA, 20 bp, human
gtaagtgctctggttgtaca

SEQ ID NO: 37274 - DNA, 20 bp, human
gacaggctccatgcacagga

SEQ ID NO: 37275 - DNA, 20 bp, human
gaggagtggcttccgcaggt

SEQ ID NO: 37276 - DNA, 20 bp, human
gcgcggagaagctcaaactt

SEQ ID NO: 37277 - DNA, 20 bp, human
gctcccgctggggacgggta

SEQ ID NO: 37278 - DNA, 20 bp, human
gggaggcgctccgcagaccc

SEQ ID NO: 37279 - DNA, 20 bp, human
ggtgacaggaggaaatgtat

SEQ ID NO: 37280 - DNA, 20 bp, human
ggcagggtaaggatttttag

SEQ ID NO: 37281 - DNA, 20 bp, human
ggcggccccagcacacctcc

SEQ ID NO: 37282 - DNA, 20 bp, human
gccggggacagcgtgacagg

SEQ ID NO: 37283 - DNA, 20 bp, human
gaagccctacccgtccccag

SEQ ID NO: 37284 - DNA, 20 bp, human
gcgcagaccctggcgcgccg

SEQ ID NO: 37285 - DNA, 20 bp, human
gggtccggggacagcgtgac

SEQ ID NO: 37286 - DNA, 20 bp, human
ggtgcctgactgcctgaagg

SEQ ID NO: 37287 - DNA, 20 bp, human
ggaagggcagacccttggtg

SEQ ID NO: 37288 - DNA, 20 bp, human
gtggcagcggtgctaaggga

SEQ ID NO: 37289 - DNA, 20 bp, human
gcagcctccttcaggcagtc

SEQ ID NO: 37290 - DNA, 20 bp, human
gagtcccctacaggcagaga

SEQ ID NO: 37291 - DNA, 20 bp, human
gtcgtgtgcaggtatggcag

SEQ ID NO: 37292 - DNA, 20 bp, human
gggtatggcagcggtgctaa

SEQ ID NO: 37293 - DNA, 20 bp, human
ggaggagagatcccacacaa

SEQ ID NO: 37294 - DNA, 20 bp, human
gtactggtggctgaacacaa

SEQ ID NO: 37295 - DNA, 20 bp, human
gcctgcacacgaggatgatg

SEQ ID NO: 37296 - DNA, 20 bp, human
gacgaagggacggaaccaag

SEQ ID NO: 37297 - DNA, 20 bp, human
ggtcgccgacggctatccga

SEQ ID NO: 37298 - DNA, 20 bp, human
gacgccggagtccttctgag

SEQ ID NO: 37299 - DNA, 20 bp, human
gtggcaacggctaaacgcaa

SEQ ID NO: 37300 - DNA, 20 bp, human
gcctagagagggctgactgc

SEQ ID NO: 37301 - DNA, 20 bp, human
ggccgacggctatccgaggg

SEQ ID NO: 37302 - DNA, 20 bp, human
gaaaagtggagccctagaga

SEQ ID NO: 37303 - DNA, 20 bp, human
gggagcaccgcctctcctct

SEQ ID NO: 37304 - DNA, 20 bp, human
gccgcccctcagaaggactc

SEQ ID NO: 37305 - DNA, 20 bp, human
gggccgggcctgcggaaaag

SEQ ID NO: 37306 - DNA, 20 bp, human
gctgaggggccagctacgag

SEQ ID NO: 37307 - DNA, 20 bp, human
gcatctaagcaggtaactca

SEQ ID NO: 37308 - DNA, 20 bp, human
ggacacgggtgaaagatggg

SEQ ID NO: 37309 - DNA, 20 bp, human
ggtcccccaagtcctcctgg

SEQ ID NO: 37310 - DNA, 20 bp, human
gagggacacgggtgaaagat

SEQ ID NO: 37311 - DNA, 20 bp, human
gtggcacggtgggaaacctg

SEQ ID NO: 37312 - DNA, 20 bp, human
gagtgcagtcagcagggaca

SEQ ID NO: 37313 - DNA, 20 bp, human
gcaagaaggcaattcctggc

SEQ ID NO: 37314 - DNA, 20 bp, human
ggaaggcaattcctggctgg

SEQ ID NO: 37315 - DNA, 20 bp, human
gaggctcggtgggaccccga

SEQ ID NO: 37316 - DNA, 20 bp, human
gggcacagtcataaatacag

SEQ ID NO: 37317 - DNA, 20 bp, human
gtcaacaaggtgaagcctat

SEQ ID NO: 37318 - DNA, 20 bp, human
ggaatgaacaaagttctcgt

SEQ ID NO: 37319 - DNA, 20 bp, human
gaggagactatactaggatt

SEQ ID NO: 37320 - DNA, 20 bp, human
ggatttaaacatcttctctg

SEQ ID NO: 37321 - DNA, 20 bp, human
gatgtttaggagactatact

SEQ ID NO: 37322 - DNA, 20 bp, human
gttgctgagactgattactt

SEQ ID NO: 37323 - DNA, 20 bp, human
gagcaatgagaagtcttact

SEQ ID NO: 37324 - DNA, 20 bp, human
gttaaacatcttctctgagg

SEQ ID NO: 37325 - DNA, 20 bp, human
gctggtacatgtactgtgtc

SEQ ID NO: 37326 - DNA, 20 bp, human
gcgccgttgccagcggagaa

SEQ ID NO: 37327 - DNA, 20 bp, human
gagcgccagcatgtagcaga

SEQ ID NO: 37328 - DNA, 20 bp, human
gcggccgccccatccagtag

SEQ ID NO: 37329 - DNA, 20 bp, human
gcgttgccagcggagaaagg

SEQ ID NO: 37330 - DNA, 20 bp, human
ggaacgtgaacgccatggct

SEQ ID NO: 37331 - DNA, 20 bp, human
gactcctcccctactggatg

SEQ ID NO: 37332 - DNA, 20 bp, human
gggagcggcgccgttgccag

SEQ ID NO: 37333 - DNA, 20 bp, human
ggaacgcagcgcggaaccgc

SEQ ID NO: 37334 - DNA, 20 bp, human
gccgccccatccagtagggg

SEQ ID NO: 37335 - DNA, 20 bp, human
gccgcggccctgcattcccg

SEQ ID NO: 37336 - DNA, 20 bp, human
gggatgagcgatcggggccc

SEQ ID NO: 37337 - DNA, 20 bp, human
gggcgaagccgacaagccga

SEQ ID NO: 37338 - DNA, 20 bp, human
ggatcgcaggatgagcgatc

SEQ ID NO: 37339 - DNA, 20 bp, human
gcgggaagaaagccgaccac

SEQ ID NO: 37340 - DNA, 20 bp, human
ggaagaaagccgaccacggg

SEQ ID NO: 37341 - DNA, 20 bp, human
gtcctgcgatccctcgcccg

SEQ ID NO: 37342 - DNA, 20 bp, human
ggcgggccggtgggctcggg

SEQ ID NO: 37343 - DNA, 20 bp, human
gccacggggggtgttaatgg

SEQ ID NO: 37344 - DNA, 20 bp, human
gcgtccgctgccggctgccc

SEQ ID NO: 37345 - DNA, 20 bp, human
ggtgagcatgtagcagaacg

SEQ ID NO: 37346 - DNA, 20 bp, human
ggaaggaaaaggccgcgatg

SEQ ID NO: 37347 - DNA, 20 bp, human
ggtggcggagaagcaggtac

SEQ ID NO: 37348 - DNA, 20 bp, human
gcggccacatgtggagcggt

SEQ ID NO: 37349 - DNA, 20 bp, human
gcgctgttgggggaaggaaa

SEQ ID NO: 37350 - DNA, 20 bp, human
gctgctaccctcacctccag

SEQ ID NO: 37351 - DNA, 20 bp, human
gtctgggccacagacagtgg

SEQ ID NO: 37352 - DNA, 20 bp, human
gggcgccagagcgatctctg

SEQ ID NO: 37353 - DNA, 20 bp, human
gccaccagctgggggagtga

SEQ ID NO: 37354 - DNA, 20 bp, human
gcccagaggtcacggtgggt

SEQ ID NO: 37355 - DNA, 20 bp, human
gcatcagacagaagaggccg

SEQ ID NO: 37356 - DNA, 20 bp, human
gctcgcagtggcaaaggcgg

SEQ ID NO: 37357 - DNA, 20 bp, human
ggccactgcgagaactgtag

SEQ ID NO: 37358 - DNA, 20 bp, human
gcgactccacggaggaccga

SEQ ID NO: 37359 - DNA, 20 bp, human
gggaccctcccgcgccaccg

SEQ ID NO: 37360 - DNA, 20 bp, human
gaccgctacagttctcgcag

SEQ ID NO: 37361 - DNA, 20 bp, human
ggtctggggcgcaggaccaa

SEQ ID NO: 37362 - DNA, 20 bp, human
ggggccaactccagcccggg

SEQ ID NO: 37363 - DNA, 20 bp, human
ggtgcacgcccgcctctcgg

SEQ ID NO: 37364 - DNA, 20 bp, human
gcaagtgtcccggaaaccgg

SEQ ID NO: 37365 - DNA, 20 bp, human
gcacggaggaccgagggagg

SEQ ID NO: 37366 - DNA, 20 bp, human
gcccggcaagggcctatcag

SEQ ID NO: 37367 - DNA, 20 bp, human
ggatgagcgcgcaacaatcg

SEQ ID NO: 37368 - DNA, 20 bp, human
ggcgggtttgacggaaggag

SEQ ID NO: 37369 - DNA, 20 bp, human
gaggcgggcaggccgagacg

SEQ ID NO: 37370 - DNA, 20 bp, human
gggatacgaagtagaccgag

SEQ ID NO: 37371 - DNA, 20 bp, human
gcagcagggcccgtcgggta

SEQ ID NO: 37372 - DNA, 20 bp, human
gccctcactcgggtccgagt

SEQ ID NO: 37373 - DNA, 20 bp, human
gtccgagcgggtttgacgga

SEQ ID NO: 37374 - DNA, 20 bp, human
gggcatccgagcgggtttga

SEQ ID NO: 37375 - DNA, 20 bp, human
ggacgcttctctcccgaggg

SEQ ID NO: 37376 - DNA, 20 bp, human
gtgtcccaccgggaagcggg

SEQ ID NO: 37377 - DNA, 20 bp, human
gcaagttgccacctttccgg

SEQ ID NO: 37378 - DNA, 20 bp, human
ggagacctggacccccggaa

SEQ ID NO: 37379 - DNA, 20 bp, human
gcgggggtccaggtctctac

SEQ ID NO: 37380 - DNA, 20 bp, human
gaacaggagctgattcgagc

SEQ ID NO: 37381 - DNA, 20 bp, human
gcatggaaccggtagagacc

SEQ ID NO: 37382 - DNA, 20 bp, human
gaactgcgggctctatcagt

SEQ ID NO: 37383 - DNA, 20 bp, human
gaggtggcaacttggctgag

SEQ ID NO: 37384 - DNA, 20 bp, human
gggaaattccggcgacagca

SEQ ID NO: 37385 - DNA, 20 bp, human
gcagagcccaggcctaagga

SEQ ID NO: 37386 - DNA, 20 bp, human
ggtgaggcgagcgggcaagt

SEQ ID NO: 37387 - DNA, 20 bp, human
gtcccgcgcgtgaggcgagc

SEQ ID NO: 37388 - DNA, 20 bp, human
ggcccggcggaaatgacgag

SEQ ID NO: 37389 - DNA, 20 bp, human
gctagggacggagaccggag

SEQ ID NO: 37390 - DNA, 20 bp, human
ggggcagctagtcgtgctcg

SEQ ID NO: 37391 - DNA, 20 bp, human
gagccaaccgccggcaggaa

SEQ ID NO: 37392 - DNA, 20 bp, human
gagcacgactagctgcccgg

SEQ ID NO: 37393 - DNA, 20 bp, human
gtggtctccgagtcaagtag

SEQ ID NO: 37394 - DNA, 20 bp, human
gagagccatgggtacggggt

SEQ ID NO: 37395 - DNA, 20 bp, human
gagcgggaactgagcagacc

SEQ ID NO: 37396 - DNA, 20 bp, human
gctgccagggcggcacggga

SEQ ID NO: 37397 - DNA, 20 bp, human
gccagggcggcacgggaggg

SEQ ID NO: 37398 - DNA, 20 bp, human
ggactctccagcccagcgag

SEQ ID NO: 37399 - DNA, 20 bp, human
ggggcgcgccctcccgggaa

SEQ ID NO: 37400 - DNA, 20 bp, human
gacctgcgccgggaaggctc

SEQ ID NO: 37401 - DNA, 20 bp, human
gagcccagcgagaggcgaag

SEQ ID NO: 37402 - DNA, 20 bp, human
gagccagcaggcgagaagac

SEQ ID NO: 37403 - DNA, 20 bp, human
gctcgagagatccgaggaag

SEQ ID NO: 37404 - DNA, 20 bp, human
gggccctgccagggcggcac

SEQ ID NO: 37405 - DNA, 20 bp, human
gtcgcgcctcgagagatccg

SEQ ID NO: 37406 - DNA, 20 bp, human
gagaggacatgctggccggt

SEQ ID NO: 37407 - DNA, 20 bp, human
gaacagaagactgatcaggt

SEQ ID NO: 37408 - DNA, 20 bp, human
gcctcggttgaagtgagcag

SEQ ID NO: 37409 - DNA, 20 bp, human
ggctggccggtgggctctgg

SEQ ID NO: 37410 - DNA, 20 bp, human
gcatgctggccggtgggctc

SEQ ID NO: 37411 - DNA, 20 bp, human
gaacccttcgtgttcttggg

SEQ ID NO: 37412 - DNA, 20 bp, human
gcttggggggaacaacatag

SEQ ID NO: 37413 - DNA, 20 bp, human
gggttaacagaagactgatc

SEQ ID NO: 37414 - DNA, 20 bp, human
ggttccccccaagaacacga

SEQ ID NO: 37415 - DNA, 20 bp, human
gcacataggataggcaggag

SEQ ID NO: 37416 - DNA, 20 bp, human
gtcatggacggcctcaaaga

SEQ ID NO: 37417 - DNA, 20 bp, human
gctgagagagtggatcgagg

SEQ ID NO: 37418 - DNA, 20 bp, human
gtaacaggcacagaaaactg

SEQ ID NO: 37419 - DNA, 20 bp, human
ggggtgacaggccgtcgcat

SEQ ID NO: 37420 - DNA, 20 bp, human
gcgcatcggcaacaacttca

SEQ ID NO: 37421 - DNA, 20 bp, human
gtggctggcttggtgatgtg

SEQ ID NO: 37422 - DNA, 20 bp, human
gtatagggtaggcccatctg

SEQ ID NO: 37423 - DNA, 20 bp, human
gtgattactggccaccccaa

SEQ ID NO: 37424 - DNA, 20 bp, human
ggatgtgcagcaataattaa

SEQ ID NO: 37425 - DNA, 20 bp, human
ggccagccatgaacagctgt

SEQ ID NO: 37426 - DNA, 20 bp, human
gggacggggccgcacaggac

SEQ ID NO: 37427 - DNA, 20 bp, human
gggggccgcacaggacggga

SEQ ID NO: 37428 - DNA, 20 bp, human
gaccttctcgaaggttgagt

SEQ ID NO: 37429 - DNA, 20 bp, human
ggagctcatggctggcgggc

SEQ ID NO: 37430 - DNA, 20 bp, human
gcagggagcttggagacccg

SEQ ID NO: 37431 - DNA, 20 bp, human
gagtgtggccaggagatgac

SEQ ID NO: 37432 - DNA, 20 bp, human
gcacccaggtctgagatctg

SEQ ID NO: 37433 - DNA, 20 bp, human
gcttgaacggaccttctcga

SEQ ID NO: 37434 - DNA, 20 bp, human
gagattcgcgggagcctcag

SEQ ID NO: 37435 - DNA, 20 bp, human
gggcgcccccggcacctccc

SEQ ID NO: 37436 - DNA, 20 bp, human
ggcagccgggtgcttcgcag

SEQ ID NO: 37437 - DNA, 20 bp, human
gtgggcgactgggtccaact

SEQ ID NO: 37438 - DNA, 20 bp, human
ggactggacgcgaccgggac

SEQ ID NO: 37439 - DNA, 20 bp, human
gcgccgtgggacaggactag

SEQ ID NO: 37440 - DNA, 20 bp, human
gacttcggccgagagcccat

SEQ ID NO: 37441 - DNA, 20 bp, human
gtcctggagaggggccgtcg

SEQ ID NO: 37442 - DNA, 20 bp, human
gtcgaactccctcctctggg

SEQ ID NO: 37443 - DNA, 20 bp, human
ggggcggtgcctgggcgact

SEQ ID NO: 37444 - DNA, 20 bp, human
gcagcgccaggccagcccaa

SEQ ID NO: 37445 - DNA, 20 bp, human
gaggctctgtagcacccagt

SEQ ID NO: 37446 - DNA, 20 bp, human
gtgcagggagcagagcgact

SEQ ID NO: 37447 - DNA, 20 bp, human
gtgcgctgggtgcaggatgg

SEQ ID NO: 37448 - DNA, 20 bp, human
ggcagcgctgcggtcccggg

SEQ ID NO: 37449 - DNA, 20 bp, human
gtcatcgaggagcccccggg

SEQ ID NO: 37450 - DNA, 20 bp, human
ggcctcggctgcagcagtcc

SEQ ID NO: 37451 - DNA, 20 bp, human
gtcctctgcgaactcctacc

SEQ ID NO: 37452 - DNA, 20 bp, human
ggagcagagcgactgggcat

SEQ ID NO: 37453 - DNA, 20 bp, human
ggccgggtaggagttcgcag

SEQ ID NO: 37454 - DNA, 20 bp, human
gggcagcagcggtgggtgtc

SEQ ID NO: 37455 - DNA, 20 bp, human
gcgcactcgcacctggacca

SEQ ID NO: 37456 - DNA, 20 bp, human
ggtggagtcagtgtcagtca

SEQ ID NO: 37457 - DNA, 20 bp, human
gagccagctgaggaaccccg

SEQ ID NO: 37458 - DNA, 20 bp, human
ggcgccgccatcttccaagt

SEQ ID NO: 37459 - DNA, 20 bp, human
gggtcaagctgcgggtgtac

SEQ ID NO: 37460 - DNA, 20 bp, human
ggcagcggtgggcgagaatg

SEQ ID NO: 37461 - DNA, 20 bp, human
gggcggttgagaatgatgtg

SEQ ID NO: 37462 - DNA, 20 bp, human
ggccacagccaatcataggg

SEQ ID NO: 37463 - DNA, 20 bp, human
gatgaggagacggtgatcat

SEQ ID NO: 37464 - DNA, 20 bp, human
gcccctgggcgagactgcaa

SEQ ID NO: 37465 - DNA, 20 bp, human
gatcttccaagtgggcagtg

SEQ ID NO: 37466 - DNA, 20 bp, human
gtagctgcggcgggtcggtt

SEQ ID NO: 37467 - DNA, 20 bp, human
gagggggcagcaggcgatgg

SEQ ID NO: 37468 - DNA, 20 bp, human
ggggcagcaggcgatggcgg

SEQ ID NO: 37469 - DNA, 20 bp, human
ggcgttgcccaggcagagcg

SEQ ID NO: 37470 - DNA, 20 bp, human
gggctgcgcgagaggccgag

SEQ ID NO: 37471 - DNA, 20 bp, human
gggcgaagcccgggccgaag

SEQ ID NO: 37472 - DNA, 20 bp, human
gtgcggcgggtcggttaggc

SEQ ID NO: 37473 - DNA, 20 bp, human
gtcgcgcagcacctgcacct

SEQ ID NO: 37474 - DNA, 20 bp, human
gccgccagcagcgccgagtg

SEQ ID NO: 37475 - DNA, 20 bp, human
ggtccagcgcccgctcacgg

SEQ ID NO: 37476 - DNA, 20 bp, human
gcccagcagggcacgatcgt

SEQ ID NO: 37477 - DNA, 20 bp, human
gggagctgcggtgcggaccg

SEQ ID NO: 37478 - DNA, 20 bp, human
gcagctggtggacttgtgga

SEQ ID NO: 37479 - DNA, 20 bp, human
ggcccgggcagttggctcgg

SEQ ID NO: 37480 - DNA, 20 bp, human
gtgagccgcgggaacacgtc

SEQ ID NO: 37481 - DNA, 20 bp, human
gcggcagagccagagcaaca

SEQ ID NO: 37482 - DNA, 20 bp, human
ggcagttggctcggcggcag

SEQ ID NO: 37483 - DNA, 20 bp, human
ggagctgcaacaagtcgtgt

SEQ ID NO: 37484 - DNA, 20 bp, human
ggtgagctcgaggcagctgg

SEQ ID NO: 37485 - DNA, 20 bp, human
gagagcaacatggcgccggt

SEQ ID NO: 37486 - DNA, 20 bp, human
gctccgggaaacgcttccag

SEQ ID NO: 37487 - DNA, 20 bp, human
gttaaccgaagagggggtcg

SEQ ID NO: 37488 - DNA, 20 bp, human
ggacgtgagcgcgcgacctc

SEQ ID NO: 37489 - DNA, 20 bp, human
gcggagctctagggagtgag

SEQ ID NO: 37490 - DNA, 20 bp, human
ggcggagttaaccgaagagg

SEQ ID NO: 37491 - DNA, 20 bp, human
gggtcgtggaggtctcagag

SEQ ID NO: 37492 - DNA, 20 bp, human
gccgggacagagaccaccat

SEQ ID NO: 37493 - DNA, 20 bp, human
gtcgaggagagccggagtcg

SEQ ID NO: 37494 - DNA, 20 bp, human
gctctcctcgaccccctctt

SEQ ID NO: 37495 - DNA, 20 bp, human
gtgggaacgcgagagccggt

SEQ ID NO: 37496 - DNA, 20 bp, human
ggtgaggcggaagctgtgta

SEQ ID NO: 37497 - DNA, 20 bp, human
gacagccgagacagaggatg

SEQ ID NO: 37498 - DNA, 20 bp, human
gtgtgtatggcgggaggctg

SEQ ID NO: 37499 - DNA, 20 bp, human
gtgccgcccccggaagtagt

SEQ ID NO: 37500 - DNA, 20 bp, human
ggctgtggcggtcccttggt

SEQ ID NO: 37501 - DNA, 20 bp, human
gttagcgacagccgagacag

SEQ ID NO: 37502 - DNA, 20 bp, human
gtagaggagtgggcagacgg

SEQ ID NO: 37503 - DNA, 20 bp, human
ggggcggaccctgaactcgg

SEQ ID NO: 37504 - DNA, 20 bp, human
ggtaccgggacgccgtgagg

SEQ ID NO: 37505 - DNA, 20 bp, human
gaggacagcggccagcccgg

SEQ ID NO: 37506 - DNA, 20 bp, human
gcgctttacggccgcgggga

SEQ ID NO: 37507 - DNA, 20 bp, human
gcccctcgggccgggaagag

SEQ ID NO: 37508 - DNA, 20 bp, human
gaagctggcggcgaaggggt

SEQ ID NO: 37509 - DNA, 20 bp, human
ggagcgaggttgatgcccgg

SEQ ID NO: 37510 - DNA, 20 bp, human
ggtcggccttgctgaagtag

SEQ ID NO: 37511 - DNA, 20 bp, human
gacggagcgagccggcgcca

SEQ ID NO: 37512 - DNA, 20 bp, human
gagccggcgccagggcccct

SEQ ID NO: 37513 - DNA, 20 bp, human
gggcggccagcggctcggtg

SEQ ID NO: 37514 - DNA, 20 bp, human
gtcccctcttcccggcccga

SEQ ID NO: 37515 - DNA, 20 bp, human
ggcggtacatctcccagagc

SEQ ID NO: 37516 - DNA, 20 bp, human
gctcccaccgactcacaggg

SEQ ID NO: 37517 - DNA, 20 bp, human
gacaagacggagcggcggta

SEQ ID NO: 37518 - DNA, 20 bp, human
gcccccaggaagcagcgcgg

SEQ ID NO: 37519 - DNA, 20 bp, human
gagcggcggtaagggcggta

SEQ ID NO: 37520 - DNA, 20 bp, human
gcgggacaagaaaattcatg

SEQ ID NO: 37521 - DNA, 20 bp, human
gccaggggcgatgaatggtg

SEQ ID NO: 37522 - DNA, 20 bp, human
gcgtcgccatcttggatccg

SEQ ID NO: 37523 - DNA, 20 bp, human
gtaggctcccgccagcgcgg

SEQ ID NO: 37524 - DNA, 20 bp, human
ggatggcgacgtatccaccg

SEQ ID NO: 37525 - DNA, 20 bp, human
gcgagagacggagagcggag

SEQ ID NO: 37526 - DNA, 20 bp, human
gcaggaacgggagggcgaga

SEQ ID NO: 37527 - DNA, 20 bp, human
ggacgggggtcggggctcaa

SEQ ID NO: 37528 - DNA, 20 bp, human
ggtcgcgatacgctcctcag

SEQ ID NO: 37529 - DNA, 20 bp, human
ggcgctgaggaacgtgaaag

SEQ ID NO: 37530 - DNA, 20 bp, human
gggcgggcacctgggaccag

SEQ ID NO: 37531 - DNA, 20 bp, human
gaggcacctgagccccgaga

SEQ ID NO: 37532 - DNA, 20 bp, human
gaaagaggcgcaggaacggg

SEQ ID NO: 37533 - DNA, 20 bp, human
ggcgatacgctcctcagcgg

SEQ ID NO: 37534 - DNA, 20 bp, human
ggggggtcggggctcaaggg

SEQ ID NO: 37535 - DNA, 20 bp, human
gagcctgacgctctcaccac

SEQ ID NO: 37536 - DNA, 20 bp, human
ggggccaccatcttacatta

SEQ ID NO: 37537 - DNA, 20 bp, human
gaggcgggtgagtctatgcg

SEQ ID NO: 37538 - DNA, 20 bp, human
ggagactctcagctttcggt

SEQ ID NO: 37539 - DNA, 20 bp, human
ggtgggttccacagccagac

SEQ ID NO: 37540 - DNA, 20 bp, human
gctgaccggctacgagagag

SEQ ID NO: 37541 - DNA, 20 bp, human
ggggtcagaaggcagcgcgg

SEQ ID NO: 37542 - DNA, 20 bp, human
gtaactgctgtggcgtaaag

SEQ ID NO: 37543 - DNA, 20 bp, human
gttaccctaatgtaagatgg

SEQ ID NO: 37544 - DNA, 20 bp, human
gagcgggtcagaaggcagcg

SEQ ID NO: 37545 - DNA, 20 bp, human
gcattagggtaagactcctc

SEQ ID NO: 37546 - DNA, 20 bp, human
ggactaaggcggcagaggag

SEQ ID NO: 37547 - DNA, 20 bp, human
gcaaagagcagcgactaagg

SEQ ID NO: 37548 - DNA, 20 bp, human
ggcgctcgctggctgaggga

SEQ ID NO: 37549 - DNA, 20 bp, human
gaccgagcccggccgacggg

SEQ ID NO: 37550 - DNA, 20 bp, human
gctcgctggctgagggacgg

SEQ ID NO: 37551 - DNA, 20 bp, human
gaagcaaacaagcatcatgg

SEQ ID NO: 37552 - DNA, 20 bp, human
ggaacaaagagcagcgacta

SEQ ID NO: 37553 - DNA, 20 bp, human
gcagccgaagcagtggctct

SEQ ID NO: 37554 - DNA, 20 bp, human
gtaaggcggcagaggagcgg

SEQ ID NO: 37555 - DNA, 20 bp, human
gctttcaatgaaaacgaggg

SEQ ID NO: 37556 - DNA, 20 bp, human
gcactctcggtcctactcgg

SEQ ID NO: 37557 - DNA, 20 bp, human
gacggcggccccgggatcag

SEQ ID NO: 37558 - DNA, 20 bp, human
gggtgagagctgctcctagg

SEQ ID NO: 37559 - DNA, 20 bp, human
gcaacactctcggtcctact

SEQ ID NO: 37560 - DNA, 20 bp, human
ggcactcactcagccctccc

SEQ ID NO: 37561 - DNA, 20 bp, human
gaacagcagccatttccccg

SEQ ID NO: 37562 - DNA, 20 bp, human
gggagcagctctcacctgcg

SEQ ID NO: 37563 - DNA, 20 bp, human
ggggagccgcagccacaaag

SEQ ID NO: 37564 - DNA, 20 bp, human
ggccgcagccacaaagcggg

SEQ ID NO: 37565 - DNA, 20 bp, human
gctgacccgcgtctcttcag

SEQ ID NO: 37566 - DNA, 20 bp, human
gcaggacgtgcgaaaagcga

SEQ ID NO: 37567 - DNA, 20 bp, human
gtgtacctggggcttcgcag

SEQ ID NO: 37568 - DNA, 20 bp, human
ggcgcgtagtgatgacgcaa

SEQ ID NO: 37569 - DNA, 20 bp, human
gtccgctgcagccttacggg

SEQ ID NO: 37570 - DNA, 20 bp, human
gggttagggaagtagaaagg

SEQ ID NO: 37571 - DNA, 20 bp, human
ggtgggacggaaattgggag

SEQ ID NO: 37572 - DNA, 20 bp, human
ggacggaaattgggagtgga

SEQ ID NO: 37573 - DNA, 20 bp, human
gtcgcagtgggacggaaatt

SEQ ID NO: 37574 - DNA, 20 bp, human
gcgtcccactgcgaagcccc

SEQ ID NO: 37575 - DNA, 20 bp, human
gcgcgtgaaacaatacgaag

SEQ ID NO: 37576 - DNA, 20 bp, human
gggttctaggagcagatccg

SEQ ID NO: 37577 - DNA, 20 bp, human
gcgggctgactccccgacgg

SEQ ID NO: 37578 - DNA, 20 bp, human
gttacaagataggaaaaccg

SEQ ID NO: 37579 - DNA, 20 bp, human
gccgcttaccgggaccgaca

SEQ ID NO: 37580 - DNA, 20 bp, human
ggaaaagagctccgggccag

SEQ ID NO: 37581 - DNA, 20 bp, human
gaagaccgctctgggcacgg

SEQ ID NO: 37582 - DNA, 20 bp, human
gacgggggcgctcacctcac

SEQ ID NO: 37583 - DNA, 20 bp, human
gctcccaccaaacaaccgga

SEQ ID NO: 37584 - DNA, 20 bp, human
gcgagtcgggcggatcgggt

SEQ ID NO: 37585 - DNA, 20 bp, human
ggactccccgacggcggcga

SEQ ID NO: 37586 - DNA, 20 bp, human
gggacacgggagtccagcgg

SEQ ID NO: 37587 - DNA, 20 bp, human
gcgcctgcgcggagggacac

SEQ ID NO: 37588 - DNA, 20 bp, human
gctctcaccatgatgaggag

SEQ ID NO: 37589 - DNA, 20 bp, human
gggaggtggagccagttcag

SEQ ID NO: 37590 - DNA, 20 bp, human
gcccacgcaggcccgcgctg

SEQ ID NO: 37591 - DNA, 20 bp, human
gccggcctctcaccatgatg

SEQ ID NO: 37592 - DNA, 20 bp, human
gggttccgcgtgatgagact

SEQ ID NO: 37593 - DNA, 20 bp, human
ggtggcgcccctcctcatca

SEQ ID NO: 37594 - DNA, 20 bp, human
gtgccggcaccagcgctccg

SEQ ID NO: 37595 - DNA, 20 bp, human
gggccccggagcgctggtgc

SEQ ID NO: 37596 - DNA, 20 bp, human
gcagcctggtccatagaggg

SEQ ID NO: 37597 - DNA, 20 bp, human
gcccggggaaccctcgatgg

SEQ ID NO: 37598 - DNA, 20 bp, human
gagtataggaatgggcgtag

SEQ ID NO: 37599 - DNA, 20 bp, human
gtggcagcctggtccataga

SEQ ID NO: 37600 - DNA, 20 bp, human
gagccgcggagtataggaat

SEQ ID NO: 37601 - DNA, 20 bp, human
gagggagagccgcggagtat

SEQ ID NO: 37602 - DNA, 20 bp, human
ggaaggaaacgagttgtagg

SEQ ID NO: 37603 - DNA, 20 bp, human
gcagaacgcgggtctgggta

SEQ ID NO: 37604 - DNA, 20 bp, human
ggccgccctgcgaaggtgaa

SEQ ID NO: 37605 - DNA, 20 bp, human
gtccgagaagggccctcgtg

SEQ ID NO: 37606 - DNA, 20 bp, human
ggctgacactgcgcctacac

SEQ ID NO: 37607 - DNA, 20 bp, human
ggactgcctggacctagacc

SEQ ID NO: 37608 - DNA, 20 bp, human
gtactcaagcatgagatcgg

SEQ ID NO: 37609 - DNA, 20 bp, human
ggacccggactcggaacccg

SEQ ID NO: 37610 - DNA, 20 bp, human
gctggacctagacccggact

SEQ ID NO: 37611 - DNA, 20 bp, human
gccagaaaacgaacctgtgt

SEQ ID NO: 37612 - DNA, 20 bp, human
gtctggttgacgaagtaccc

SEQ ID NO: 37613 - DNA, 20 bp, human
gtaccccgggttccgagtcc

SEQ ID NO: 37614 - DNA, 20 bp, human
gggaccagtgcgttgagggt

SEQ ID NO: 37615 - DNA, 20 bp, human
gctcatgcttgagtaggccg

SEQ ID NO: 37616 - DNA, 20 bp, human
gtaacgggacaaactctcag

SEQ ID NO: 37617 - DNA, 20 bp, human
gccttcacgcctggatctaa

SEQ ID NO: 37618 - DNA, 20 bp, human
gtgggtgctgaaacaatgcc

SEQ ID NO: 37619 - DNA, 20 bp, human
gtggagagccaccgggaatg

SEQ ID NO: 37620 - DNA, 20 bp, human
gaaggacggactgtactaca

SEQ ID NO: 37621 - DNA, 20 bp, human
gccctgcacccgcggcgagg

SEQ ID NO: 37622 - DNA, 20 bp, human
ggcttgtgcctcattcccgg

SEQ ID NO: 37623 - DNA, 20 bp, human
gccggcgtgaaacccccgag

SEQ ID NO: 37624 - DNA, 20 bp, human
gaaacccccgaggggaaaag

SEQ ID NO: 37625 - DNA, 20 bp, human
ggcccggcgctgtggacgag

SEQ ID NO: 37626 - DNA, 20 bp, human
ggcacgctggagtcccgctt

SEQ ID NO: 37627 - DNA, 20 bp, human
gtaggtaccagttagcgtca

SEQ ID NO: 37628 - DNA, 20 bp, human
gtgccacacacggggtgtcc

SEQ ID NO: 37629 - DNA, 20 bp, human
gcgccgggacaccccgtgtg

SEQ ID NO: 37630 - DNA, 20 bp, human
ggcgaggagagcaataacta

SEQ ID NO: 37631 - DNA, 20 bp, human
gttcgccgcctgccacacac

SEQ ID NO: 37632 - DNA, 20 bp, human
gggcctcctggcctgactga

SEQ ID NO: 37633 - DNA, 20 bp, human
ggcgattacgtgaggactac

SEQ ID NO: 37634 - DNA, 20 bp, human
gtaggtgaggccctaagtgt

SEQ ID NO: 37635 - DNA, 20 bp, human
gcagctcccctgacgctaac

SEQ ID NO: 37636 - DNA, 20 bp, human
gacgtgtgcagtcccggaag

SEQ ID NO: 37637 - DNA, 20 bp, human
gcggaccctaaaggaccggg

SEQ ID NO: 37638 - DNA, 20 bp, human
gggccgggcccggaccctaa

SEQ ID NO: 37639 - DNA, 20 bp, human
gggaggcacgtgtgcagtcc

SEQ ID NO: 37640 - DNA, 20 bp, human
gcagtcccggaagcggcgag

SEQ ID NO: 37641 - DNA, 20 bp, human
gggagctgaggagaacgact

SEQ ID NO: 37642 - DNA, 20 bp, human
gacccctggagttcacacat

SEQ ID NO: 37643 - DNA, 20 bp, human
gtgttgtcgtggttgctcgg

SEQ ID NO: 37644 - DNA, 20 bp, human
ggtagatgccatgatagggg

SEQ ID NO: 37645 - DNA, 20 bp, human
gcgggcggttcctcctcccg

SEQ ID NO: 37646 - DNA, 20 bp, human
gtagccgcctgggaatttaa

SEQ ID NO: 37647 - DNA, 20 bp, human
gtgtccggcctagaagaagg

SEQ ID NO: 37648 - DNA, 20 bp, human
gggccgggcgatgcctatag

SEQ ID NO: 37649 - DNA, 20 bp, human
gcttgccttcaacttcggga

SEQ ID NO: 37650 - DNA, 20 bp, human
gcaacttcgggaaggtagtg

SEQ ID NO: 37651 - DNA, 20 bp, human
gccgcccgccaatggattgt

SEQ ID NO: 37652 - DNA, 20 bp, human
gctctggatgcagtttgagg

SEQ ID NO: 37653 - DNA, 20 bp, human
gggatgtccggcctagaaga

SEQ ID NO: 37654 - DNA, 20 bp, human
ggtgggtcccttaaattccc

SEQ ID NO: 37655 - DNA, 20 bp, human
gcaatacaggctaggatgtc

SEQ ID NO: 37656 - DNA, 20 bp, human
gacagcgcgagcggagggag

SEQ ID NO: 37657 - DNA, 20 bp, human
gagctctccgtagtcagtgg

SEQ ID NO: 37658 - DNA, 20 bp, human
gcgcgggagacaagaagagg

SEQ ID NO: 37659 - DNA, 20 bp, human
gcagagctctccgtagtcag

SEQ ID NO: 37660 - DNA, 20 bp, human
ggagccagagacagcgcgag

SEQ ID NO: 37661 - DNA, 20 bp, human
gagagctctgcagggagccg

SEQ ID NO: 37662 - DNA, 20 bp, human
gggatgcgaagggtaagacc

SEQ ID NO: 37663 - DNA, 20 bp, human
gggcggaggcggaaaagaag

SEQ ID NO: 37664 - DNA, 20 bp, human
gcagagacagcgcgagcgga

SEQ ID NO: 37665 - DNA, 20 bp, human
gccgggccaagggaaggcgc

SEQ ID NO: 37666 - DNA, 20 bp, human
gactcaacaggtgctctgag

SEQ ID NO: 37667 - DNA, 20 bp, human
gtctcccaggacctggccgt

SEQ ID NO: 37668 - DNA, 20 bp, human
ggcacccacggccaggtcct

SEQ ID NO: 37669 - DNA, 20 bp, human
gctgagtggcacccacggcc

SEQ ID NO: 37670 - DNA, 20 bp, human
gagggataaggtaagaatac

SEQ ID NO: 37671 - DNA, 20 bp, human
ggcttggggtggcactcaac

SEQ ID NO: 37672 - DNA, 20 bp, human
gctcacggttgtgttgtggg

SEQ ID NO: 37673 - DNA, 20 bp, human
gggttgtgttgtgggtggct

SEQ ID NO: 37674 - DNA, 20 bp, human
gatacaggtgttggggaatg

SEQ ID NO: 37675 - DNA, 20 bp, human
gtcacagatgagtgagtgtg

SEQ ID NO: 37676 - DNA, 20 bp, human
gtgccaaggagcgagacccc

SEQ ID NO: 37677 - DNA, 20 bp, human
gctcacgtagctggccgagg

SEQ ID NO: 37678 - DNA, 20 bp, human
ggacagcccgagcctctcaa

SEQ ID NO: 37679 - DNA, 20 bp, human
gaacagccccgggcaggagg

SEQ ID NO: 37680 - DNA, 20 bp, human
gtggagggaagcgagaatgg

SEQ ID NO: 37681 - DNA, 20 bp, human
gggcggtatccagattccgg

SEQ ID NO: 37682 - DNA, 20 bp, human
gcgacggcgcgggttcctag

SEQ ID NO: 37683 - DNA, 20 bp, human
ggcgcccaaggctggacaga

SEQ ID NO: 37684 - DNA, 20 bp, human
gccactgaggtcactgcgat

SEQ ID NO: 37685 - DNA, 20 bp, human
gctgaggtcactgcgatggg

SEQ ID NO: 37686 - DNA, 20 bp, human
ggacccacagtagctgagaa

SEQ ID NO: 37687 - DNA, 20 bp, human
gaaacaggcgacctgagagg

SEQ ID NO: 37688 - DNA, 20 bp, human
gtgagaggcggaggaggtaa

SEQ ID NO: 37689 - DNA, 20 bp, human
ggcgaggggtgcgcagaggg

SEQ ID NO: 37690 - DNA, 20 bp, human
gttctggcgctagtccccta

SEQ ID NO: 37691 - DNA, 20 bp, human
gaccgcggagcatagagcac

SEQ ID NO: 37692 - DNA, 20 bp, human
gggaaaacaggcgacctgag

SEQ ID NO: 37693 - DNA, 20 bp, human
gctcctcacctgggaatcgg

SEQ ID NO: 37694 - DNA, 20 bp, human
ggccagtgctctatgctccg

SEQ ID NO: 37695 - DNA, 20 bp, human
gtccagccggccagccgcga

SEQ ID NO: 37696 - DNA, 20 bp, human
gtcagggagccccagatcgt

SEQ ID NO: 37697 - DNA, 20 bp, human
gcccctgtgcccgggaaccg

SEQ ID NO: 37698 - DNA, 20 bp, human
gcagccgcacccacgatctg

SEQ ID NO: 37699 - DNA, 20 bp, human
gccagggtgtggcagaagac

SEQ ID NO: 37700 - DNA, 20 bp, human
gtgctgggccaagtgaagca

SEQ ID NO: 37701 - DNA, 20 bp, human
ggaaggggacgaggaatcca

SEQ ID NO: 37702 - DNA, 20 bp, human
ggactggagaggagctaagg

SEQ ID NO: 37703 - DNA, 20 bp, human
gtgattggctgaggagtccg

SEQ ID NO: 37704 - DNA, 20 bp, human
ggagccccagatcgtgggtg

SEQ ID NO: 37705 - DNA, 20 bp, human
ggatctggggctccctgaag

SEQ ID NO: 37706 - DNA, 20 bp, human
gacgccggctgccagtgata

SEQ ID NO: 37707 - DNA, 20 bp, human
gccggctgccagtgataggg

SEQ ID NO: 37708 - DNA, 20 bp, human
gagcctctcctccctatcac

SEQ ID NO: 37709 - DNA, 20 bp, human
gggtgagaggcagggaccag

SEQ ID NO: 37710 - DNA, 20 bp, human
gaggatgctggtgagaggca

SEQ ID NO: 37711 - DNA, 20 bp, human
ggccggcgtcgccctcacca

SEQ ID NO: 37712 - DNA, 20 bp, human
gctcgcccgcaacaccctcc

SEQ ID NO: 37713 - DNA, 20 bp, human
gaggcagcgagactctgcaa

SEQ ID NO: 37714 - DNA, 20 bp, human
gttcccctagctgcaagggt

SEQ ID NO: 37715 - DNA, 20 bp, human
gacaccctcctggaggatgc

SEQ ID NO: 37716 - DNA, 20 bp, human
gcccaccccggaagtacctc

SEQ ID NO: 37717 - DNA, 20 bp, human
gcctaagatgtccaactgac

SEQ ID NO: 37718 - DNA, 20 bp, human
gggctggtccaggtgcacgt

SEQ ID NO: 37719 - DNA, 20 bp, human
ggaagagtgcgtgcttcccg

SEQ ID NO: 37720 - DNA, 20 bp, human
gttggaggccagtttgggtg

SEQ ID NO: 37721 - DNA, 20 bp, human
ggcttcccgaggtacttccg

SEQ ID NO: 37722 - DNA, 20 bp, human
gtgcacgtaggtatctggaa

SEQ ID NO: 37723 - DNA, 20 bp, human
gacgcggccagcgctcaggt

SEQ ID NO: 37724 - DNA, 20 bp, human
gaggcatgccacacccaaac

SEQ ID NO: 37725 - DNA, 20 bp, human
gaccagggcgcgcatctccg

SEQ ID NO: 37726 - DNA, 20 bp, human
ggcggctacagaggtcccga

SEQ ID NO: 37727 - DNA, 20 bp, human
gcccaggaaacaagtcagct

SEQ ID NO: 37728 - DNA, 20 bp, human
gcatctcctaaacagcccag

SEQ ID NO: 37729 - DNA, 20 bp, human
gggacagttgagttaaggga

SEQ ID NO: 37730 - DNA, 20 bp, human
gcctgggacagttgagttaa

SEQ ID NO: 37731 - DNA, 20 bp, human
gtacagaggtcccgacggtg

SEQ ID NO: 37732 - DNA, 20 bp, human
gggtttacttctgtctatac

SEQ ID NO: 37733 - DNA, 20 bp, human
gccagatagagcggctacag

SEQ ID NO: 37734 - DNA, 20 bp, human
gagattagccatgggccctc

SEQ ID NO: 37735 - DNA, 20 bp, human
ggagagtcacatctcttatt

SEQ ID NO: 37736 - DNA, 20 bp, human
gccgactgtggactagaggg

SEQ ID NO: 37737 - DNA, 20 bp, human
gctcgggcgcgccctcaaga

SEQ ID NO: 37738 - DNA, 20 bp, human
gccccgcgcgtgcagctgag

SEQ ID NO: 37739 - DNA, 20 bp, human
ggggccgactgtggactaga

SEQ ID NO: 37740 - DNA, 20 bp, human
gcgcgcgtgcagctgagggg

SEQ ID NO: 37741 - DNA, 20 bp, human
ggactagagggaggtggctc

SEQ ID NO: 37742 - DNA, 20 bp, human
gtgagggcgcgcccgagaaa

SEQ ID NO: 37743 - DNA, 20 bp, human
ggacgagtgtgccagcgggg

SEQ ID NO: 37744 - DNA, 20 bp, human
gggacactaggacaaaccgc

SEQ ID NO: 37745 - DNA, 20 bp, human
ggggcgcggtgagtaccctg

SEQ ID NO: 37746 - DNA, 20 bp, human
ggcgctgggggcgaagggtg

SEQ ID NO: 37747 - DNA, 20 bp, human
gctgggcggggtaggtccca

SEQ ID NO: 37748 - DNA, 20 bp, human
ggaaaggcgcgcctccccac

SEQ ID NO: 37749 - DNA, 20 bp, human
gccatgggcgcgctgaggag

SEQ ID NO: 37750 - DNA, 20 bp, human
gccatggctgcggctgctaa

SEQ ID NO: 37751 - DNA, 20 bp, human
gcccaacacgtggggacctg

SEQ ID NO: 37752 - DNA, 20 bp, human
gctagccgtctggaccccat

SEQ ID NO: 37753 - DNA, 20 bp, human
gtcccggccccgctgtggtg

SEQ ID NO: 37754 - DNA, 20 bp, human
gggccctgtgtcaggtatcg

SEQ ID NO: 37755 - DNA, 20 bp, human
gagcggggccgggacccgtg

SEQ ID NO: 37756 - DNA, 20 bp, human
ggctgtcaagtagccagggt

SEQ ID NO: 37757 - DNA, 20 bp, human
gagctcggagccctcttcta

SEQ ID NO: 37758 - DNA, 20 bp, human
gacggcagtgccctagaaga

SEQ ID NO: 37759 - DNA, 20 bp, human
gtgggagcgcatctccccac

SEQ ID NO: 37760 - DNA, 20 bp, human
ggccagggtgggctccgccg

SEQ ID NO: 37761 - DNA, 20 bp, human
gaggcgatatggcatccctg

SEQ ID NO: 37762 - DNA, 20 bp, human
gctcccctgccgaggcgata

SEQ ID NO: 37763 - DNA, 20 bp, human
gtgccttgcccggcacccca

SEQ ID NO: 37764 - DNA, 20 bp, human
ggctcctgctcgcctcggtg

SEQ ID NO: 37765 - DNA, 20 bp, human
ggcgccgggaactcgcccca

SEQ ID NO: 37766 - DNA, 20 bp, human
ggccgcacccggacagcgag

SEQ ID NO: 37767 - DNA, 20 bp, human
gattcctggacacactcctg

SEQ ID NO: 37768 - DNA, 20 bp, human
gtgaggccgccagggcccaa

SEQ ID NO: 37769 - DNA, 20 bp, human
ggatgccgcccacgtagaca

SEQ ID NO: 37770 - DNA, 20 bp, human
gacgtgggcggcatcccgca

SEQ ID NO: 37771 - DNA, 20 bp, human
gcagcacgcagggaagtccc

SEQ ID NO: 37772 - DNA, 20 bp, human
gtccgccctgtctacgtggg

SEQ ID NO: 37773 - DNA, 20 bp, human
gagccccagcacccaccctg

SEQ ID NO: 37774 - DNA, 20 bp, human
gccctccgccctgtctacgt

SEQ ID NO: 37775 - DNA, 20 bp, human
ggccgcccacgtagacaggg

SEQ ID NO: 37776 - DNA, 20 bp, human
gcattcattggctgcttagg

SEQ ID NO: 37777 - DNA, 20 bp, human
ggcagccaatgaatgaaagc

SEQ ID NO: 37778 - DNA, 20 bp, human
gacctcaacttagaaaatat

SEQ ID NO: 37779 - DNA, 20 bp, human
gggcttacaaaaataaggga

SEQ ID NO: 37780 - DNA, 20 bp, human
ggcaggatcaactgtttcca

SEQ ID NO: 37781 - DNA, 20 bp, human
gtttccaaaggaacttaaag

SEQ ID NO: 37782 - DNA, 20 bp, human
gtttcattcattggctgctt

SEQ ID NO: 37783 - DNA, 20 bp, human
gtgtttttctttgctactgg

SEQ ID NO: 37784 - DNA, 20 bp, human
gaattctctaatctgataat

SEQ ID NO: 37785 - DNA, 20 bp, human
gtcctatattttctaagttg

SEQ ID NO: 37786 - DNA, 20 bp, human
gctggcgagagcctcgggtg

SEQ ID NO: 37787 - DNA, 20 bp, human
gcccggtgctgaggtaagtg

SEQ ID NO: 37788 - DNA, 20 bp, human
gagtagcccgaaccagtcgg

SEQ ID NO: 37789 - DNA, 20 bp, human
gggcgccggcacagtccgag

SEQ ID NO: 37790 - DNA, 20 bp, human
gggtgctgaggtaagtgagg

SEQ ID NO: 37791 - DNA, 20 bp, human
gggcagtagcccgaaccagt

SEQ ID NO: 37792 - DNA, 20 bp, human
gcgggttgcccgaaggacag

SEQ ID NO: 37793 - DNA, 20 bp, human
gccgagagcccggaatgctg

SEQ ID NO: 37794 - DNA, 20 bp, human
gaacccggcgccagaggcca

SEQ ID NO: 37795 - DNA, 20 bp, human
ggcacagtccgaggggcccg

SEQ ID NO: 37796 - DNA, 20 bp, human
ggagcggaactgcgagaagg

SEQ ID NO: 37797 - DNA, 20 bp, human
gggggagcggaactgcgaga

SEQ ID NO: 37798 - DNA, 20 bp, human
ggtgccattaaagctcgggg

SEQ ID NO: 37799 - DNA, 20 bp, human
gctcgcagcagacgggaccc

SEQ ID NO: 37800 - DNA, 20 bp, human
gattaaagctcggggcggag

SEQ ID NO: 37801 - DNA, 20 bp, human
ggaggaaggacagtggagtc

SEQ ID NO: 37802 - DNA, 20 bp, human
gcaactacggcgtgggggag

SEQ ID NO: 37803 - DNA, 20 bp, human
gcggagaggatgcgttacct

SEQ ID NO: 37804 - DNA, 20 bp, human
gcctgcctctcgcagcagac

SEQ ID NO: 37805 - DNA, 20 bp, human
gataaccaactacggcgtgg

SEQ ID NO: 37806 - DNA, 20 bp, human
gcatgtgcaaagctctcgtt

SEQ ID NO: 37807 - DNA, 20 bp, human
gtggagatagtcactcctgt

SEQ ID NO: 37808 - DNA, 20 bp, human
gcaggcagaaccaagccgta

SEQ ID NO: 37809 - DNA, 20 bp, human
gggaggttaggatcaaacca

SEQ ID NO: 37810 - DNA, 20 bp, human
gtaaaactaatgggcaagac

SEQ ID NO: 37811 - DNA, 20 bp, human
gggatgacagtgctaattct

SEQ ID NO: 37812 - DNA, 20 bp, human
gccatctgccgttacagaaa

SEQ ID NO: 37813 - DNA, 20 bp, human
gtaattctgggactttcaga

SEQ ID NO: 37814 - DNA, 20 bp, human
gttgctgcagtaaaactaat

SEQ ID NO: 37815 - DNA, 20 bp, human
gagagccacgcaatactcag

SEQ ID NO: 37816 - DNA, 20 bp, human
gccgcggtctcaggagccga

SEQ ID NO: 37817 - DNA, 20 bp, human
gctgtgagtgttgggcttgg

SEQ ID NO: 37818 - DNA, 20 bp, human
gtgcgcggggtccgggaaac

SEQ ID NO: 37819 - DNA, 20 bp, human
ggccggagccgttcacaggg

SEQ ID NO: 37820 - DNA, 20 bp, human
ggcagccgcctccctgtgaa

SEQ ID NO: 37821 - DNA, 20 bp, human
gcatgcagggctgacggtcc

SEQ ID NO: 37822 - DNA, 20 bp, human
ggagagaagagcggaggacc

SEQ ID NO: 37823 - DNA, 20 bp, human
ggccggagatgcatcatgca

SEQ ID NO: 37824 - DNA, 20 bp, human
gctgtgaacggctccggcta

SEQ ID NO: 37825 - DNA, 20 bp, human
ggcggccccgaaccgcattg

SEQ ID NO: 37826 - DNA, 20 bp, human
gtctcccttcaagaacccta

SEQ ID NO: 37827 - DNA, 20 bp, human
gtgcagtccgactctccgta

SEQ ID NO: 37828 - DNA, 20 bp, human
gcaagaaccctacggagagt

SEQ ID NO: 37829 - DNA, 20 bp, human
ggcatccttcgcctcccggc

SEQ ID NO: 37830 - DNA, 20 bp, human
gcatctccgcagcgagctct

SEQ ID NO: 37831 - DNA, 20 bp, human
gctagagagactgatgtaga

SEQ ID NO: 37832 - DNA, 20 bp, human
gggctgcaagtgtgtgacag

SEQ ID NO: 37833 - DNA, 20 bp, human
gtgatcggttggcaagagct

SEQ ID NO: 37834 - DNA, 20 bp, human
gcctggtcttggtgatcggt

SEQ ID NO: 37835 - DNA, 20 bp, human
gtcagtgcggcattgatgtt

SEQ ID NO: 37836 - DNA, 20 bp, human
ggaccgctgctgcgaggagt

SEQ ID NO: 37837 - DNA, 20 bp, human
ggaaaagacggagggaggtg

SEQ ID NO: 37838 - DNA, 20 bp, human
gaagtgttaaccggtcacat

SEQ ID NO: 37839 - DNA, 20 bp, human
gtcccccaaaagatcttgag

SEQ ID NO: 37840 - DNA, 20 bp, human
gtgatttaaaacttgctggg

SEQ ID NO: 37841 - DNA, 20 bp, human
gggcggtgtggatgcttgtt

SEQ ID NO: 37842 - DNA, 20 bp, human
ggcccaataaatgtgaacat

SEQ ID NO: 37843 - DNA, 20 bp, human
ggtgaacatgggatctgtca

SEQ ID NO: 37844 - DNA, 20 bp, human
gtgcttttcagtgaggagtc

SEQ ID NO: 37845 - DNA, 20 bp, human
gtgctgagtgcttttcagtg

SEQ ID NO: 37846 - DNA, 20 bp, human
ggacaggcgccggagctcgg

SEQ ID NO: 37847 - DNA, 20 bp, human
ggctctcgcgcccgacgagg

SEQ ID NO: 37848 - DNA, 20 bp, human
ggcgcccgacgaggtggatt

SEQ ID NO: 37849 - DNA, 20 bp, human
gggcgcctgtcgttctaatt

SEQ ID NO: 37850 - DNA, 20 bp, human
ggctggaatcagcacccggg

SEQ ID NO: 37851 - DNA, 20 bp, human
gccagctctcgcgcccgacg

SEQ ID NO: 37852 - DNA, 20 bp, human
gggagcgtctgggcacggga

SEQ ID NO: 37853 - DNA, 20 bp, human
gcagccaaatccacctcgtc

SEQ ID NO: 37854 - DNA, 20 bp, human
gctgtgagtacgaggagctg

SEQ ID NO: 37855 - DNA, 20 bp, human
gggagggaccgctcactcgg

SEQ ID NO: 37856 - DNA, 20 bp, human
gggtagagcgggagaagttc

SEQ ID NO: 37857 - DNA, 20 bp, human
gccgcaggctgaggtagagc

SEQ ID NO: 37858 - DNA, 20 bp, human
gtctttcctcaggggcccag

SEQ ID NO: 37859 - DNA, 20 bp, human
gcgagcagtcccgcaggctg

SEQ ID NO: 37860 - DNA, 20 bp, human
gcctcaggggcccagcggcg

SEQ ID NO: 37861 - DNA, 20 bp, human
ggttcgggctctttcctcag

SEQ ID NO: 37862 - DNA, 20 bp, human
gccggcacaacacaacaaaa

SEQ ID NO: 37863 - DNA, 20 bp, human
gggatgtgccagctgtctgt

SEQ ID NO: 37864 - DNA, 20 bp, human
gggatgaagaaccagagtgt

SEQ ID NO: 37865 - DNA, 20 bp, human
gaggtgtggaagttagggtg

SEQ ID NO: 37866 - DNA, 20 bp, human
ggtcatcgaggcgagagagg

SEQ ID NO: 37867 - DNA, 20 bp, human
gtccccaatttgccaaagtg

SEQ ID NO: 37868 - DNA, 20 bp, human
gcgtgagagggggatctcag

SEQ ID NO: 37869 - DNA, 20 bp, human
gcccctacgctcaaaaccgt

SEQ ID NO: 37870 - DNA, 20 bp, human
gaggcggagccgtggacagt

SEQ ID NO: 37871 - DNA, 20 bp, human
gaccaattgagggactagta

SEQ ID NO: 37872 - DNA, 20 bp, human
ggacgtcatcgaggcgagag

SEQ ID NO: 37873 - DNA, 20 bp, human
gcgtcggggcagaggatctc

SEQ ID NO: 37874 - DNA, 20 bp, human
gtggttccagtctcaagaga

SEQ ID NO: 37875 - DNA, 20 bp, human
gtgagggactagtagggcag

SEQ ID NO: 37876 - DNA, 20 bp, human
gtccaggcttgggaaagcac

SEQ ID NO: 37877 - DNA, 20 bp, human
ggagcatgacgagttcttcc

SEQ ID NO: 37878 - DNA, 20 bp, human
gtccctcacgggtcacatcg

SEQ ID NO: 37879 - DNA, 20 bp, human
gctcacaggttagtctcccg

SEQ ID NO: 37880 - DNA, 20 bp, human
gccgtccgctcggagttagg

SEQ ID NO: 37881 - DNA, 20 bp, human
gctctcgaagagttgggact

SEQ ID NO: 37882 - DNA, 20 bp, human
gagggtcctctcgaagagtt

SEQ ID NO: 37883 - DNA, 20 bp, human
gctcacgggtcacatcgcgg

SEQ ID NO: 37884 - DNA, 20 bp, human
gccgctggcgcgcaggaccg

SEQ ID NO: 37885 - DNA, 20 bp, human
gggcacctggtaaccttcag

SEQ ID NO: 37886 - DNA, 20 bp, human
ggaagggaggagtggcaaca

SEQ ID NO: 37887 - DNA, 20 bp, human
gctccacgcttagaatccag

SEQ ID NO: 37888 - DNA, 20 bp, human
gtcgggagctggtgaccctc

SEQ ID NO: 37889 - DNA, 20 bp, human
ggtggcagaaggtcctacca

SEQ ID NO: 37890 - DNA, 20 bp, human
gtcaaggggaccgcatatag

SEQ ID NO: 37891 - DNA, 20 bp, human
ggaacccggaacatcgtgac

SEQ ID NO: 37892 - DNA, 20 bp, human
gcgagcccgagctctggcaa

SEQ ID NO: 37893 - DNA, 20 bp, human
gtcgtgaccggcctaggcat

SEQ ID NO: 37894 - DNA, 20 bp, human
gagagtggtagagcaaatct

SEQ ID NO: 37895 - DNA, 20 bp, human
gcttgagtctacaacacgga

SEQ ID NO: 37896 - DNA, 20 bp, human
ggttcttcaggaggcgttgc

SEQ ID NO: 37897 - DNA, 20 bp, human
ggaaacccaagccgccgcgt

SEQ ID NO: 37898 - DNA, 20 bp, human
gaacgcacgctcctacgcgg

SEQ ID NO: 37899 - DNA, 20 bp, human
gccgaacgcacgctcctacg

SEQ ID NO: 37900 - DNA, 20 bp, human
gttcctgaaaggatgtacag

SEQ ID NO: 37901 - DNA, 20 bp, human
gcaggaaccagcccctcgtg

SEQ ID NO: 37902 - DNA, 20 bp, human
gaaagcgcttgggctactat

SEQ ID NO: 37903 - DNA, 20 bp, human
gcgatgctcaccgaacaggt

SEQ ID NO: 37904 - DNA, 20 bp, human
gtgtgcacgctccccacgag

SEQ ID NO: 37905 - DNA, 20 bp, human
gtcagggtaggctagatggt

SEQ ID NO: 37906 - DNA, 20 bp, human
ggcctcgctcgctcccgacc

SEQ ID NO: 37907 - DNA, 20 bp, human
ggacccggttgcaagtgttg

SEQ ID NO: 37908 - DNA, 20 bp, human
gggacaggggtcgtcaccac

SEQ ID NO: 37909 - DNA, 20 bp, human
gcggttgcaagtgttgcggt

SEQ ID NO: 37910 - DNA, 20 bp, human
gagtcgcgtccgcatcggag

SEQ ID NO: 37911 - DNA, 20 bp, human
gcggcgcttcccctccgatg

SEQ ID NO: 37912 - DNA, 20 bp, human
gtggggctccgacagctcag

SEQ ID NO: 37913 - DNA, 20 bp, human
gacgataaacgcaccctgtc

SEQ ID NO: 37914 - DNA, 20 bp, human
gttccggtcccctgagactg

SEQ ID NO: 37915 - DNA, 20 bp, human
gcctttacaaaaacccgaca

SEQ ID NO: 37916 - DNA, 20 bp, human
gcacgcaggccaccaaccgg

SEQ ID NO: 37917 - DNA, 20 bp, human
gcgcggctcggggacagtaa

SEQ ID NO: 37918 - DNA, 20 bp, human
ggttctgtcccagtcgctta

SEQ ID NO: 37919 - DNA, 20 bp, human
gcactgcagggtcgccccgc

SEQ ID NO: 37920 - DNA, 20 bp, human
gggacagtaagggacctccc

SEQ ID NO: 37921 - DNA, 20 bp, human
gtgagctgccctaagcgact

SEQ ID NO: 37922 - DNA, 20 bp, human
ggtgagataagcctcaagag

SEQ ID NO: 37923 - DNA, 20 bp, human
gaactcacgcggcgaaaccg

SEQ ID NO: 37924 - DNA, 20 bp, human
gcttctagagcttgagccag

SEQ ID NO: 37925 - DNA, 20 bp, human
gccgcaaaaagcaactcacg

SEQ ID NO: 37926 - DNA, 20 bp, human
gggttccacttgcaccaccg

SEQ ID NO: 37927 - DNA, 20 bp, human
ggccagggaagcctccgcgg

SEQ ID NO: 37928 - DNA, 20 bp, human
ggcagccagggaagcctccg

SEQ ID NO: 37929 - DNA, 20 bp, human
gtccacttgcaccaccgcgg

SEQ ID NO: 37930 - DNA, 20 bp, human
gccaggcctgcggacagtca

SEQ ID NO: 37931 - DNA, 20 bp, human
ggcctccgcggtggtgcaag

SEQ ID NO: 37932 - DNA, 20 bp, human
ggcggacagtcagggagacg

SEQ ID NO: 37933 - DNA, 20 bp, human
gcactgaaacctcaaggctt

SEQ ID NO: 37934 - DNA, 20 bp, human
gggaccttggaccccagaga

SEQ ID NO: 37935 - DNA, 20 bp, human
gaccaccgcggaggcttccc

SEQ ID NO: 37936 - DNA, 20 bp, human
ggcccgcgtgggaggacgat

SEQ ID NO: 37937 - DNA, 20 bp, human
gggccggcggaggacagcgg

SEQ ID NO: 37938 - DNA, 20 bp, human
ggcgcggaaaaagtgaatga

SEQ ID NO: 37939 - DNA, 20 bp, human
ggttacctgggcaacgaccc

SEQ ID NO: 37940 - DNA, 20 bp, human
ggtcctccgccggcccgcgt

SEQ ID NO: 37941 - DNA, 20 bp, human
gcggcccgacacggttacct

SEQ ID NO: 37942 - DNA, 20 bp, human
gctccggccccggcccgaca

SEQ ID NO: 37943 - DNA, 20 bp, human
gggaggacgatgggtcagcg

SEQ ID NO: 37944 - DNA, 20 bp, human
gcctacggcaaacacttggg

SEQ ID NO: 37945 - DNA, 20 bp, human
ggctccccgctccaccccta

SEQ ID NO: 37946 - DNA, 20 bp, human
gtcctggcttgagagccgag

SEQ ID NO: 37947 - DNA, 20 bp, human
gctagaccttgtagagacgg

SEQ ID NO: 37948 - DNA, 20 bp, human
ggcgggcgcccagagcacgg

SEQ ID NO: 37949 - DNA, 20 bp, human
ggaccttgtagagacggcgg

SEQ ID NO: 37950 - DNA, 20 bp, human
gaggtggaagcgcacccggg

SEQ ID NO: 37951 - DNA, 20 bp, human
gctagcgggcgcccagagca

SEQ ID NO: 37952 - DNA, 20 bp, human
gagccgagcggcaagagcgc

SEQ ID NO: 37953 - DNA, 20 bp, human
gggaagccgcgagggagaac

SEQ ID NO: 37954 - DNA, 20 bp, human
gcgccgccgccgtctctaca

SEQ ID NO: 37955 - DNA, 20 bp, human
gcgccctccccggtgagagg

SEQ ID NO: 37956 - DNA, 20 bp, human
gggtggatctcgagcaggtg

SEQ ID NO: 37957 - DNA, 20 bp, human
gacccggctgcgcccgagtg

SEQ ID NO: 37958 - DNA, 20 bp, human
gggccttgccttccgcactc

SEQ ID NO: 37959 - DNA, 20 bp, human
ggcgcctcccagacctagag

SEQ ID NO: 37960 - DNA, 20 bp, human
gaggccgagagccgggatcc

SEQ ID NO: 37961 - DNA, 20 bp, human
gcaaggggccggggtcgtga

SEQ ID NO: 37962 - DNA, 20 bp, human
gagccgggtggatctcgagc

SEQ ID NO: 37963 - DNA, 20 bp, human
gaacagggacagaggcgtca

SEQ ID NO: 37964 - DNA, 20 bp, human
ggcgcccctctaggtctggg

SEQ ID NO: 37965 - DNA, 20 bp, human
gtgggagcgacaaagaaaca

SEQ ID NO: 37966 - DNA, 20 bp, human
gaacctcacccgcgctgaag

SEQ ID NO: 37967 - DNA, 20 bp, human
gggcgtaggtagatcgccgg

SEQ ID NO: 37968 - DNA, 20 bp, human
ggtctgggactgacagaggg

SEQ ID NO: 37969 - DNA, 20 bp, human
gaggcgggcgcagtactggt

SEQ ID NO: 37970 - DNA, 20 bp, human
gctcctggctaaggaaggtg

SEQ ID NO: 37971 - DNA, 20 bp, human
gaggagctgcggcagatggt

SEQ ID NO: 37972 - DNA, 20 bp, human
gagcgcgggtgaggttgccg

SEQ ID NO: 37973 - DNA, 20 bp, human
gcggtaccgcgacctgatcg

SEQ ID NO: 37974 - DNA, 20 bp, human
gagaggtgaggtcgccaggt

SEQ ID NO: 37975 - DNA, 20 bp, human
gcaaagggtgaggggcggat

SEQ ID NO: 37976 - DNA, 20 bp, human
gagaccgccacagagggcac

SEQ ID NO: 37977 - DNA, 20 bp, human
gcctgtgccgtggaaactgg

SEQ ID NO: 37978 - DNA, 20 bp, human
ggaggctgcgcagaccgact

SEQ ID NO: 37979 - DNA, 20 bp, human
ggctgcgcagaccgactcgg

SEQ ID NO: 37980 - DNA, 20 bp, human
gcggccaccgccagtttcca

SEQ ID NO: 37981 - DNA, 20 bp, human
gccaagcgagaaaacgcagg

SEQ ID NO: 37982 - DNA, 20 bp, human
ggatccaagcgagaaaacgc

SEQ ID NO: 37983 - DNA, 20 bp, human
gccgaagagaccgccacaga

SEQ ID NO: 37984 - DNA, 20 bp, human
gccccggagccgggccatga

SEQ ID NO: 37985 - DNA, 20 bp, human
gcagggcagaggcaccctca

SEQ ID NO: 37986 - DNA, 20 bp, human
ggacggcgccgctgaccgac

SEQ ID NO: 37987 - DNA, 20 bp, human
ggtattggagctgaaggcgg

SEQ ID NO: 37988 - DNA, 20 bp, human
gaggagtggagagatatcct

SEQ ID NO: 37989 - DNA, 20 bp, human
ggaccccgacagagagacct

SEQ ID NO: 37990 - DNA, 20 bp, human
ggagatgaggcccctcccac

SEQ ID NO: 37991 - DNA, 20 bp, human
gtcagcagcagcgagatgga

SEQ ID NO: 37992 - DNA, 20 bp, human
gttggaagctccggttctcc

SEQ ID NO: 37993 - DNA, 20 bp, human
gggcccaggtctctctgtcg

SEQ ID NO: 37994 - DNA, 20 bp, human
gcctgacagcctgggagatg

SEQ ID NO: 37995 - DNA, 20 bp, human
gctgctgctgaaggccgcga

SEQ ID NO: 37996 - DNA, 20 bp, human
gtcgcctccgaagctgtcag

SEQ ID NO: 37997 - DNA, 20 bp, human
gggatcagggaaatcaacgg

SEQ ID NO: 37998 - DNA, 20 bp, human
gcagcttcggaggcgaatca

SEQ ID NO: 37999 - DNA, 20 bp, human
ggcacccctgacagcttcgg

SEQ ID NO: 38000 - DNA, 20 bp, human
gcgaatggggaccaagatgg

SEQ ID NO: 38001 - DNA, 20 bp, human
gggtgcagcagccgtctgag

SEQ ID NO: 38002 - DNA, 20 bp, human
gggaccggaagtgccgaatg

SEQ ID NO: 38003 - DNA, 20 bp, human
gaatcaacgggggtctaggg

SEQ ID NO: 38004 - DNA, 20 bp, human
gcatggatcagggaaatcaa

SEQ ID NO: 38005 - DNA, 20 bp, human
gtggaggatctagggagagt

SEQ ID NO: 38006 - DNA, 20 bp, human
gcggcacctgccaacatgga

SEQ ID NO: 38007 - DNA, 20 bp, human
gccgccgccaccttccatgt

SEQ ID NO: 38008 - DNA, 20 bp, human
gtagctggcctcggagctcg

SEQ ID NO: 38009 - DNA, 20 bp, human
ggctgctgacgacatcaacc

SEQ ID NO: 38010 - DNA, 20 bp, human
gggaccgcgttggcagccac

SEQ ID NO: 38011 - DNA, 20 bp, human
gaccccttcgtcaagaactg

SEQ ID NO: 38012 - DNA, 20 bp, human
gttgggctcccgaaacttca

SEQ ID NO: 38013 - DNA, 20 bp, human
gaccccaggagtgccaatca

SEQ ID NO: 38014 - DNA, 20 bp, human
ggcggctgcagctacagtcc

SEQ ID NO: 38015 - DNA, 20 bp, human
gaacccggcacctgccaaca

SEQ ID NO: 38016 - DNA, 20 bp, human
gacgcgcagcgctatggcag

SEQ ID NO: 38017 - DNA, 20 bp, human
gggcgggacgcgcagcgcta

SEQ ID NO: 38018 - DNA, 20 bp, human
gacgcggctggacaacgaca

SEQ ID NO: 38019 - DNA, 20 bp, human
ggccgggacgagggagaccg

SEQ ID NO: 38020 - DNA, 20 bp, human
ggcgctatggcagagggcag

SEQ ID NO: 38021 - DNA, 20 bp, human
gcccatccagagagccttga

SEQ ID NO: 38022 - DNA, 20 bp, human
gaacctccggaaaagcgaag

SEQ ID NO: 38023 - DNA, 20 bp, human
gggatgggattggtgaacgg

SEQ ID NO: 38024 - DNA, 20 bp, human
gctgccaacggcctcaacaa

SEQ ID NO: 38025 - DNA, 20 bp, human
gcacagccaaacgcctccag

SEQ ID NO: 38026 - DNA, 20 bp, human
gcgacttcgacgtgaaggag

SEQ ID NO: 38027 - DNA, 20 bp, human
ggcctgaggcagttccgcca

SEQ ID NO: 38028 - DNA, 20 bp, human
gttgcgtgaggcactcaggt

SEQ ID NO: 38029 - DNA, 20 bp, human
gggcgaaccccagaaacgcc

SEQ ID NO: 38030 - DNA, 20 bp, human
gaggtcaccgaacttgcgtg

SEQ ID NO: 38031 - DNA, 20 bp, human
gcccagccgagagcagggga

SEQ ID NO: 38032 - DNA, 20 bp, human
gaccccagaaacgccaggac

SEQ ID NO: 38033 - DNA, 20 bp, human
gtgaggcactcaggtgggcg

SEQ ID NO: 38034 - DNA, 20 bp, human
ggaacttgcgtgaggcactc

SEQ ID NO: 38035 - DNA, 20 bp, human
gaggaacttggagaagtcca

SEQ ID NO: 38036 - DNA, 20 bp, human
gaccgcggcgactatcccat

SEQ ID NO: 38037 - DNA, 20 bp, human
gtgtggccgtggctaccgat

SEQ ID NO: 38038 - DNA, 20 bp, human
gaccgatgggatagtcgccg

SEQ ID NO: 38039 - DNA, 20 bp, human
ggctgggaagatggcgaccg

SEQ ID NO: 38040 - DNA, 20 bp, human
gtcgccgagagccgctgctg

SEQ ID NO: 38041 - DNA, 20 bp, human
ggacgcgcctggcgctaaag

SEQ ID NO: 38042 - DNA, 20 bp, human
gactatcccatcggtagcca

SEQ ID NO: 38043 - DNA, 20 bp, human
gcgccccttgtggtccggaa

SEQ ID NO: 38044 - DNA, 20 bp, human
ggcggctctcggcgaggtgg

SEQ ID NO: 38045 - DNA, 20 bp, human
gcggccacagcagcggctct

SEQ ID NO: 38046 - DNA, 20 bp, human
gataccacggggccaccgag

SEQ ID NO: 38047 - DNA, 20 bp, human
ggaagccgagagataccacg

SEQ ID NO: 38048 - DNA, 20 bp, human
gttccgagacggttaggcta

SEQ ID NO: 38049 - DNA, 20 bp, human
gggcagcttccgagacggtt

SEQ ID NO: 38050 - DNA, 20 bp, human
ggaaccccggagatcctgat

SEQ ID NO: 38051 - DNA, 20 bp, human
gagccgtagcctaaccgtct

SEQ ID NO: 38052 - DNA, 20 bp, human
gaagatggcagcttccgaga

SEQ ID NO: 38053 - DNA, 20 bp, human
gacaccaatcaggatctccg

SEQ ID NO: 38054 - DNA, 20 bp, human
gaggcctctacctggagggg

SEQ ID NO: 38055 - DNA, 20 bp, human
gcctccactaccaggtctag

SEQ ID NO: 38056 - DNA, 20 bp, human
gccttctgcactgctcatct

SEQ ID NO: 38057 - DNA, 20 bp, human
gccactgaacagctcttgag

SEQ ID NO: 38058 - DNA, 20 bp, human
ggttcctggagatggtgcct

SEQ ID NO: 38059 - DNA, 20 bp, human
gctgccaaggcaccatctcc

SEQ ID NO: 38060 - DNA, 20 bp, human
gaagcttcagaaagctgcca

SEQ ID NO: 38061 - DNA, 20 bp, human
gatttttggaagctatactc

SEQ ID NO: 38062 - DNA, 20 bp, human
gaagaaacagaaattaggat

SEQ ID NO: 38063 - DNA, 20 bp, human
gaataaaatgatttacctaa

SEQ ID NO: 38064 - DNA, 20 bp, human
gtacactgaaattcggatta

SEQ ID NO: 38065 - DNA, 20 bp, human
ggtaagcgtacgcttactgg

SEQ ID NO: 38066 - DNA, 20 bp, human
ggcagaagcagtaggaccga

SEQ ID NO: 38067 - DNA, 20 bp, human
gtccaagctagagaggtcag

SEQ ID NO: 38068 - DNA, 20 bp, human
gccggcagaggaaggatcag

SEQ ID NO: 38069 - DNA, 20 bp, human
ggagtactgtgtgcccctaa

SEQ ID NO: 38070 - DNA, 20 bp, human
ggacggcatgaagcctttag

SEQ ID NO: 38071 - DNA, 20 bp, human
gttcagaatgaaggcagatg

SEQ ID NO: 38072 - DNA, 20 bp, human
gccctggcgataccttggaa

SEQ ID NO: 38073 - DNA, 20 bp, human
gcactcgtccagcccactga

SEQ ID NO: 38074 - DNA, 20 bp, human
gcccaccggccgggaccctc

SEQ ID NO: 38075 - DNA, 20 bp, human
gcacagtactctcagcttgt

SEQ ID NO: 38076 - DNA, 20 bp, human
gaagcggcagccaccgagga

SEQ ID NO: 38077 - DNA, 20 bp, human
gggccggggacacacagaag

SEQ ID NO: 38078 - DNA, 20 bp, human
gatgcagcaaggcgccgtcg

SEQ ID NO: 38079 - DNA, 20 bp, human
gggcccagctccatgcagca

SEQ ID NO: 38080 - DNA, 20 bp, human
gctgaggctgacagaagaca

SEQ ID NO: 38081 - DNA, 20 bp, human
gagacgccggggtcccaggg

SEQ ID NO: 38082 - DNA, 20 bp, human
gttcaaggctacaggctgga

SEQ ID NO: 38083 - DNA, 20 bp, human
gccccagcaccagaggtagg

SEQ ID NO: 38084 - DNA, 20 bp, human
gaaggcgccgtcggggctcc

SEQ ID NO: 38085 - DNA, 20 bp, human
gccctgatgccaaggaacac

SEQ ID NO: 38086 - DNA, 20 bp, human
ggcctatcgccggggcgtgt

SEQ ID NO: 38087 - DNA, 20 bp, human
ggcgggcgcggcaggaagac

SEQ ID NO: 38088 - DNA, 20 bp, human
gtgcggggaagtccaggagg

SEQ ID NO: 38089 - DNA, 20 bp, human
gcggagcggtgaagaatcct

SEQ ID NO: 38090 - DNA, 20 bp, human
gcaacagggagaggtagcgg

SEQ ID NO: 38091 - DNA, 20 bp, human
ggacttgtaatagtgtaggt

SEQ ID NO: 38092 - DNA, 20 bp, human
gcgcgcggacgcgtctgggg

SEQ ID NO: 38093 - DNA, 20 bp, human
gcggcgcgcggacgcgtctg

SEQ ID NO: 38094 - DNA, 20 bp, human
gcgcgcccgcctctcctcct

SEQ ID NO: 38095 - DNA, 20 bp, human
gcaccaaatcccagtataca

SEQ ID NO: 38096 - DNA, 20 bp, human
gggagtgtgtcaagttacag

SEQ ID NO: 38097 - DNA, 20 bp, human
gcgcacacggagggccccat

SEQ ID NO: 38098 - DNA, 20 bp, human
ggggcagaggtgggtcgtgg

SEQ ID NO: 38099 - DNA, 20 bp, human
gcatgggcagaggtgggtcg

SEQ ID NO: 38100 - DNA, 20 bp, human
gagggccccatgggcagagg

SEQ ID NO: 38101 - DNA, 20 bp, human
gcggagggccccatgggcag

SEQ ID NO: 38102 - DNA, 20 bp, human
gggagcgcaggggccgattc

SEQ ID NO: 38103 - DNA, 20 bp, human
ggcggagcgcacccacaaag

SEQ ID NO: 38104 - DNA, 20 bp, human
gacacttgaagggaaagact

SEQ ID NO: 38105 - DNA, 20 bp, human
gtccctgcggcggcacggat

SEQ ID NO: 38106 - DNA, 20 bp, human
gcacggtgtagggagattag

SEQ ID NO: 38107 - DNA, 20 bp, human
gagcgcagcggcagaaggag

SEQ ID NO: 38108 - DNA, 20 bp, human
ggccgccaaggaccaactag

SEQ ID NO: 38109 - DNA, 20 bp, human
gctccgagggaagagagcaa

SEQ ID NO: 38110 - DNA, 20 bp, human
gcgcggagagctcccaacct

SEQ ID NO: 38111 - DNA, 20 bp, human
ggatgagagcgcagggatag

SEQ ID NO: 38112 - DNA, 20 bp, human
ggcgcgcgcccagaatggac

SEQ ID NO: 38113 - DNA, 20 bp, human
ggtggaagcgcagcggcaga

SEQ ID NO: 38114 - DNA, 20 bp, human
gcaccgtgaaccccgcgaaa

SEQ ID NO: 38115 - DNA, 20 bp, human
ggggatgggacgggtacacc

SEQ ID NO: 38116 - DNA, 20 bp, human
gcaaaggcggcgctcggcag

SEQ ID NO: 38117 - DNA, 20 bp, human
gaccgccagtgcgcactgag

SEQ ID NO: 38118 - DNA, 20 bp, human
ggatgtgcccgagggagaaa

SEQ ID NO: 38119 - DNA, 20 bp, human
ggcggcggcgggcagaatcc

SEQ ID NO: 38120 - DNA, 20 bp, human
ggcagagcgttggagcttag

SEQ ID NO: 38121 - DNA, 20 bp, human
gcccgcgggcggctacctcc

SEQ ID NO: 38122 - DNA, 20 bp, human
gtaacccctgcactgccagg

SEQ ID NO: 38123 - DNA, 20 bp, human
ggacaggtaagcaacccggt

SEQ ID NO: 38124 - DNA, 20 bp, human
gcgcgctcgcccttcctgca

SEQ ID NO: 38125 - DNA, 20 bp, human
gcccggtcggagggtggcac

SEQ ID NO: 38126 - DNA, 20 bp, human
gcctggcgctcgagctctcc

SEQ ID NO: 38127 - DNA, 20 bp, human
gtggggacccgtgaccgtca

SEQ ID NO: 38128 - DNA, 20 bp, human
gaggttcctcaggtccgcta

SEQ ID NO: 38129 - DNA, 20 bp, human
gcagagactaggagccggaa

SEQ ID NO: 38130 - DNA, 20 bp, human
gaggctccagccagagtgca

SEQ ID NO: 38131 - DNA, 20 bp, human
ggctcgagcgccaggaagct

SEQ ID NO: 38132 - DNA, 20 bp, human
gtctctggtcgccactcctc

SEQ ID NO: 38133 - DNA, 20 bp, human
gcggtaagtagggatacagt

SEQ ID NO: 38134 - DNA, 20 bp, human
gatctctccgtgacggtcac

SEQ ID NO: 38135 - DNA, 20 bp, human
ggttctctatctctccgtga

SEQ ID NO: 38136 - DNA, 20 bp, human
gaaaatatagcgggctttag

SEQ ID NO: 38137 - DNA, 20 bp, human
gactcagctttaacacacct

SEQ ID NO: 38138 - DNA, 20 bp, human
gtatgcattctgcttagggt

SEQ ID NO: 38139 - DNA, 20 bp, human
gaaggctggttaaaatatag

SEQ ID NO: 38140 - DNA, 20 bp, human
gcttagggtaggtctttcaa

SEQ ID NO: 38141 - DNA, 20 bp, human
gtttatttagaatatgatac

SEQ ID NO: 38142 - DNA, 20 bp, human
gagctttaacacaccttggc

SEQ ID NO: 38143 - DNA, 20 bp, human
gggtgtatgcattctgctta

SEQ ID NO: 38144 - DNA, 20 bp, human
gtctctgagactttgattta

SEQ ID NO: 38145 - DNA, 20 bp, human
ggtcttcctgtttacttacc

SEQ ID NO: 38146 - DNA, 20 bp, human
gcggagagctaggaatgcca

SEQ ID NO: 38147 - DNA, 20 bp, human
gccacggctgggccagagag

SEQ ID NO: 38148 - DNA, 20 bp, human
gggagaatgggaccactctc

SEQ ID NO: 38149 - DNA, 20 bp, human
ggtgccagcctcggttgtgt

SEQ ID NO: 38150 - DNA, 20 bp, human
gccgggcgcccacacaaccg

SEQ ID NO: 38151 - DNA, 20 bp, human
gagctaggaatgccacggct

SEQ ID NO: 38152 - DNA, 20 bp, human
gcccacagagttagccacgt

SEQ ID NO: 38153 - DNA, 20 bp, human
ggggagccatcggggcagtg

SEQ ID NO: 38154 - DNA, 20 bp, human
ggtgctggaaggcccagcga

SEQ ID NO: 38155 - DNA, 20 bp, human
gcagcaccccccaggagaat

SEQ ID NO: 38156 - DNA, 20 bp, human
ggcgcagtggagtccggaca

SEQ ID NO: 38157 - DNA, 20 bp, human
gcagggagctcactcctcgg

SEQ ID NO: 38158 - DNA, 20 bp, human
gtcgcagggagctcactcct

SEQ ID NO: 38159 - DNA, 20 bp, human
gactccactgcgcctctgag

SEQ ID NO: 38160 - DNA, 20 bp, human
ggagcactgctgatgcgggt

SEQ ID NO: 38161 - DNA, 20 bp, human
ggagtgagctccctgcgagt

SEQ ID NO: 38162 - DNA, 20 bp, human
gtgtctgtgaagcggaacta

SEQ ID NO: 38163 - DNA, 20 bp, human
ggaaaaaccacctagaactt

SEQ ID NO: 38164 - DNA, 20 bp, human
gtatggagcactgctgatgc

SEQ ID NO: 38165 - DNA, 20 bp, human
ggctatgtgtgtctgtgaag

SEQ ID NO: 38166 - DNA, 20 bp, human
ggccagtcgtcggagcagac

SEQ ID NO: 38167 - DNA, 20 bp, human
gtcctcggggtcggagcagg

SEQ ID NO: 38168 - DNA, 20 bp, human
gacaggagggagctcaccct

SEQ ID NO: 38169 - DNA, 20 bp, human
ggtgtgaggccacgcatgag

SEQ ID NO: 38170 - DNA, 20 bp, human
gaggaggcacgcggagtgtg

SEQ ID NO: 38171 - DNA, 20 bp, human
gggtggagcgcggcgtgagt

SEQ ID NO: 38172 - DNA, 20 bp, human
gagacgggagtttctcctcg

SEQ ID NO: 38173 - DNA, 20 bp, human
ggcgcgcaaccggggaagtg

SEQ ID NO: 38174 - DNA, 20 bp, human
gaggggcccgggccagtcgt

SEQ ID NO: 38175 - DNA, 20 bp, human
gctcggcgccctgagacagg

SEQ ID NO: 38176 - DNA, 20 bp, human
gcggcggaggtatcacctgg

SEQ ID NO: 38177 - DNA, 20 bp, human
gcaccggcggaggtatcacc

SEQ ID NO: 38178 - DNA, 20 bp, human
gacctccgccggtgacccag

SEQ ID NO: 38179 - DNA, 20 bp, human
gcgcagagcccctgggtcac

SEQ ID NO: 38180 - DNA, 20 bp, human
gttagcaccacggcagcagg

SEQ ID NO: 38181 - DNA, 20 bp, human
ggggcgcgggcatgcagtcg

SEQ ID NO: 38182 - DNA, 20 bp, human
gtgagacagttaactcggtc

SEQ ID NO: 38183 - DNA, 20 bp, human
gtcggctaagttggaggtac

SEQ ID NO: 38184 - DNA, 20 bp, human
ggaggtttcggctaagttgg

SEQ ID NO: 38185 - DNA, 20 bp, human
ggtagagaggttagatggga

SEQ ID NO: 38186 - DNA, 20 bp, human
ggagtggaccagcacacccc

SEQ ID NO: 38187 - DNA, 20 bp, human
gtgatcacagaggcaccagt

SEQ ID NO: 38188 - DNA, 20 bp, human
ggctcccaaactgatcacag

SEQ ID NO: 38189 - DNA, 20 bp, human
gccggtcctgtggctcacag

SEQ ID NO: 38190 - DNA, 20 bp, human
gctcagtgggacccctgcca

SEQ ID NO: 38191 - DNA, 20 bp, human
ggaaggctggagcttatgaa

SEQ ID NO: 38192 - DNA, 20 bp, human
gctggggtcccaggagtagg

SEQ ID NO: 38193 - DNA, 20 bp, human
gggaccccagtcctctctcc

SEQ ID NO: 38194 - DNA, 20 bp, human
ggtgcacatcgagcagagag

SEQ ID NO: 38195 - DNA, 20 bp, human
gctgcctgagctctcaccaa

SEQ ID NO: 38196 - DNA, 20 bp, human
ggacctgcgctgaaacggat

SEQ ID NO: 38197 - DNA, 20 bp, human
gtgcagggagaacggactcc

SEQ ID NO: 38198 - DNA, 20 bp, human
gtcagaagccaaacactcca

SEQ ID NO: 38199 - DNA, 20 bp, human
gagggagaacggactccggg

SEQ ID NO: 38200 - DNA, 20 bp, human
gctggacactgcgccaggta

SEQ ID NO: 38201 - DNA, 20 bp, human
gctggcagcgagaggggagt

SEQ ID NO: 38202 - DNA, 20 bp, human
gcgcaggtcttgctcgggtt

SEQ ID NO: 38203 - DNA, 20 bp, human
gggattggctgccctccgcc

SEQ ID NO: 38204 - DNA, 20 bp, human
ggaagctaaaagctgagggt

SEQ ID NO: 38205 - DNA, 20 bp, human
ggagaacggactccgggcgg

SEQ ID NO: 38206 - DNA, 20 bp, human
gctggcagggaggcactcag

SEQ ID NO: 38207 - DNA, 20 bp, human
gagagaacccgggtcttacc

SEQ ID NO: 38208 - DNA, 20 bp, human
gctccctgccaggtaagacc

SEQ ID NO: 38209 - DNA, 20 bp, human
gcggagaagacacttccttg

SEQ ID NO: 38210 - DNA, 20 bp, human
gagacccgcagtaagtgtgg

SEQ ID NO: 38211 - DNA, 20 bp, human
gctgaggccagcttgcccct

SEQ ID NO: 38212 - DNA, 20 bp, human
gaggcactcaggggtgccag

SEQ ID NO: 38213 - DNA, 20 bp, human
gcccaggactggacctccgc

SEQ ID NO: 38214 - DNA, 20 bp, human
gtcttcccagatgacagtga

SEQ ID NO: 38215 - DNA, 20 bp, human
gacaagacccgcagtaagtg

SEQ ID NO: 38216 - DNA, 20 bp, human
ggcgatccgctgctacccgg

SEQ ID NO: 38217 - DNA, 20 bp, human
ggttagcctccgggtagcag

SEQ ID NO: 38218 - DNA, 20 bp, human
ggagctggctgcggcgaagg

SEQ ID NO: 38219 - DNA, 20 bp, human
gggctcggcccaggcgtcca

SEQ ID NO: 38220 - DNA, 20 bp, human
ggcagcaggcgctccaggtg

SEQ ID NO: 38221 - DNA, 20 bp, human
gtagaggaaactgcccaaag

SEQ ID NO: 38222 - DNA, 20 bp, human
gcccaaagtggccgctgtgg

SEQ ID NO: 38223 - DNA, 20 bp, human
gctgcccaaagtggccgctg

SEQ ID NO: 38224 - DNA, 20 bp, human
ggcggtacgctgggagccgg

SEQ ID NO: 38225 - DNA, 20 bp, human
gctgcgggaggtgagcgtct

SEQ ID NO: 38226 - DNA, 20 bp, human
gcacccgccgggtagggtag

SEQ ID NO: 38227 - DNA, 20 bp, human
gggcgactctgtgactccag

SEQ ID NO: 38228 - DNA, 20 bp, human
ggtagcccacccgccgggta

SEQ ID NO: 38229 - DNA, 20 bp, human
gtaacccctaccctacccgg

SEQ ID NO: 38230 - DNA, 20 bp, human
gggaggtaaacctcactggg

SEQ ID NO: 38231 - DNA, 20 bp, human
gcgaggaggtaaacctcact

SEQ ID NO: 38232 - DNA, 20 bp, human
gggaggcctcggggcgccgg

SEQ ID NO: 38233 - DNA, 20 bp, human
gaagttcacttgcggttcaa

SEQ ID NO: 38234 - DNA, 20 bp, human
gttccaggcaaagcagccgg

SEQ ID NO: 38235 - DNA, 20 bp, human
gcagcactcaagttcacttg

SEQ ID NO: 38236 - DNA, 20 bp, human
ggtgccgaaagacaccgagt

SEQ ID NO: 38237 - DNA, 20 bp, human
gagcgcgaaaggggcgacta

SEQ ID NO: 38238 - DNA, 20 bp, human
gactcgcgaagccgaagtcg

SEQ ID NO: 38239 - DNA, 20 bp, human
ggtggccgctcagggtccga

SEQ ID NO: 38240 - DNA, 20 bp, human
gggggctgcggagatccttc

SEQ ID NO: 38241 - DNA, 20 bp, human
gtcggaagagctgtctgggt

SEQ ID NO: 38242 - DNA, 20 bp, human
gctttcgagggccccaacag

SEQ ID NO: 38243 - DNA, 20 bp, human
gcgagtagcattggttcctt

SEQ ID NO: 38244 - DNA, 20 bp, human
ggcgaaaggggcgactaagg

SEQ ID NO: 38245 - DNA, 20 bp, human
gcacccagtccccggacgga

SEQ ID NO: 38246 - DNA, 20 bp, human
ggtgcgagctggaaatgtgt

SEQ ID NO: 38247 - DNA, 20 bp, human
gggcgcccggaccgaacccg

SEQ ID NO: 38248 - DNA, 20 bp, human
gtcggccccgagctactcac

SEQ ID NO: 38249 - DNA, 20 bp, human
gggcggccccggagaggcgt

SEQ ID NO: 38250 - DNA, 20 bp, human
gtgcggccgagaagggatag

SEQ ID NO: 38251 - DNA, 20 bp, human
ggggcgagcggtcggagccc

SEQ ID NO: 38252 - DNA, 20 bp, human
gagaggcagcaacacgccca

SEQ ID NO: 38253 - DNA, 20 bp, human
ggccccgagctactcaccgg

SEQ ID NO: 38254 - DNA, 20 bp, human
ggcagagctgcggccgagaa

SEQ ID NO: 38255 - DNA, 20 bp, human
gaggaccggcaggagcgcac

SEQ ID NO: 38256 - DNA, 20 bp, human
gggctcgggagcatgaagta

SEQ ID NO: 38257 - DNA, 20 bp, human
ggcagagcaaggccgggtga

SEQ ID NO: 38258 - DNA, 20 bp, human
gtcatgctcccgagcccggg

SEQ ID NO: 38259 - DNA, 20 bp, human
gcccggaggcagagcaaggc

SEQ ID NO: 38260 - DNA, 20 bp, human
gggggcccgaggcacagcgg

SEQ ID NO: 38261 - DNA, 20 bp, human
gtgaagtaggggcctgccat

SEQ ID NO: 38262 - DNA, 20 bp, human
ggtggaagctgcctccccgc

SEQ ID NO: 38263 - DNA, 20 bp, human
ggagcccggggggcaagtgt

SEQ ID NO: 38264 - DNA, 20 bp, human
gcgcgccgatcccgctccca

SEQ ID NO: 38265 - DNA, 20 bp, human
gtaggggcctgccatgggag

SEQ ID NO: 38266 - DNA, 20 bp, human
gcaacagcaaggactgtggt

SEQ ID NO: 38267 - DNA, 20 bp, human
gtgagtaaatgccaacagca

SEQ ID NO: 38268 - DNA, 20 bp, human
gtgatattgttctgttctgt

SEQ ID NO: 38269 - DNA, 20 bp, human
gtagtcacttgaaatcagat

SEQ ID NO: 38270 - DNA, 20 bp, human
gctgtttgacaaactttata

SEQ ID NO: 38271 - DNA, 20 bp, human
gcagcaaggactgtggttgg

SEQ ID NO: 38272 - DNA, 20 bp, human
gaaatcagataggaccatca

SEQ ID NO: 38273 - DNA, 20 bp, human
gacttacttacataattatt

SEQ ID NO: 38274 - DNA, 20 bp, human
gtttttcttaatttggaaca

SEQ ID NO: 38275 - DNA, 20 bp, human
gtatagaatactttacaact

SEQ ID NO: 38276 - DNA, 20 bp, human
gccctgacaccgaaggacag

SEQ ID NO: 38277 - DNA, 20 bp, human
ggaagacgcagagcgctgct

SEQ ID NO: 38278 - DNA, 20 bp, human
ggatgggcaccgaggaccct

SEQ ID NO: 38279 - DNA, 20 bp, human
gcgggcggagcgcagcgaaa

SEQ ID NO: 38280 - DNA, 20 bp, human
gctctaccgcgccctcatgc

SEQ ID NO: 38281 - DNA, 20 bp, human
gtgagggcgcggtagagacc

SEQ ID NO: 38282 - DNA, 20 bp, human
gggtcgtagcgcgccgactt

SEQ ID NO: 38283 - DNA, 20 bp, human
gtaccgcgccctcatgcagg

SEQ ID NO: 38284 - DNA, 20 bp, human
gggagccccgaggcgaatca

SEQ ID NO: 38285 - DNA, 20 bp, human
gaggggccgggcgcatataa

SEQ ID NO: 38286 - DNA, 20 bp, human
gtgacgggcccggtgctgaa

SEQ ID NO: 38287 - DNA, 20 bp, human
gagggcagggaacaacttga

SEQ ID NO: 38288 - DNA, 20 bp, human
gcaaagcaaaggaatctcag

SEQ ID NO: 38289 - DNA, 20 bp, human
ggcacaacaggaaggtgagt

SEQ ID NO: 38290 - DNA, 20 bp, human
gctatttaaggccaaagcaa

SEQ ID NO: 38291 - DNA, 20 bp, human
gagtggctgagttttatgac

SEQ ID NO: 38292 - DNA, 20 bp, human
ggttgtgccaaaataatagt

SEQ ID NO: 38293 - DNA, 20 bp, human
gcacaatctggagcttatag

SEQ ID NO: 38294 - DNA, 20 bp, human
gtaacttgttttcatgttaa

SEQ ID NO: 38295 - DNA, 20 bp, human
gctcacaaagaggggtgtaa

SEQ ID NO: 38296 - DNA, 20 bp, human
gcggacagctagctctcgga

SEQ ID NO: 38297 - DNA, 20 bp, human
gcgggtgcggcggctccaag

SEQ ID NO: 38298 - DNA, 20 bp, human
gggagccgccgcacccggga

SEQ ID NO: 38299 - DNA, 20 bp, human
ggtgcgtagcgctggaagtc

SEQ ID NO: 38300 - DNA, 20 bp, human
ggagttaaggaattcctccg

SEQ ID NO: 38301 - DNA, 20 bp, human
gggagaaacagcccgcgctg

SEQ ID NO: 38302 - DNA, 20 bp, human
gccagcgctacgcaccgtcc

SEQ ID NO: 38303 - DNA, 20 bp, human
ggaattcctccggggaaggg

SEQ ID NO: 38304 - DNA, 20 bp, human
ggcggcggacagctagctct

SEQ ID NO: 38305 - DNA, 20 bp, human
gcgggaactcaccttcgcag

SEQ ID NO: 38306 - DNA, 20 bp, human
ggtgcgcggcccgcatgcag

SEQ ID NO: 38307 - DNA, 20 bp, human
gcccacaggggcctaacggg

SEQ ID NO: 38308 - DNA, 20 bp, human
gagcgcgcggcccgggagtg

SEQ ID NO: 38309 - DNA, 20 bp, human
gcggccaaggagcacccaca

SEQ ID NO: 38310 - DNA, 20 bp, human
gggccgtcccccccacgacc

SEQ ID NO: 38311 - DNA, 20 bp, human
gcccccacgacccggaaaga

SEQ ID NO: 38312 - DNA, 20 bp, human
gtgcagtgcgccgggacacc

SEQ ID NO: 38313 - DNA, 20 bp, human
gtccgcgctccgcactcaag

SEQ ID NO: 38314 - DNA, 20 bp, human
gctgcttgggagtagaaagg

SEQ ID NO: 38315 - DNA, 20 bp, human
ggcacccacaggggcctaac

SEQ ID NO: 38316 - DNA, 20 bp, human
gccgcgctgcgcaggagacg

SEQ ID NO: 38317 - DNA, 20 bp, human
gcggtccgggcgctcatggt

SEQ ID NO: 38318 - DNA, 20 bp, human
gggcggggacaggcctccag

SEQ ID NO: 38319 - DNA, 20 bp, human
gcagagcctgggcgagtccg

SEQ ID NO: 38320 - DNA, 20 bp, human
gtcccgggacaggcagcgag

SEQ ID NO: 38321 - DNA, 20 bp, human
ggggcgcgcgctcagagcct

SEQ ID NO: 38322 - DNA, 20 bp, human
gtcctgcgcagcgcggctct

SEQ ID NO: 38323 - DNA, 20 bp, human
gtcgcctcgccactcggccg

SEQ ID NO: 38324 - DNA, 20 bp, human
ggcgcattccacctgttccg

SEQ ID NO: 38325 - DNA, 20 bp, human
gcagcggcgcggtagtggag

SEQ ID NO: 38326 - DNA, 20 bp, human
gtcggtgtcaggcgcggcgg

SEQ ID NO: 38327 - DNA, 20 bp, human
gctccgctcggtgtcaggcg

SEQ ID NO: 38328 - DNA, 20 bp, human
ggcggtagcggaggtgtgag

SEQ ID NO: 38329 - DNA, 20 bp, human
gggaggggagggtaaatagt

SEQ ID NO: 38330 - DNA, 20 bp, human
gggctgacggctggaagggt

SEQ ID NO: 38331 - DNA, 20 bp, human
gaactcgtcgggctcggagg

SEQ ID NO: 38332 - DNA, 20 bp, human
ggcggaggtgtgagtggacg

SEQ ID NO: 38333 - DNA, 20 bp, human
gatcagagctggaactcgtc

SEQ ID NO: 38334 - DNA, 20 bp, human
gggttgtcgagcctccatgt

SEQ ID NO: 38335 - DNA, 20 bp, human
gggatccagagacggagtct

SEQ ID NO: 38336 - DNA, 20 bp, human
gggtaaggcgcccataggtg

SEQ ID NO: 38337 - DNA, 20 bp, human
ggcgccgggcgtctgcactc

SEQ ID NO: 38338 - DNA, 20 bp, human
gcgcgggcgcggggaacaag

SEQ ID NO: 38339 - DNA, 20 bp, human
gcagcggttgccccacctat

SEQ ID NO: 38340 - DNA, 20 bp, human
gctctcgcagccaagcccgg

SEQ ID NO: 38341 - DNA, 20 bp, human
gcccggcggccgcaagttgg

SEQ ID NO: 38342 - DNA, 20 bp, human
gactcagcggagaataagat

SEQ ID NO: 38343 - DNA, 20 bp, human
gccacaggtaaggcgcccat

SEQ ID NO: 38344 - DNA, 20 bp, human
ggttaccggcctggcagtcg

SEQ ID NO: 38345 - DNA, 20 bp, human
gaagcccggcggccgcaagt

SEQ ID NO: 38346 - DNA, 20 bp, human
ggggaggaaagtagatctgt

SEQ ID NO: 38347 - DNA, 20 bp, human
gggctgcccccaaagactca

SEQ ID NO: 38348 - DNA, 20 bp, human
gcttgtgctggtgaggaggg

SEQ ID NO: 38349 - DNA, 20 bp, human
gtccccaaagccggtctctc

SEQ ID NO: 38350 - DNA, 20 bp, human
gagagagctagagccggaga

SEQ ID NO: 38351 - DNA, 20 bp, human
gagcgtgaaagagcggtgat

SEQ ID NO: 38352 - DNA, 20 bp, human
gagagcggtgatgggcgcgg

SEQ ID NO: 38353 - DNA, 20 bp, human
ggccagccgggaatttcgtg

SEQ ID NO: 38354 - DNA, 20 bp, human
gtaatttcagcgtgaaagag

SEQ ID NO: 38355 - DNA, 20 bp, human
gtcccttgtgctggtgagga

SEQ ID NO: 38356 - DNA, 20 bp, human
ggccacaacctgaaatggga

SEQ ID NO: 38357 - DNA, 20 bp, human
gagataagaagtgctccaaa

SEQ ID NO: 38358 - DNA, 20 bp, human
gggcagcaacagctcaccca

SEQ ID NO: 38359 - DNA, 20 bp, human
ggcatccaaaagggttcggg

SEQ ID NO: 38360 - DNA, 20 bp, human
gagcagccacaacctgaaat

SEQ ID NO: 38361 - DNA, 20 bp, human
ggtcccgggagactgctaag

SEQ ID NO: 38362 - DNA, 20 bp, human
ggttacaacttgcagcactc

SEQ ID NO: 38363 - DNA, 20 bp, human
gtgccaggccgggactatac

SEQ ID NO: 38364 - DNA, 20 bp, human
gtgggagcaggcatccaaaa

SEQ ID NO: 38365 - DNA, 20 bp, human
gaagtgctccaaagggaaac

SEQ ID NO: 38366 - DNA, 20 bp, human
gtacattagctcaatatagg

SEQ ID NO: 38367 - DNA, 20 bp, human
gtatatatcagaattatcaa

SEQ ID NO: 38368 - DNA, 20 bp, human
gtataggaggcattaattat

SEQ ID NO: 38369 - DNA, 20 bp, human
gaacattcaagtctttatat

SEQ ID NO: 38370 - DNA, 20 bp, human
gggtattggtaattattcta

SEQ ID NO: 38371 - DNA, 20 bp, human
gaatatttaaatagagttga

SEQ ID NO: 38372 - DNA, 20 bp, human
gtaaagaagaccagcagccc

SEQ ID NO: 38373 - DNA, 20 bp, human
gttttacattagctcaatat

SEQ ID NO: 38374 - DNA, 20 bp, human
gttcagaaagatttagggca

SEQ ID NO: 38375 - DNA, 20 bp, human
gttatatacgtataagatct

SEQ ID NO: 38376 - DNA, 20 bp, human
gcccgcgacccgctccccgt

SEQ ID NO: 38377 - DNA, 20 bp, human
ggcgcaggacctcactcgag

SEQ ID NO: 38378 - DNA, 20 bp, human
gtgggcgctccgctcgagtg

SEQ ID NO: 38379 - DNA, 20 bp, human
gtgaggtcctgcgccagccg

SEQ ID NO: 38380 - DNA, 20 bp, human
gtacctgcgcggctcggagg

SEQ ID NO: 38381 - DNA, 20 bp, human
gcgccacaaagaagaacggg

SEQ ID NO: 38382 - DNA, 20 bp, human
gtccgcactctccgtccccg

SEQ ID NO: 38383 - DNA, 20 bp, human
gccttacctgcgcggctcgg

SEQ ID NO: 38384 - DNA, 20 bp, human
gagagtgcggacctcgcctt

SEQ ID NO: 38385 - DNA, 20 bp, human
gcatggacgtccatacccgc

SEQ ID NO: 38386 - DNA, 20 bp, human
ggagcttctagatccaccgt

SEQ ID NO: 38387 - DNA, 20 bp, human
gagtagtgtactctctccaa

SEQ ID NO: 38388 - DNA, 20 bp, human
gagtgtactctctccaacgg

SEQ ID NO: 38389 - DNA, 20 bp, human
ggacatgatggcaaactggg

SEQ ID NO: 38390 - DNA, 20 bp, human
gctggagctggtgctgaaaa

SEQ ID NO: 38391 - DNA, 20 bp, human
gtgaaaaagggggtttgcag

SEQ ID NO: 38392 - DNA, 20 bp, human
gaaagcccaggaagaagacg

SEQ ID NO: 38393 - DNA, 20 bp, human
gttagacatgatggcaaact

SEQ ID NO: 38394 - DNA, 20 bp, human
gcctcaggaagagcgtgaag

SEQ ID NO: 38395 - DNA, 20 bp, human
ggagtgaaaagtagattctg

SEQ ID NO: 38396 - DNA, 20 bp, human
gccgcggaccctgagaggag

SEQ ID NO: 38397 - DNA, 20 bp, human
gcggggcgcggcgacttctc

SEQ ID NO: 38398 - DNA, 20 bp, human
gcagggtccacgactcagag

SEQ ID NO: 38399 - DNA, 20 bp, human
gtcggtgcagtcactcgcgg

SEQ ID NO: 38400 - DNA, 20 bp, human
ggagccgggagggaagagat

SEQ ID NO: 38401 - DNA, 20 bp, human
gggcggggaaccagtcgggg

SEQ ID NO: 38402 - DNA, 20 bp, human
gccatcccggcggggcccac

SEQ ID NO: 38403 - DNA, 20 bp, human
ggcaaggcggggaaccagtc

SEQ ID NO: 38404 - DNA, 20 bp, human
gcgcggcggccgctcctctc

SEQ ID NO: 38405 - DNA, 20 bp, human
ggaggctctaaaagagcgag

SEQ ID NO: 38406 - DNA, 20 bp, human
gaccgcaggcagctcgggag

SEQ ID NO: 38407 - DNA, 20 bp, human
gtcaccacacagcgcggcca

SEQ ID NO: 38408 - DNA, 20 bp, human
gccttggccggggcccctag

SEQ ID NO: 38409 - DNA, 20 bp, human
gcagccagagtgagagcgga

SEQ ID NO: 38410 - DNA, 20 bp, human
gcctggccggcagcaaagag

SEQ ID NO: 38411 - DNA, 20 bp, human
gctgcggtcaccacacagcg

SEQ ID NO: 38412 - DNA, 20 bp, human
gcaccagctccccctcgcca

SEQ ID NO: 38413 - DNA, 20 bp, human
gctgccctggccgcgctgtg

SEQ ID NO: 38414 - DNA, 20 bp, human
ggccggcagcaaagagcggg

SEQ ID NO: 38415 - DNA, 20 bp, human
gttgccctccgctctcactc

SEQ ID NO: 38416 - DNA, 20 bp, human
gtcgggagcggagcctcctc

SEQ ID NO: 38417 - DNA, 20 bp, human
gaggcgctcacctggtcccg

SEQ ID NO: 38418 - DNA, 20 bp, human
gcgctcacctggtcccgagg

SEQ ID NO: 38419 - DNA, 20 bp, human
gcgcctcgggccgtcgggag

SEQ ID NO: 38420 - DNA, 20 bp, human
gcggaggcggctccccaggg

SEQ ID NO: 38421 - DNA, 20 bp, human
ggcgggccgagcggcttcca

SEQ ID NO: 38422 - DNA, 20 bp, human
gccgagcggcttccagggtg

SEQ ID NO: 38423 - DNA, 20 bp, human
ggcgccccggcggagtccca

SEQ ID NO: 38424 - DNA, 20 bp, human
gcccggcctggagcccacca

SEQ ID NO: 38425 - DNA, 20 bp, human
ggcggagcctcctcgggacc

SEQ ID NO: 38426 - DNA, 20 bp, human
ggagctcagtcttccaccaa

SEQ ID NO: 38427 - DNA, 20 bp, human
gaaggccgttcagttctcct

SEQ ID NO: 38428 - DNA, 20 bp, human
ggcgccctgtgcattccggg

SEQ ID NO: 38429 - DNA, 20 bp, human
ggggccagggataccagtca

SEQ ID NO: 38430 - DNA, 20 bp, human
gtgtagcagccacagacacg

SEQ ID NO: 38431 - DNA, 20 bp, human
gagcagccacagacacgcgg

SEQ ID NO: 38432 - DNA, 20 bp, human
gtgagctccaaactggactg

SEQ ID NO: 38433 - DNA, 20 bp, human
ggaaaagtgctcacactctt

SEQ ID NO: 38434 - DNA, 20 bp, human
gctgccgcccggaatgcaca

SEQ ID NO: 38435 - DNA, 20 bp, human
gcctgaaggcgtgtgtccct

SEQ ID NO: 38436 - DNA, 20 bp, human
gggcttaaaagaccctctca

SEQ ID NO: 38437 - DNA, 20 bp, human
gaacgcctcgtgccctgaga

SEQ ID NO: 38438 - DNA, 20 bp, human
gcaagggcacgggtcagcgc

SEQ ID NO: 38439 - DNA, 20 bp, human
gccttagagctcagatttgg

SEQ ID NO: 38440 - DNA, 20 bp, human
gccggggtcaggggacactc

SEQ ID NO: 38441 - DNA, 20 bp, human
ggaaacctcgagtagacagg

SEQ ID NO: 38442 - DNA, 20 bp, human
ggcccccaactctccagaag

SEQ ID NO: 38443 - DNA, 20 bp, human
ggaggaaacctcgagtagac

SEQ ID NO: 38444 - DNA, 20 bp, human
gggttaagacaggttctgaa

SEQ ID NO: 38445 - DNA, 20 bp, human
ggtgaagagttaaaagcccc

SEQ ID NO: 38446 - DNA, 20 bp, human
gtggtgtctgagttaaataa

SEQ ID NO: 38447 - DNA, 20 bp, human
ggtgccatcagctccctcaa

SEQ ID NO: 38448 - DNA, 20 bp, human
gtgctcgaggaaaggtaaca

SEQ ID NO: 38449 - DNA, 20 bp, human
gatggagtaagctgtgaggt

SEQ ID NO: 38450 - DNA, 20 bp, human
gacagagactcaggtcagtg

SEQ ID NO: 38451 - DNA, 20 bp, human
gaaatcagctgctcgaggaa

SEQ ID NO: 38452 - DNA, 20 bp, human
ggaaacagtctaggattcaa

SEQ ID NO: 38453 - DNA, 20 bp, human
gatgtctgaatcaagggact

SEQ ID NO: 38454 - DNA, 20 bp, human
gagacaccatgtctgaatca

SEQ ID NO: 38455 - DNA, 20 bp, human
gtgtctcaactcaggagaaa

SEQ ID NO: 38456 - DNA, 20 bp, human
gtgggtaggaacaggatagg

SEQ ID NO: 38457 - DNA, 20 bp, human
ggcccgagagactgcagcgg

SEQ ID NO: 38458 - DNA, 20 bp, human
ggcaggcaagaccaggactc

SEQ ID NO: 38459 - DNA, 20 bp, human
gcggacgcgcaggcaagacc

SEQ ID NO: 38460 - DNA, 20 bp, human
ggggaccccgcacgcatcca

SEQ ID NO: 38461 - DNA, 20 bp, human
ggaagccgcagcgtcatcct

SEQ ID NO: 38462 - DNA, 20 bp, human
gatttgggtaggaacaggat

SEQ ID NO: 38463 - DNA, 20 bp, human
gagagaggtgggcaccgcaa

SEQ ID NO: 38464 - DNA, 20 bp, human
ggagcccagcacagggagag

SEQ ID NO: 38465 - DNA, 20 bp, human
ggcaagaccaggactcgggc

SEQ ID NO: 38466 - DNA, 20 bp, human
gccttgagcacgtaagatca

SEQ ID NO: 38467 - DNA, 20 bp, human
gctcgctggctcccacggag

SEQ ID NO: 38468 - DNA, 20 bp, human
gagaggctcgctggctccca

SEQ ID NO: 38469 - DNA, 20 bp, human
gcacgtaagatcagggagag

SEQ ID NO: 38470 - DNA, 20 bp, human
gcaggcagctcacctaccag

SEQ ID NO: 38471 - DNA, 20 bp, human
gtggctcccacggagaggat

SEQ ID NO: 38472 - DNA, 20 bp, human
gcttccccgatcctctccgt

SEQ ID NO: 38473 - DNA, 20 bp, human
gccccatagcaacccctggt

SEQ ID NO: 38474 - DNA, 20 bp, human
gatcagggagagaggctcgc

SEQ ID NO: 38475 - DNA, 20 bp, human
gggtaagacagcacttctgc

SEQ ID NO: 38476 - DNA, 20 bp, human
gggcggccggcagagcgacg

SEQ ID NO: 38477 - DNA, 20 bp, human
gggctccgagggcaagacct

SEQ ID NO: 38478 - DNA, 20 bp, human
gcccagagccacatcgtcgg

SEQ ID NO: 38479 - DNA, 20 bp, human
gccactccggcagccgcgag

SEQ ID NO: 38480 - DNA, 20 bp, human
gctctgccggccgcccctcg

SEQ ID NO: 38481 - DNA, 20 bp, human
ggcgcccagagccacatcgt

SEQ ID NO: 38482 - DNA, 20 bp, human
gggtgcaacccccgacgatg

SEQ ID NO: 38483 - DNA, 20 bp, human
ggagccctcgcttctgggag

SEQ ID NO: 38484 - DNA, 20 bp, human
gggtgggacgggagatcggg

SEQ ID NO: 38485 - DNA, 20 bp, human
gcttcctctcccagaagcga

SEQ ID NO: 38486 - DNA, 20 bp, human
ggacccgccactagcatagg

SEQ ID NO: 38487 - DNA, 20 bp, human
gaaagcacccccgggagtag

SEQ ID NO: 38488 - DNA, 20 bp, human
gccagacccgccactagcat

SEQ ID NO: 38489 - DNA, 20 bp, human
gcgggtctggaagcctagag

SEQ ID NO: 38490 - DNA, 20 bp, human
gttggcaaccgctactcccg

SEQ ID NO: 38491 - DNA, 20 bp, human
gtagaccaaggggtcatcta

SEQ ID NO: 38492 - DNA, 20 bp, human
ggaagtgccacctatgctag

SEQ ID NO: 38493 - DNA, 20 bp, human
gaaggcgcggagcatcccca

SEQ ID NO: 38494 - DNA, 20 bp, human
gtggacttcgataggactcg

SEQ ID NO: 38495 - DNA, 20 bp, human
gagccgggccaagggattag

SEQ ID NO: 38496 - DNA, 20 bp, human
gtggctggcggcgagaccaa

SEQ ID NO: 38497 - DNA, 20 bp, human
ggtgtccgcgcacgcaccga

SEQ ID NO: 38498 - DNA, 20 bp, human
gcaccgacggcagagtctcc

SEQ ID NO: 38499 - DNA, 20 bp, human
gcaggtggcggggcatacaa

SEQ ID NO: 38500 - DNA, 20 bp, human
gcgccgggagactctgccgt

SEQ ID NO: 38501 - DNA, 20 bp, human
gggcccgggacaggcagcgt

SEQ ID NO: 38502 - DNA, 20 bp, human
ggcggcgagaccaaggggga

SEQ ID NO: 38503 - DNA, 20 bp, human
gaggagctggcgcccggtcc

SEQ ID NO: 38504 - DNA, 20 bp, human
gctggaccctggcagcggag

SEQ ID NO: 38505 - DNA, 20 bp, human
gtagcccgagaggccacctg

SEQ ID NO: 38506 - DNA, 20 bp, human
gtaacgggctccgcatgtca

SEQ ID NO: 38507 - DNA, 20 bp, human
ggtctgtcggcggctataac

SEQ ID NO: 38508 - DNA, 20 bp, human
ggaggcctcgctgtgagctg

SEQ ID NO: 38509 - DNA, 20 bp, human
gtcaaaccagccctgacatg

SEQ ID NO: 38510 - DNA, 20 bp, human
ggcagctccttgtctgtcgg

SEQ ID NO: 38511 - DNA, 20 bp, human
gtccagtgccaaaggaccct

SEQ ID NO: 38512 - DNA, 20 bp, human
gtcggggagagaaaaccgaa

SEQ ID NO: 38513 - DNA, 20 bp, human
ggagctgctgttcagtccgc

SEQ ID NO: 38514 - DNA, 20 bp, human
gcctcgctgtgagctgcggc

SEQ ID NO: 38515 - DNA, 20 bp, human
gaaaaccgaagggaagagac

SEQ ID NO: 38516 - DNA, 20 bp, human
ggtctcaccgaggagagcgg

SEQ ID NO: 38517 - DNA, 20 bp, human
gtgggtctcaccgaggagag

SEQ ID NO: 38518 - DNA, 20 bp, human
gtgagacccaaagcctcggg

SEQ ID NO: 38519 - DNA, 20 bp, human
gcgccgggtcaggcccacgg

SEQ ID NO: 38520 - DNA, 20 bp, human
gcgacgaccgccgctctcct

SEQ ID NO: 38521 - DNA, 20 bp, human
gcggtgagacccaaagcctc

SEQ ID NO: 38522 - DNA, 20 bp, human
gcgggtcccgagcggctccg

SEQ ID NO: 38523 - DNA, 20 bp, human
gggagcgcaggtgcccccgt

SEQ ID NO: 38524 - DNA, 20 bp, human
gtgcccccgtgggcctgacc

SEQ ID NO: 38525 - DNA, 20 bp, human
ggccagaaccccgaacacag

SEQ ID NO: 38526 - DNA, 20 bp, human
gcactgcagggtagtggtca

SEQ ID NO: 38527 - DNA, 20 bp, human
ggaaacgcctgccccagaaa

SEQ ID NO: 38528 - DNA, 20 bp, human
ggaggtggccgcaggagtcc

SEQ ID NO: 38529 - DNA, 20 bp, human
gtggcgggcgcgctcaagag

SEQ ID NO: 38530 - DNA, 20 bp, human
gttcctggacgcacactgca

SEQ ID NO: 38531 - DNA, 20 bp, human
gcctaccccctccctttctg

SEQ ID NO: 38532 - DNA, 20 bp, human
ggagccgccccggactcctg

SEQ ID NO: 38533 - DNA, 20 bp, human
ggggcgagctttcaaggtgg

SEQ ID NO: 38534 - DNA, 20 bp, human
ggccgggcgagctttcaagg

SEQ ID NO: 38535 - DNA, 20 bp, human
gtaccctgcagtgtgcgtcc

SEQ ID NO: 38536 - DNA, 20 bp, human
gcccggagcagaatggaaca

SEQ ID NO: 38537 - DNA, 20 bp, human
gaacccaggacggagatctg

SEQ ID NO: 38538 - DNA, 20 bp, human
gcatctgccccggagcagaa

SEQ ID NO: 38539 - DNA, 20 bp, human
gcggggcagatgcacaatcc

SEQ ID NO: 38540 - DNA, 20 bp, human
gtagtaccaggaggataaat

SEQ ID NO: 38541 - DNA, 20 bp, human
gtctgggagacccttttctg

SEQ ID NO: 38542 - DNA, 20 bp, human
gtgtgtggcacagacttcag

SEQ ID NO: 38543 - DNA, 20 bp, human
ggtcattgaaatctaggaag

SEQ ID NO: 38544 - DNA, 20 bp, human
ggatctgagggaacttaccc

SEQ ID NO: 38545 - DNA, 20 bp, human
gggaaaatgggaggaaacta

SEQ ID NO: 38546 - DNA, 20 bp, human
ggcctagcgcgtgctcaggt

SEQ ID NO: 38547 - DNA, 20 bp, human
gagcacgcgctaggcgaacg

SEQ ID NO: 38548 - DNA, 20 bp, human
ggtcctcgcgggccagcgac

SEQ ID NO: 38549 - DNA, 20 bp, human
ggagaccaggtactgcactg

SEQ ID NO: 38550 - DNA, 20 bp, human
ggcagccatgaggcgcctgg

SEQ ID NO: 38551 - DNA, 20 bp, human
gaggctcaggaacaatcgtc

SEQ ID NO: 38552 - DNA, 20 bp, human
gaggtaggagactctgcccg

SEQ ID NO: 38553 - DNA, 20 bp, human
gagcctgagcagcgtctgac

SEQ ID NO: 38554 - DNA, 20 bp, human
gctgcagctgagggtttcac

SEQ ID NO: 38555 - DNA, 20 bp, human
gatcgtcaggttgtgagacc

SEQ ID NO: 38556 - DNA, 20 bp, human
gagagccgcagacgctccac

SEQ ID NO: 38557 - DNA, 20 bp, human
gttctcctgtggagcgtctg

SEQ ID NO: 38558 - DNA, 20 bp, human
ggcggaccgcggatgaggag

SEQ ID NO: 38559 - DNA, 20 bp, human
gaaacttctgagagagccgt

SEQ ID NO: 38560 - DNA, 20 bp, human
gcctcatccgcggtccgctt

SEQ ID NO: 38561 - DNA, 20 bp, human
gtgaaggcccaagcggaccg

SEQ ID NO: 38562 - DNA, 20 bp, human
gactttgtggtagcgtgtgt

SEQ ID NO: 38563 - DNA, 20 bp, human
gacacgctaccacaaagtca

SEQ ID NO: 38564 - DNA, 20 bp, human
gggatgaggagggggcggac

SEQ ID NO: 38565 - DNA, 20 bp, human
gtggtgactgttttgatcat

SEQ ID NO: 38566 - DNA, 20 bp, human
ggcgatgcctccactctcct

SEQ ID NO: 38567 - DNA, 20 bp, human
gggcgctgggagagcgagag

SEQ ID NO: 38568 - DNA, 20 bp, human
ggttcgtgcgcggacactgg

SEQ ID NO: 38569 - DNA, 20 bp, human
gcggctggagacctcgaggt

SEQ ID NO: 38570 - DNA, 20 bp, human
gcgcgcggcgcggctaccat

SEQ ID NO: 38571 - DNA, 20 bp, human
ggtcaccatgaaaggtaggg

SEQ ID NO: 38572 - DNA, 20 bp, human
gaccatgaaaggtagggcgg

SEQ ID NO: 38573 - DNA, 20 bp, human
gctgcgggcccggggagtcg

SEQ ID NO: 38574 - DNA, 20 bp, human
gccgaggaagtcgtcccgag

SEQ ID NO: 38575 - DNA, 20 bp, human
ggggcccgcagcccaaggga

SEQ ID NO: 38576 - DNA, 20 bp, human
gctgcttgctgtccccatag

SEQ ID NO: 38577 - DNA, 20 bp, human
gccgcccagaagaggacagc

SEQ ID NO: 38578 - DNA, 20 bp, human
gtcgcgtggacccaccccta

SEQ ID NO: 38579 - DNA, 20 bp, human
ggagacgcgtggcgcgatgg

SEQ ID NO: 38580 - DNA, 20 bp, human
gcgagtgcgcccagcgtggt

SEQ ID NO: 38581 - DNA, 20 bp, human
gctgcccgctgtcctcttct

SEQ ID NO: 38582 - DNA, 20 bp, human
ggcgcggacccgcccagaag

SEQ ID NO: 38583 - DNA, 20 bp, human
gcacgctgggcgcactcgag

SEQ ID NO: 38584 - DNA, 20 bp, human
gctctggccgcgccttaaag

SEQ ID NO: 38585 - DNA, 20 bp, human
gagcgtggtgggcaacgcgt

SEQ ID NO: 38586 - DNA, 20 bp, human
gggccagtgtgtgagccggc

SEQ ID NO: 38587 - DNA, 20 bp, human
gggccggccggctcacacac

SEQ ID NO: 38588 - DNA, 20 bp, human
gagtagcgaccaggcgaggg

SEQ ID NO: 38589 - DNA, 20 bp, human
gagcagtagcgaccaggcga

SEQ ID NO: 38590 - DNA, 20 bp, human
ggagaggagcagtagcgacc

SEQ ID NO: 38591 - DNA, 20 bp, human
gcaactcgcggctctaggga

SEQ ID NO: 38592 - DNA, 20 bp, human
ggcgactccgggaaaaccac

SEQ ID NO: 38593 - DNA, 20 bp, human
ggctcacacactggcctcgg

SEQ ID NO: 38594 - DNA, 20 bp, human
ggccacaactcgcggctcta

SEQ ID NO: 38595 - DNA, 20 bp, human
gtcgggctcgcagacagtag

SEQ ID NO: 38596 - DNA, 20 bp, human
ggagggtcaagttagaaagg

SEQ ID NO: 38597 - DNA, 20 bp, human
gcagcaaatggggagaatag

SEQ ID NO: 38598 - DNA, 20 bp, human
gggcgagggtcaagttagaa

SEQ ID NO: 38599 - DNA, 20 bp, human
ggcgcacgcaaacagcagtg

SEQ ID NO: 38600 - DNA, 20 bp, human
ggagagcttaaaagagacag

SEQ ID NO: 38601 - DNA, 20 bp, human
gcagccaggtaggagccggt

SEQ ID NO: 38602 - DNA, 20 bp, human
gtgagcagccaggtaggagc

SEQ ID NO: 38603 - DNA, 20 bp, human
gggattcaggacaaccatgc

SEQ ID NO: 38604 - DNA, 20 bp, human
ggttccaaccggctcctacc

SEQ ID NO: 38605 - DNA, 20 bp, human
gcggctgagacacgatagag

SEQ ID NO: 38606 - DNA, 20 bp, human
gagggtggcaaacccctgag

SEQ ID NO: 38607 - DNA, 20 bp, human
gcggcgggcgagcttgaggg

SEQ ID NO: 38608 - DNA, 20 bp, human
gtacccgtggaaagtgtcct

SEQ ID NO: 38609 - DNA, 20 bp, human
gcattcagcagcccgctcag

SEQ ID NO: 38610 - DNA, 20 bp, human
ggggccttcgcagagcatgg

SEQ ID NO: 38611 - DNA, 20 bp, human
gtgtgggtgtcagtctaccg

SEQ ID NO: 38612 - DNA, 20 bp, human
gggcccaggacactttccac

SEQ ID NO: 38613 - DNA, 20 bp, human
gtggcggcgggcgagcttga

SEQ ID NO: 38614 - DNA, 20 bp, human
gggcttggagcagaacccct

SEQ ID NO: 38615 - DNA, 20 bp, human
gttgaaggaaaaacccctgt

SEQ ID NO: 38616 - DNA, 20 bp, human
gccccgcggcgctgatccta

SEQ ID NO: 38617 - DNA, 20 bp, human
gccttgtgcgagcccgatct

SEQ ID NO: 38618 - DNA, 20 bp, human
gcggcgcagctaacagacgg

SEQ ID NO: 38619 - DNA, 20 bp, human
ggttcggcgcagctaacaga

SEQ ID NO: 38620 - DNA, 20 bp, human
gggccgccattggctgggtt

SEQ ID NO: 38621 - DNA, 20 bp, human
gctacctggggctctcccgt

SEQ ID NO: 38622 - DNA, 20 bp, human
gccgcggggaccgccatctt

SEQ ID NO: 38623 - DNA, 20 bp, human
gtggaccaccgtgactgtag

SEQ ID NO: 38624 - DNA, 20 bp, human
gagcactgaaggcagcaccc

SEQ ID NO: 38625 - DNA, 20 bp, human
gagtgcgagaaagccgaaga

SEQ ID NO: 38626 - DNA, 20 bp, human
gcgctgccgggtgaaatcgt

SEQ ID NO: 38627 - DNA, 20 bp, human
ggaattgtccgaggagcata

SEQ ID NO: 38628 - DNA, 20 bp, human
gcagcagagctcttcagtca

SEQ ID NO: 38629 - DNA, 20 bp, human
ggaagtggcgaaggcggggt

SEQ ID NO: 38630 - DNA, 20 bp, human
gtcacagctacttaagggac

SEQ ID NO: 38631 - DNA, 20 bp, human
gatgctgctggaattgtccg

SEQ ID NO: 38632 - DNA, 20 bp, human
gcctctaggcgccgggacac

SEQ ID NO: 38633 - DNA, 20 bp, human
ggcgccggaagtggcgaagg

SEQ ID NO: 38634 - DNA, 20 bp, human
gaggacagtgaagatgctgc

SEQ ID NO: 38635 - DNA, 20 bp, human
gctgcgacgccggagcctct

SEQ ID NO: 38636 - DNA, 20 bp, human
ggcccggaggagaagcgtga

SEQ ID NO: 38637 - DNA, 20 bp, human
gggtcacggcgcgctcacaa

SEQ ID NO: 38638 - DNA, 20 bp, human
ggtgtgcgtgtcgaaggtca

SEQ ID NO: 38639 - DNA, 20 bp, human
ggtgaaggcgttggagtcga

SEQ ID NO: 38640 - DNA, 20 bp, human
gggcgttggagtcgaaggag

SEQ ID NO: 38641 - DNA, 20 bp, human
gccgggaagaggaagtctcc

SEQ ID NO: 38642 - DNA, 20 bp, human
ggagccggcggagcgagaag

SEQ ID NO: 38643 - DNA, 20 bp, human
gaggagaagcgtgaaggcgt

SEQ ID NO: 38644 - DNA, 20 bp, human
gacagccgcagcctcagaca

SEQ ID NO: 38645 - DNA, 20 bp, human
ggcggggatccgccagcatc

SEQ ID NO: 38646 - DNA, 20 bp, human
ggcccggaggagaagcgtga

SEQ ID NO: 38647 - DNA, 20 bp, human
gggtcacggcgcgctcacaa

SEQ ID NO: 38648 - DNA, 20 bp, human
ggtgtgcgtgtcgaaggtca

SEQ ID NO: 38649 - DNA, 20 bp, human
ggtgaaggcgttggagtcga

SEQ ID NO: 38650 - DNA, 20 bp, human
gggcgttggagtcgaaggag

SEQ ID NO: 38651 - DNA, 20 bp, human
gccgggaagaggaagtctcc

SEQ ID NO: 38652 - DNA, 20 bp, human
ggagccggcggagcgagaag

SEQ ID NO: 38653 - DNA, 20 bp, human
gaggagaagcgtgaaggcgt

SEQ ID NO: 38654 - DNA, 20 bp, human
gacagccgcagcctcagaca

SEQ ID NO: 38655 - DNA, 20 bp, human
ggcggggatccgccagcatc

SEQ ID NO: 38656 - DNA, 20 bp, human
ggcgcgatggtgaggcacta

SEQ ID NO: 38657 - DNA, 20 bp, human
ggcttcttggcgcgatggtg

SEQ ID NO: 38658 - DNA, 20 bp, human
gtaggggcgaagcgaggctt

SEQ ID NO: 38659 - DNA, 20 bp, human
gaggcactaggggcgaagcg

SEQ ID NO: 38660 - DNA, 20 bp, human
gccttcttgtacaagcccca

SEQ ID NO: 38661 - DNA, 20 bp, human
gccctggcttcttggcgcga

SEQ ID NO: 38662 - DNA, 20 bp, human
gttgtacaagccccacggca

SEQ ID NO: 38663 - DNA, 20 bp, human
gcaagaaggtgcttagaatc

SEQ ID NO: 38664 - DNA, 20 bp, human
gtctcccgctcccgagacgg

SEQ ID NO: 38665 - DNA, 20 bp, human
gcaagtggctccggaaactg

SEQ ID NO: 38666 - DNA, 20 bp, human
gggacgccacccgacaggag

SEQ ID NO: 38667 - DNA, 20 bp, human
ggggccagcggaccacagtg

SEQ ID NO: 38668 - DNA, 20 bp, human
gaggcgcagaccgtccacac

SEQ ID NO: 38669 - DNA, 20 bp, human
ggcgccggacgccacccgac

SEQ ID NO: 38670 - DNA, 20 bp, human
gtgtggtccgctggcccgag

SEQ ID NO: 38671 - DNA, 20 bp, human
gcttccgggccgctctagga

SEQ ID NO: 38672 - DNA, 20 bp, human
gcgtttcccctcctgtcggg

SEQ ID NO: 38673 - DNA, 20 bp, human
gccccgcccgggggaatcgg

SEQ ID NO: 38674 - DNA, 20 bp, human
gggcgacccccgattccccc

SEQ ID NO: 38675 - DNA, 20 bp, human
gtggacggtctgcgcctcca

SEQ ID NO: 38676 - DNA, 20 bp, human
ggctcgctggacgcctccat

SEQ ID NO: 38677 - DNA, 20 bp, human
gtcccagacgctgcccatgg

SEQ ID NO: 38678 - DNA, 20 bp, human
gcatcggacttagcatccag

SEQ ID NO: 38679 - DNA, 20 bp, human
gtccaggttggaactcacat

SEQ ID NO: 38680 - DNA, 20 bp, human
gggcaggctggcggaggaca

SEQ ID NO: 38681 - DNA, 20 bp, human
ggcctccatgggcagcgtct

SEQ ID NO: 38682 - DNA, 20 bp, human
gatgcagatcaaggattgtt

SEQ ID NO: 38683 - DNA, 20 bp, human
ggggcagcgtctgggacttg

SEQ ID NO: 38684 - DNA, 20 bp, human
ggcccgaagaatgcagatca

SEQ ID NO: 38685 - DNA, 20 bp, human
gctcgcggacacaggactag

SEQ ID NO: 38686 - DNA, 20 bp, human
ggtctcagaataggactccg

SEQ ID NO: 38687 - DNA, 20 bp, human
gctggcgtctgtctcagaat

SEQ ID NO: 38688 - DNA, 20 bp, human
gctggcaatgggtagccacc

SEQ ID NO: 38689 - DNA, 20 bp, human
gtgacactgcaagaatggga

SEQ ID NO: 38690 - DNA, 20 bp, human
ggtcaaccgactgcgctagg

SEQ ID NO: 38691 - DNA, 20 bp, human
gggccttgctgcctggcaat

SEQ ID NO: 38692 - DNA, 20 bp, human
gtgcgctaggaggcgtgccg

SEQ ID NO: 38693 - DNA, 20 bp, human
ggcacgcctcctagcgcagt

SEQ ID NO: 38694 - DNA, 20 bp, human
gcggttgacactgcaagaat

SEQ ID NO: 38695 - DNA, 20 bp, human
gagactttacctaggcagag

SEQ ID NO: 38696 - DNA, 20 bp, human
gtggggagccaagggatctc

SEQ ID NO: 38697 - DNA, 20 bp, human
gggcctaagggccacctgag

SEQ ID NO: 38698 - DNA, 20 bp, human
gggagccaagggatctccgg

SEQ ID NO: 38699 - DNA, 20 bp, human
ggccacctgaggggtccgaa

SEQ ID NO: 38700 - DNA, 20 bp, human
gacggaggggagtctagatg

SEQ ID NO: 38701 - DNA, 20 bp, human
ggcgaggctaaggtgagctg

SEQ ID NO: 38702 - DNA, 20 bp, human
gggcggcggtggaacctgcg

SEQ ID NO: 38703 - DNA, 20 bp, human
gtaggcctccggagatccct

SEQ ID NO: 38704 - DNA, 20 bp, human
ggacggccgtggcgaaagtg

SEQ ID NO: 38705 - DNA, 20 bp, human
gggaccccaaaagctctcct

SEQ ID NO: 38706 - DNA, 20 bp, human
gtaccgggggaagcggcgcg

SEQ ID NO: 38707 - DNA, 20 bp, human
gagggatggagccggaagag

SEQ ID NO: 38708 - DNA, 20 bp, human
gagaggggacgcccttgtgg

SEQ ID NO: 38709 - DNA, 20 bp, human
gcaagctccctagggaaggg

SEQ ID NO: 38710 - DNA, 20 bp, human
gtaccaaccaccctcaaggg

SEQ ID NO: 38711 - DNA, 20 bp, human
gacctgctgtccggtaggta

SEQ ID NO: 38712 - DNA, 20 bp, human
gcctagaggtgcagctccag

SEQ ID NO: 38713 - DNA, 20 bp, human
gcggtacccgccctcacctg

SEQ ID NO: 38714 - DNA, 20 bp, human
gacaagggcgtcccctcttc

SEQ ID NO: 38715 - DNA, 20 bp, human
gtctgtacctgctgtccggt

SEQ ID NO: 38716 - DNA, 20 bp, human
ggcactccagagcctgctca

SEQ ID NO: 38717 - DNA, 20 bp, human
gctgctcaaggtaagtcgaa

SEQ ID NO: 38718 - DNA, 20 bp, human
ggcaaaatgctccgctgtca

SEQ ID NO: 38719 - DNA, 20 bp, human
gagggctgggcagacgcagt

SEQ ID NO: 38720 - DNA, 20 bp, human
gcaaggtaagtcgaaggggt

SEQ ID NO: 38721 - DNA, 20 bp, human
gtaattgtgcaatgcaggag

SEQ ID NO: 38722 - DNA, 20 bp, human
gaatggggaactgacaacgt

SEQ ID NO: 38723 - DNA, 20 bp, human
gggggctacgggatgaaatg

SEQ ID NO: 38724 - DNA, 20 bp, human
gaacgcacaggtcattcgga

SEQ ID NO: 38725 - DNA, 20 bp, human
ggggaaaatctggacctcaa

SEQ ID NO: 38726 - DNA, 20 bp, human
ggcggtgtcggggaccatgg

SEQ ID NO: 38727 - DNA, 20 bp, human
gggagtgccagggaacggaa

SEQ ID NO: 38728 - DNA, 20 bp, human
ggtgtcggggaccatggcgg

SEQ ID NO: 38729 - DNA, 20 bp, human
ggtgagcagaagaacgcagg

SEQ ID NO: 38730 - DNA, 20 bp, human
gcaggcggtgtcggggacca

SEQ ID NO: 38731 - DNA, 20 bp, human
gtgcggggcagggagtgcca

SEQ ID NO: 38732 - DNA, 20 bp, human
gagggtgagcagaagaacgc

SEQ ID NO: 38733 - DNA, 20 bp, human
gtaggccccgcgggcctcgt

SEQ ID NO: 38734 - DNA, 20 bp, human
ggaactgcaggaaaccaacg

SEQ ID NO: 38735 - DNA, 20 bp, human
gcgcggcgctgcaggacgtg

SEQ ID NO: 38736 - DNA, 20 bp, human
gcaggtcaagccctactcca

SEQ ID NO: 38737 - DNA, 20 bp, human
gcatcgtcgtggggcttctg

SEQ ID NO: 38738 - DNA, 20 bp, human
ggatgaggggctccagatag

SEQ ID NO: 38739 - DNA, 20 bp, human
gagggtggaacactgggata

SEQ ID NO: 38740 - DNA, 20 bp, human
ggcgggggccttcagaccta

SEQ ID NO: 38741 - DNA, 20 bp, human
ggtagggcttgacctggtga

SEQ ID NO: 38742 - DNA, 20 bp, human
gtccggcgcaggcagcgcgg

SEQ ID NO: 38743 - DNA, 20 bp, human
ggagatcccgcttcaagact

SEQ ID NO: 38744 - DNA, 20 bp, human
gaggaggataagcctctccc

SEQ ID NO: 38745 - DNA, 20 bp, human
ggagagcgctggctagaccg

SEQ ID NO: 38746 - DNA, 20 bp, human
gcggcgggcacggagagccg

SEQ ID NO: 38747 - DNA, 20 bp, human
gggacccccagggcgaaggt

SEQ ID NO: 38748 - DNA, 20 bp, human
gtcgccggcctcgccatggg

SEQ ID NO: 38749 - DNA, 20 bp, human
gaccggctgggtcatggcgc

SEQ ID NO: 38750 - DNA, 20 bp, human
gagccacgtgggacccgcag

SEQ ID NO: 38751 - DNA, 20 bp, human
ggcgaaggcggcgcccagtg

SEQ ID NO: 38752 - DNA, 20 bp, human
gcggggcaccggctgggtca

SEQ ID NO: 38753 - DNA, 20 bp, human
gggacccgcaggggtcgaga

SEQ ID NO: 38754 - DNA, 20 bp, human
ggtcagctgcgtgaaaggag

SEQ ID NO: 38755 - DNA, 20 bp, human
gtcacccaggaagaggccag

SEQ ID NO: 38756 - DNA, 20 bp, human
gggggctcggattaagacat

SEQ ID NO: 38757 - DNA, 20 bp, human
gtgacgtggaggcgtccgaa

SEQ ID NO: 38758 - DNA, 20 bp, human
gaggcgtccgaagggcagca

SEQ ID NO: 38759 - DNA, 20 bp, human
ggacacaccctgctgccctt

SEQ ID NO: 38760 - DNA, 20 bp, human
gggacccggaggaagacgga

SEQ ID NO: 38761 - DNA, 20 bp, human
gccggaggaagacggagggt

SEQ ID NO: 38762 - DNA, 20 bp, human
gcgtcagcgaccctctcccg

SEQ ID NO: 38763 - DNA, 20 bp, human
ggcccaccagacggacccgg

SEQ ID NO: 38764 - DNA, 20 bp, human
gcggattaagacatcggagt

SEQ ID NO: 38765 - DNA, 20 bp, human
ggcgcgcgggtcaaaggtag

SEQ ID NO: 38766 - DNA, 20 bp, human
ggccgcggatccgtctactg

SEQ ID NO: 38767 - DNA, 20 bp, human
gcccactaccaggctccgag

SEQ ID NO: 38768 - DNA, 20 bp, human
gcggctatgaaccgcagcag

SEQ ID NO: 38769 - DNA, 20 bp, human
ggccgcagtagacggatccg

SEQ ID NO: 38770 - DNA, 20 bp, human
gactgcggctccgtctactc

SEQ ID NO: 38771 - DNA, 20 bp, human
gctatgaaccgcagcagcgg

SEQ ID NO: 38772 - DNA, 20 bp, human
gggttcatagccggagtaga

SEQ ID NO: 38773 - DNA, 20 bp, human
gagcagccctaggcctgaaa

SEQ ID NO: 38774 - DNA, 20 bp, human
gctggcagaagggaccgggt

SEQ ID NO: 38775 - DNA, 20 bp, human
gtagacggagccgcagtaga

SEQ ID NO: 38776 - DNA, 20 bp, human
gtgacggtcagtggatcggt

SEQ ID NO: 38777 - DNA, 20 bp, human
ggatcggtgggtttatctca

SEQ ID NO: 38778 - DNA, 20 bp, human
gagtctgacggtcagtggat

SEQ ID NO: 38779 - DNA, 20 bp, human
gcagtctgcagcgggatcgg

SEQ ID NO: 38780 - DNA, 20 bp, human
gcagtcagtctgacggtcag

SEQ ID NO: 38781 - DNA, 20 bp, human
ggctgcgtcggtccaatccc

SEQ ID NO: 38782 - DNA, 20 bp, human
gtgactgacgtggaacttcc

SEQ ID NO: 38783 - DNA, 20 bp, human
gtgagggccgcggtaagcag

SEQ ID NO: 38784 - DNA, 20 bp, human
ggagtagccggtaacaaacg

SEQ ID NO: 38785 - DNA, 20 bp, human
gcgaatgtgttgaactccgt

SEQ ID NO: 38786 - DNA, 20 bp, human
ggacagcgaaatggcgcctc

SEQ ID NO: 38787 - DNA, 20 bp, human
gaacagctcgtctacctccc

SEQ ID NO: 38788 - DNA, 20 bp, human
gtggtgagaagacagcgaaa

SEQ ID NO: 38789 - DNA, 20 bp, human
gctcacgggaactgaaggta

SEQ ID NO: 38790 - DNA, 20 bp, human
gtcagccggaagcaagacac

SEQ ID NO: 38791 - DNA, 20 bp, human
gaggcttattgtcactacag

SEQ ID NO: 38792 - DNA, 20 bp, human
gtccatctcacgggaactga

SEQ ID NO: 38793 - DNA, 20 bp, human
gtggtagctgccgatgtaga

SEQ ID NO: 38794 - DNA, 20 bp, human
gaaatggcgcctccggcccc

SEQ ID NO: 38795 - DNA, 20 bp, human
gtgaaggtgcggccgcgcag

SEQ ID NO: 38796 - DNA, 20 bp, human
ggttctctgtcctgacccgg

SEQ ID NO: 38797 - DNA, 20 bp, human
gcgggcgcggcacggagtag

SEQ ID NO: 38798 - DNA, 20 bp, human
gggtccctgtagaaccactg

SEQ ID NO: 38799 - DNA, 20 bp, human
gcagcaacgcaatgctcgac

SEQ ID NO: 38800 - DNA, 20 bp, human
gcggagtagcggtgccacag

SEQ ID NO: 38801 - DNA, 20 bp, human
gcaacatagtggagtcggtg

SEQ ID NO: 38802 - DNA, 20 bp, human
ggtcaggacagagaaccaga

SEQ ID NO: 38803 - DNA, 20 bp, human
ggtgccacagtggttctaca

SEQ ID NO: 38804 - DNA, 20 bp, human
gacgcaatgctcgacgggcg

SEQ ID NO: 38805 - DNA, 20 bp, human
gggtcagagttcccagtcac

SEQ ID NO: 38806 - DNA, 20 bp, human
gagcatgaggaggtccgggc

SEQ ID NO: 38807 - DNA, 20 bp, human
gtgaggaggtccgggcaggt

SEQ ID NO: 38808 - DNA, 20 bp, human
gcactcggttatagatgaag

SEQ ID NO: 38809 - DNA, 20 bp, human
gtacatctcctgggccagga

SEQ ID NO: 38810 - DNA, 20 bp, human
gcgagtggtcttggagcatg

SEQ ID NO: 38811 - DNA, 20 bp, human
gatgtactttgagggattgg

SEQ ID NO: 38812 - DNA, 20 bp, human
gtggctcagacctacctgcc

SEQ ID NO: 38813 - DNA, 20 bp, human
gttcaactagatgacatgta

SEQ ID NO: 38814 - DNA, 20 bp, human
ggtgcacaaatccccactgg

SEQ ID NO: 38815 - DNA, 20 bp, human
gtgaagcggatgtactttga

SEQ ID NO: 38816 - DNA, 20 bp, human
gaacagggtgctcccactag

SEQ ID NO: 38817 - DNA, 20 bp, human
gggacggttgcggtgggtct

SEQ ID NO: 38818 - DNA, 20 bp, human
ggtagggtcggacccctagt

SEQ ID NO: 38819 - DNA, 20 bp, human
ggggaggaggcggctcggag

SEQ ID NO: 38820 - DNA, 20 bp, human
gctaccagcacccctggacg

SEQ ID NO: 38821 - DNA, 20 bp, human
ggcgcctgggacggttgcgg

SEQ ID NO: 38822 - DNA, 20 bp, human
ggagcgcgcggcccgaaggg

SEQ ID NO: 38823 - DNA, 20 bp, human
ggaccccagccccgggaaca

SEQ ID NO: 38824 - DNA, 20 bp, human
gctcttccgctcgccggctg

SEQ ID NO: 38825 - DNA, 20 bp, human
gcgacggcacagggtgtgtg

SEQ ID NO: 38826 - DNA, 20 bp, human
gtggtcgccctggacgccgt

SEQ ID NO: 38827 - DNA, 20 bp, human
ggcagcggcgggccccgaga

SEQ ID NO: 38828 - DNA, 20 bp, human
gacgtggcccacggcgtcca

SEQ ID NO: 38829 - DNA, 20 bp, human
gcctgaaggtccatgccctg

SEQ ID NO: 38830 - DNA, 20 bp, human
ggtccagggcgaccagccgc

SEQ ID NO: 38831 - DNA, 20 bp, human
ggaaagccgagggcgtgggt

SEQ ID NO: 38832 - DNA, 20 bp, human
gctgcggcggatcctcgggc

SEQ ID NO: 38833 - DNA, 20 bp, human
gcgctctgggtcagcagaga

SEQ ID NO: 38834 - DNA, 20 bp, human
gccccccgcgcgctaggcag

SEQ ID NO: 38835 - DNA, 20 bp, human
gtgcggatttggtaaatggg

SEQ ID NO: 38836 - DNA, 20 bp, human
gccgggcccggtgcgggaac

SEQ ID NO: 38837 - DNA, 20 bp, human
gaccgaacgcctgggaccag

SEQ ID NO: 38838 - DNA, 20 bp, human
gggaggactacgacctggtg

SEQ ID NO: 38839 - DNA, 20 bp, human
gccggccaagatgtctgaca

SEQ ID NO: 38840 - DNA, 20 bp, human
ggccaagatgtctgacatgg

SEQ ID NO: 38841 - DNA, 20 bp, human
gcaccgcagcatggtcaccg

SEQ ID NO: 38842 - DNA, 20 bp, human
gcggaacgctgggcccgaaa

SEQ ID NO: 38843 - DNA, 20 bp, human
gcagacatcttggccgggag

SEQ ID NO: 38844 - DNA, 20 bp, human
ggatgaggaggactacgacc

SEQ ID NO: 38845 - DNA, 20 bp, human
gcgcctcggtgaccatgctg

SEQ ID NO: 38846 - DNA, 20 bp, human
gcgctcgcgaggacctcagg

SEQ ID NO: 38847 - DNA, 20 bp, human
gggccgcggcgatccacctg

SEQ ID NO: 38848 - DNA, 20 bp, human
ggcggcccctcctcccagag

SEQ ID NO: 38849 - DNA, 20 bp, human
ggcggtgcgccaatcaccga

SEQ ID NO: 38850 - DNA, 20 bp, human
gggccgcccgggggaaaaca

SEQ ID NO: 38851 - DNA, 20 bp, human
gctgttcacgaactgctcca

SEQ ID NO: 38852 - DNA, 20 bp, human
gaaaaggctgccgctctggg

SEQ ID NO: 38853 - DNA, 20 bp, human
gagtcgcccgagatggctcc

SEQ ID NO: 38854 - DNA, 20 bp, human
gatcgagcgcggccgagtgt

SEQ ID NO: 38855 - DNA, 20 bp, human
gatcggcggcaaagatgaca

SEQ ID NO: 38856 - DNA, 20 bp, human
ggcagccgtgcgacaggatt

SEQ ID NO: 38857 - DNA, 20 bp, human
ggggaaggctactaaggcca

SEQ ID NO: 38858 - DNA, 20 bp, human
ggccggccagcgatgggaag

SEQ ID NO: 38859 - DNA, 20 bp, human
gtgtgaggccggccagcgat

SEQ ID NO: 38860 - DNA, 20 bp, human
gcaggaacgcgggagtacag

SEQ ID NO: 38861 - DNA, 20 bp, human
ggccggcctgacgtccaagg

SEQ ID NO: 38862 - DNA, 20 bp, human
gtgggccaaatcctgtcgca

SEQ ID NO: 38863 - DNA, 20 bp, human
gtccaaagagaggccagatt

SEQ ID NO: 38864 - DNA, 20 bp, human
ggccggcctcacaccgaatc

SEQ ID NO: 38865 - DNA, 20 bp, human
gcggtggatgcgggggcctc

SEQ ID NO: 38866 - DNA, 20 bp, human
ggccttgaccctccgcacca

SEQ ID NO: 38867 - DNA, 20 bp, human
gagttggtagagaccattca

SEQ ID NO: 38868 - DNA, 20 bp, human
ggagcctaagccctccgctg

SEQ ID NO: 38869 - DNA, 20 bp, human
gaggggagtgaaagccccag

SEQ ID NO: 38870 - DNA, 20 bp, human
gccatgacacctagaaccgg

SEQ ID NO: 38871 - DNA, 20 bp, human
gcagccatgacacctagaac

SEQ ID NO: 38872 - DNA, 20 bp, human
gactcttacctagactcttg

SEQ ID NO: 38873 - DNA, 20 bp, human
ggagctttcaccgactggga

SEQ ID NO: 38874 - DNA, 20 bp, human
gggtccctggcgagacgcag

SEQ ID NO: 38875 - DNA, 20 bp, human
gcccgtggtgcggagggtca

SEQ ID NO: 38876 - DNA, 20 bp, human
gggcggctgcagctacgaac

SEQ ID NO: 38877 - DNA, 20 bp, human
gctgcagctacgaacgggac

SEQ ID NO: 38878 - DNA, 20 bp, human
gcagctacgaacgggaccgg

SEQ ID NO: 38879 - DNA, 20 bp, human
gggagcgcatgcggatccag

SEQ ID NO: 38880 - DNA, 20 bp, human
gtgcacaggccgcccctcct

SEQ ID NO: 38881 - DNA, 20 bp, human
gggaggaagcagcgggatgg

SEQ ID NO: 38882 - DNA, 20 bp, human
gcctgtgcagggtgagtgtt

SEQ ID NO: 38883 - DNA, 20 bp, human
gtgtgctcccgggagaaggg

SEQ ID NO: 38884 - DNA, 20 bp, human
gcatctccagggaagaacgt

SEQ ID NO: 38885 - DNA, 20 bp, human
gtcacgctggggactactaa

SEQ ID NO: 38886 - DNA, 20 bp, human
gcacagaatgggccgggacc

SEQ ID NO: 38887 - DNA, 20 bp, human
gtattaactacagacgtctc

SEQ ID NO: 38888 - DNA, 20 bp, human
ggccgccgctccgtcacctc

SEQ ID NO: 38889 - DNA, 20 bp, human
ggacaccgcccagcgaccgt

SEQ ID NO: 38890 - DNA, 20 bp, human
gggtcgaagcttccaggtag

SEQ ID NO: 38891 - DNA, 20 bp, human
gagctgagggagcgtcgtca

SEQ ID NO: 38892 - DNA, 20 bp, human
gctgagggactggattgtaa

SEQ ID NO: 38893 - DNA, 20 bp, human
gggtacgacgaagcagtcgg

SEQ ID NO: 38894 - DNA, 20 bp, human
gaggcactaagtcggttctg

SEQ ID NO: 38895 - DNA, 20 bp, human
gcagggtacgacgaagcagt

SEQ ID NO: 38896 - DNA, 20 bp, human
gatgctccaagcagggccgc

SEQ ID NO: 38897 - DNA, 20 bp, human
gacaacctgcgggcaggcgc

SEQ ID NO: 38898 - DNA, 20 bp, human
gggccgagccagcgactaag

SEQ ID NO: 38899 - DNA, 20 bp, human
gagcgactaagaggaccgag

SEQ ID NO: 38900 - DNA, 20 bp, human
gtggacgcttgacaacctgc

SEQ ID NO: 38901 - DNA, 20 bp, human
gccggacgccggggtgatca

SEQ ID NO: 38902 - DNA, 20 bp, human
gctgcagcagacctcacggt

SEQ ID NO: 38903 - DNA, 20 bp, human
gggagataaattcccgtcag

SEQ ID NO: 38904 - DNA, 20 bp, human
gagtcgctggctcggcctcc

SEQ ID NO: 38905 - DNA, 20 bp, human
gtaggagctagcgagagggt

SEQ ID NO: 38906 - DNA, 20 bp, human
gtccgaaacgaccaactcag

SEQ ID NO: 38907 - DNA, 20 bp, human
gccgttgggtttcaagtctc

SEQ ID NO: 38908 - DNA, 20 bp, human
ggtgagaagggtcttcccgt

SEQ ID NO: 38909 - DNA, 20 bp, human
gaaacgaccaactcagcggg

SEQ ID NO: 38910 - DNA, 20 bp, human
gctgcaagtcagccgactta

SEQ ID NO: 38911 - DNA, 20 bp, human
gcgcacactgcgcggcacac

SEQ ID NO: 38912 - DNA, 20 bp, human
gacaaacccgcccgctgagt

SEQ ID NO: 38913 - DNA, 20 bp, human
ggtttgcaccgggagagcta

SEQ ID NO: 38914 - DNA, 20 bp, human
gtcctcatacgtaacaacag

SEQ ID NO: 38915 - DNA, 20 bp, human
gagtcggctgacttgcagtc

SEQ ID NO: 38916 - DNA, 20 bp, human
ggagctcacggggcgggcgt

SEQ ID NO: 38917 - DNA, 20 bp, human
gacgcctgagggacagtctg

SEQ ID NO: 38918 - DNA, 20 bp, human
gggctgtccggacggtgcag

SEQ ID NO: 38919 - DNA, 20 bp, human
gccgagaatagcctggaagg

SEQ ID NO: 38920 - DNA, 20 bp, human
gacctacggtatgcagggta

SEQ ID NO: 38921 - DNA, 20 bp, human
gcctctcccaacccgatact

SEQ ID NO: 38922 - DNA, 20 bp, human
gcggtatgcagggtacggtg

SEQ ID NO: 38923 - DNA, 20 bp, human
gttctcggaaccgcagccag

SEQ ID NO: 38924 - DNA, 20 bp, human
gggtcccggctggagaagcg

SEQ ID NO: 38925 - DNA, 20 bp, human
gccggtcgtcagtgacgcta

SEQ ID NO: 38926 - DNA, 20 bp, human
gggcttcctactctaaacca

SEQ ID NO: 38927 - DNA, 20 bp, human
ggtcagggttcagcccgagt

SEQ ID NO: 38928 - DNA, 20 bp, human
gcggggagagggcatagagt

SEQ ID NO: 38929 - DNA, 20 bp, human
gcccgcagctggtgccgacg

SEQ ID NO: 38930 - DNA, 20 bp, human
ggatgctgtggtgtccacag

SEQ ID NO: 38931 - DNA, 20 bp, human
gaacttgggaaaccatcagg

SEQ ID NO: 38932 - DNA, 20 bp, human
gtggaggcgctgattttggt

SEQ ID NO: 38933 - DNA, 20 bp, human
gtgtggcagggaatcggcaa

SEQ ID NO: 38934 - DNA, 20 bp, human
gttcttttgcggctccacgt

SEQ ID NO: 38935 - DNA, 20 bp, human
gccacaggggccgggagtca

SEQ ID NO: 38936 - DNA, 20 bp, human
gactcctgggctgaaaagga

SEQ ID NO: 38937 - DNA, 20 bp, human
gttcgagtggaccatcaggt

SEQ ID NO: 38938 - DNA, 20 bp, human
gcacattcgagtggaccatc

SEQ ID NO: 38939 - DNA, 20 bp, human
gggagagccgtggggacaca

SEQ ID NO: 38940 - DNA, 20 bp, human
gcatgggagaaacgcagacc

SEQ ID NO: 38941 - DNA, 20 bp, human
ggtgtgaagggagttaggtg

SEQ ID NO: 38942 - DNA, 20 bp, human
gtggaattcgtcaaatgcat

SEQ ID NO: 38943 - DNA, 20 bp, human
ggctctgggaacaagggcag

SEQ ID NO: 38944 - DNA, 20 bp, human
gtcagtgtgtgaagggagtt

SEQ ID NO: 38945 - DNA, 20 bp, human
gctcccgtaaaggggacccc

SEQ ID NO: 38946 - DNA, 20 bp, human
gggcggcgagcggaatgcag

SEQ ID NO: 38947 - DNA, 20 bp, human
gtggccacgtccgcacccgg

SEQ ID NO: 38948 - DNA, 20 bp, human
gcggcgctgtcagtgcgagg

SEQ ID NO: 38949 - DNA, 20 bp, human
gtgcggacgtggccagcctc

SEQ ID NO: 38950 - DNA, 20 bp, human
gccgcggggagggtaaggag

SEQ ID NO: 38951 - DNA, 20 bp, human
gctcggctcccatcaccggt

SEQ ID NO: 38952 - DNA, 20 bp, human
gggcctgtccgtcccagact

SEQ ID NO: 38953 - DNA, 20 bp, human
gggtgatgggagccgagtct

SEQ ID NO: 38954 - DNA, 20 bp, human
ggtcagtgcgaggcggcgag

SEQ ID NO: 38955 - DNA, 20 bp, human
gagccgagtctgggacggac

SEQ ID NO: 38956 - DNA, 20 bp, human
gtggcaacagcgtgacgtgg

SEQ ID NO: 38957 - DNA, 20 bp, human
gtctgcgggagcagcggtcc

SEQ ID NO: 38958 - DNA, 20 bp, human
gcctccaccgcggaaccccg

SEQ ID NO: 38959 - DNA, 20 bp, human
gccgctgctcccgcagatct

SEQ ID NO: 38960 - DNA, 20 bp, human
ggtaggctagaactgaagcc

SEQ ID NO: 38961 - DNA, 20 bp, human
gtcgggacctctgagcgcag

SEQ ID NO: 38962 - DNA, 20 bp, human
gcgcgaccaatgaggtgaga

SEQ ID NO: 38963 - DNA, 20 bp, human
ggaccaatgaggtgagaggg

SEQ ID NO: 38964 - DNA, 20 bp, human
gctctcccaggcccgagcca

SEQ ID NO: 38965 - DNA, 20 bp, human
gcctcactccaaaggcggag

SEQ ID NO: 38966 - DNA, 20 bp, human
gctccgggcccgaccagagg

SEQ ID NO: 38967 - DNA, 20 bp, human
gggcttcggagagtctatca

SEQ ID NO: 38968 - DNA, 20 bp, human
gtggtccgggaggtgacgac

SEQ ID NO: 38969 - DNA, 20 bp, human
gtagcaacaagccatagggg

SEQ ID NO: 38970 - DNA, 20 bp, human
gcagtagcaacaagccatag

SEQ ID NO: 38971 - DNA, 20 bp, human
ggaagccggtcgtcacctcc

SEQ ID NO: 38972 - DNA, 20 bp, human
gctatcatggcagctcggac

SEQ ID NO: 38973 - DNA, 20 bp, human
gcttccggtctcctccccta

SEQ ID NO: 38974 - DNA, 20 bp, human
gggtcatacggccttgagaa

SEQ ID NO: 38975 - DNA, 20 bp, human
ggggctccgggcccgaccag

SEQ ID NO: 38976 - DNA, 20 bp, human
gaggccccgcgcgaaccccg

SEQ ID NO: 38977 - DNA, 20 bp, human
gggctgcaagtcaccaccgt

SEQ ID NO: 38978 - DNA, 20 bp, human
ggcggctcgcgagcccagca

SEQ ID NO: 38979 - DNA, 20 bp, human
ggcctcaccagcgccatgct

SEQ ID NO: 38980 - DNA, 20 bp, human
gaccgcatgaggcgcaagta

SEQ ID NO: 38981 - DNA, 20 bp, human
gacgcgccagggcgaaggag

SEQ ID NO: 38982 - DNA, 20 bp, human
ggccctggggcgaatcacct

SEQ ID NO: 38983 - DNA, 20 bp, human
ggcccgcccgcactcaccaa

SEQ ID NO: 38984 - DNA, 20 bp, human
ggcgcaagtacggctgcagg

SEQ ID NO: 38985 - DNA, 20 bp, human
ggccgtacttgcgcctcatg

SEQ ID NO: 38986 - DNA, 20 bp, human
ggtaagctgggctcctccgg

SEQ ID NO: 38987 - DNA, 20 bp, human
ggagggaccggaaaagaggt

SEQ ID NO: 38988 - DNA, 20 bp, human
gtcgggagggaccggaaaag

SEQ ID NO: 38989 - DNA, 20 bp, human
ggccgtaagctgggctcctc

SEQ ID NO: 38990 - DNA, 20 bp, human
gggggtcagcgcgaaaccta

SEQ ID NO: 38991 - DNA, 20 bp, human
gcgtttgtcgcgatgtggag

SEQ ID NO: 38992 - DNA, 20 bp, human
gtgtggagtggccgtaagct

SEQ ID NO: 38993 - DNA, 20 bp, human
gactcttaaaaaccaacccc

SEQ ID NO: 38994 - DNA, 20 bp, human
gtgtctctggacctcgcgag

SEQ ID NO: 38995 - DNA, 20 bp, human
ggttattcctgccccggcaa

SEQ ID NO: 38996 - DNA, 20 bp, human
ggcagagccgacggaggaca

SEQ ID NO: 38997 - DNA, 20 bp, human
ggagcccgcagagccgacgg

SEQ ID NO: 38998 - DNA, 20 bp, human
ggggcgcagcagagtcgcca

SEQ ID NO: 38999 - DNA, 20 bp, human
gcgtcgctcctagcccggag

SEQ ID NO: 39000 - DNA, 20 bp, human
gcgggctcccgggcctacag

SEQ ID NO: 39001 - DNA, 20 bp, human
gtggaacatagcctaggtcg

SEQ ID NO: 39002 - DNA, 20 bp, human
gcgcaggccgctgtaggccc

SEQ ID NO: 39003 - DNA, 20 bp, human
gcgggagcccgcagagccga

SEQ ID NO: 39004 - DNA, 20 bp, human
gctccaagccgcccccacgg

SEQ ID NO: 39005 - DNA, 20 bp, human
gcgtacccgcccatcctccg

SEQ ID NO: 39006 - DNA, 20 bp, human
ggatctgaccgtccatggtc

SEQ ID NO: 39007 - DNA, 20 bp, human
gggagggatctgaccgtcca

SEQ ID NO: 39008 - DNA, 20 bp, human
gcatagagcacagctcccgg

SEQ ID NO: 39009 - DNA, 20 bp, human
gcatcgcccgcgaccaccca

SEQ ID NO: 39010 - DNA, 20 bp, human
gcactcgactaccaagatgg

SEQ ID NO: 39011 - DNA, 20 bp, human
ggagctattgcggccgtggg

SEQ ID NO: 39012 - DNA, 20 bp, human
gcttggtagtcgagtgacaa

SEQ ID NO: 39013 - DNA, 20 bp, human
ggccagaagaaaccagacca

SEQ ID NO: 39014 - DNA, 20 bp, human
gcgcaacaaggcgtactctc

SEQ ID NO: 39015 - DNA, 20 bp, human
gatggagctattgcggccgt

SEQ ID NO: 39016 - DNA, 20 bp, human
gtgtcgggtggaggcctggt

SEQ ID NO: 39017 - DNA, 20 bp, human
gctactagtggccggaaacc

SEQ ID NO: 39018 - DNA, 20 bp, human
gacggcgcaggtctgcacca

SEQ ID NO: 39019 - DNA, 20 bp, human
gtgcacgcacagccccgcat

SEQ ID NO: 39020 - DNA, 20 bp, human
gccctcctagaggaacccca

SEQ ID NO: 39021 - DNA, 20 bp, human
gctgacaagccgggccgcca

SEQ ID NO: 39022 - DNA, 20 bp, human
ggcgggagttctgagtgcga

SEQ ID NO: 39023 - DNA, 20 bp, human
gccgcatcggctgacaagcc

SEQ ID NO: 39024 - DNA, 20 bp, human
gtgcgtgcagctccccacag

SEQ ID NO: 39025 - DNA, 20 bp, human
ggtccattagggtcaaaagt

SEQ ID NO: 39026 - DNA, 20 bp, human
gccccgggcgcagccgccaa

SEQ ID NO: 39027 - DNA, 20 bp, human
gtgggtcgaagaggtcacgg

SEQ ID NO: 39028 - DNA, 20 bp, human
gccagttccgttcaacgaag

SEQ ID NO: 39029 - DNA, 20 bp, human
gccccggcgcaactcattgc

SEQ ID NO: 39030 - DNA, 20 bp, human
gtagcggcgagagtgacagg

SEQ ID NO: 39031 - DNA, 20 bp, human
gcccctgtgcagtgatgtca

SEQ ID NO: 39032 - DNA, 20 bp, human
ggagcgcccagaagtagcgg

SEQ ID NO: 39033 - DNA, 20 bp, human
gtccgagccaagggcactat

SEQ ID NO: 39034 - DNA, 20 bp, human
gagcgagcgcccagaagtag

SEQ ID NO: 39035 - DNA, 20 bp, human
gcgggcgcagccgccaaagg

SEQ ID NO: 39036 - DNA, 20 bp, human
gagtccactggaaggacagg

SEQ ID NO: 39037 - DNA, 20 bp, human
ggacgtgcccgcttccaaaa

SEQ ID NO: 39038 - DNA, 20 bp, human
ggcggcccacgagcaaggtg

SEQ ID NO: 39039 - DNA, 20 bp, human
gctaccggtcgcgtcgccgt

SEQ ID NO: 39040 - DNA, 20 bp, human
gtggcaatggacttgagaat

SEQ ID NO: 39041 - DNA, 20 bp, human
gtcacgcagcctgagcctgt

SEQ ID NO: 39042 - DNA, 20 bp, human
ggaagcgggcacgtcgccca

SEQ ID NO: 39043 - DNA, 20 bp, human
gtcgtgaagtggtgaggaaa

SEQ ID NO: 39044 - DNA, 20 bp, human
gctggtgcgcttggccgggc

SEQ ID NO: 39045 - DNA, 20 bp, human
gagggccgaagctagccagg

SEQ ID NO: 39046 - DNA, 20 bp, human
gctctacgtgtcccccgggg

SEQ ID NO: 39047 - DNA, 20 bp, human
gatccgtagtgcctccccgg

SEQ ID NO: 39048 - DNA, 20 bp, human
ggtcccccggggaggcacta

SEQ ID NO: 39049 - DNA, 20 bp, human
gacccccggcatggagaccg

SEQ ID NO: 39050 - DNA, 20 bp, human
ggagccgactcgaacactga

SEQ ID NO: 39051 - DNA, 20 bp, human
gaaaccctgcccatgaccct

SEQ ID NO: 39052 - DNA, 20 bp, human
gctggtcccgaccaccaccc

SEQ ID NO: 39053 - DNA, 20 bp, human
gtgttcgagtcggctcgatc

SEQ ID NO: 39054 - DNA, 20 bp, human
gactaagaggccatcacacc

SEQ ID NO: 39055 - DNA, 20 bp, human
gctcggacgccgggcgaccg

SEQ ID NO: 39056 - DNA, 20 bp, human
ggcgcggccaccccggaggc

SEQ ID NO: 39057 - DNA, 20 bp, human
gccccaaaagccggaggtgg

SEQ ID NO: 39058 - DNA, 20 bp, human
gtcttcagcgggcgagtccc

SEQ ID NO: 39059 - DNA, 20 bp, human
ggtgatcccccaaaagccgg

SEQ ID NO: 39060 - DNA, 20 bp, human
gatcccccaaaagccggagg

SEQ ID NO: 39061 - DNA, 20 bp, human
gtcgagggcccgactcccca

SEQ ID NO: 39062 - DNA, 20 bp, human
gcagcgccggggccaggtag

SEQ ID NO: 39063 - DNA, 20 bp, human
gaccaccgcggccaagatgg

SEQ ID NO: 39064 - DNA, 20 bp, human
gccgcggccaagatggaggt

SEQ ID NO: 39065 - DNA, 20 bp, human
gttgagtctcggggagggtg

SEQ ID NO: 39066 - DNA, 20 bp, human
ggccctgccgcgctcaccgg

SEQ ID NO: 39067 - DNA, 20 bp, human
gctgcggcaccggcttcggg

SEQ ID NO: 39068 - DNA, 20 bp, human
gcgctcaccgggggcaccgg

SEQ ID NO: 39069 - DNA, 20 bp, human
gagggacctccgcccaggag

SEQ ID NO: 39070 - DNA, 20 bp, human
gatccggagccgcccgaagc

SEQ ID NO: 39071 - DNA, 20 bp, human
gatctctgggagcaggaagg

SEQ ID NO: 39072 - DNA, 20 bp, human
gcttcccagaggccgggatc

SEQ ID NO: 39073 - DNA, 20 bp, human
gttcgggcggctccggatcc

SEQ ID NO: 39074 - DNA, 20 bp, human
ggctccggatcccggcctct

SEQ ID NO: 39075 - DNA, 20 bp, human
ggaaggaggctgctcccgac

SEQ ID NO: 39076 - DNA, 20 bp, human
gaggagccgcagcggggtat

SEQ ID NO: 39077 - DNA, 20 bp, human
gtgacctccaggccccgctt

SEQ ID NO: 39078 - DNA, 20 bp, human
ggccaagtgagccgagggac

SEQ ID NO: 39079 - DNA, 20 bp, human
gcgcaggccgacccctaagg

SEQ ID NO: 39080 - DNA, 20 bp, human
gggtggctagacccccacac

SEQ ID NO: 39081 - DNA, 20 bp, human
gaagtgagccgagggacggg

SEQ ID NO: 39082 - DNA, 20 bp, human
gctccgcaggccgaccccta

SEQ ID NO: 39083 - DNA, 20 bp, human
gttggcacagtcatgacgat

SEQ ID NO: 39084 - DNA, 20 bp, human
gggccatgagaactgtcacg

SEQ ID NO: 39085 - DNA, 20 bp, human
gtcaggaagtggatgtaggg

SEQ ID NO: 39086 - DNA, 20 bp, human
gacccctaaaagccttccct

SEQ ID NO: 39087 - DNA, 20 bp, human
ggcttcgcccggctttgcag

SEQ ID NO: 39088 - DNA, 20 bp, human
gacccgggccgaggtgcctg

SEQ ID NO: 39089 - DNA, 20 bp, human
gggcgaggcgtagagcccgg

SEQ ID NO: 39090 - DNA, 20 bp, human
gagcggttggaggcttcgcc

SEQ ID NO: 39091 - DNA, 20 bp, human
ggcctcaggcacctcggccc

SEQ ID NO: 39092 - DNA, 20 bp, human
ggcccagggaaggcttttag

SEQ ID NO: 39093 - DNA, 20 bp, human
ggggcgcgagccgctcaccc

SEQ ID NO: 39094 - DNA, 20 bp, human
gggtcagggatcgcctgctt

SEQ ID NO: 39095 - DNA, 20 bp, human
gggctttgcagcggggactt

SEQ ID NO: 39096 - DNA, 20 bp, human
gtctgggcgccgggagtcgg

SEQ ID NO: 39097 - DNA, 20 bp, human
ggtgcagacagtgctcatga

SEQ ID NO: 39098 - DNA, 20 bp, human
gcggcggcggcgtccagctc

SEQ ID NO: 39099 - DNA, 20 bp, human
gcgcggcagtcatcaaggta

SEQ ID NO: 39100 - DNA, 20 bp, human
gcccatcgcgcagaccggga

SEQ ID NO: 39101 - DNA, 20 bp, human
gtcgaggtccgggctcccga

SEQ ID NO: 39102 - DNA, 20 bp, human
gagcaggggcctgtcgggac

SEQ ID NO: 39103 - DNA, 20 bp, human
gggtcccgacaagagtccca

SEQ ID NO: 39104 - DNA, 20 bp, human
gcaggtaacgcagccaagag

SEQ ID NO: 39105 - DNA, 20 bp, human
gagtgagcttccctcaccgc

SEQ ID NO: 39106 - DNA, 20 bp, human
ggcgcgcagggaccgctcgt

SEQ ID NO: 39107 - DNA, 20 bp, human
gggctgacatcagcgacgag

SEQ ID NO: 39108 - DNA, 20 bp, human
gggagtgactcgagcggatc

SEQ ID NO: 39109 - DNA, 20 bp, human
gaccgccggggctgccagag

SEQ ID NO: 39110 - DNA, 20 bp, human
gtggcctccgcagtccttgg

SEQ ID NO: 39111 - DNA, 20 bp, human
gcagagcggcatcctccccc

SEQ ID NO: 39112 - DNA, 20 bp, human
ggcgggcgagcgccgacgag

SEQ ID NO: 39113 - DNA, 20 bp, human
gtgacatcagcgacgagcgg

SEQ ID NO: 39114 - DNA, 20 bp, human
gggggccggagtgactcgag

SEQ ID NO: 39115 - DNA, 20 bp, human
gcggcccccaaggactgcgg

SEQ ID NO: 39116 - DNA, 20 bp, human
gtcgcaagaacgcagtgtca

SEQ ID NO: 39117 - DNA, 20 bp, human
gcgcaggatcggccagagtg

SEQ ID NO: 39118 - DNA, 20 bp, human
gctctagagagccgcaggat

SEQ ID NO: 39119 - DNA, 20 bp, human
ggccgcagacgcgccttgaa

SEQ ID NO: 39120 - DNA, 20 bp, human
gatactacagacacccggag

SEQ ID NO: 39121 - DNA, 20 bp, human
gagcagccagcgctcccgga

SEQ ID NO: 39122 - DNA, 20 bp, human
gggcgaaggagccacctctc

SEQ ID NO: 39123 - DNA, 20 bp, human
gatgctagccccgccctctt

SEQ ID NO: 39124 - DNA, 20 bp, human
gggtgtccagctccgcactc

SEQ ID NO: 39125 - DNA, 20 bp, human
gccccgccctcttaggttga

SEQ ID NO: 39126 - DNA, 20 bp, human
gacgcgtcttcgaggacccc

SEQ ID NO: 39127 - DNA, 20 bp, human
gggccgaccggaagctggga

SEQ ID NO: 39128 - DNA, 20 bp, human
gttcatggcgacgggcacgg

SEQ ID NO: 39129 - DNA, 20 bp, human
gggttccagacggccctgga

SEQ ID NO: 39130 - DNA, 20 bp, human
gcctggagggcacccctgtg

SEQ ID NO: 39131 - DNA, 20 bp, human
ggaacttggacaccctgaag

SEQ ID NO: 39132 - DNA, 20 bp, human
gacctgagacccgacgcccg

SEQ ID NO: 39133 - DNA, 20 bp, human
ggcgaggccgaccggaagct

SEQ ID NO: 39134 - DNA, 20 bp, human
ggagcgccagagcgagtcac

SEQ ID NO: 39135 - DNA, 20 bp, human
gtgccttcccagcttccggt

SEQ ID NO: 39136 - DNA, 20 bp, human
gggttccagacggccctgga

SEQ ID NO: 39137 - DNA, 20 bp, human
gacgcgtcttcgaggacccc

SEQ ID NO: 39138 - DNA, 20 bp, human
gggccgaccggaagctggga

SEQ ID NO: 39139 - DNA, 20 bp, human
gttcatggcgacgggcacgg

SEQ ID NO: 39140 - DNA, 20 bp, human
gcctggagggcacccctgtg

SEQ ID NO: 39141 - DNA, 20 bp, human
ggaacttggacaccctgaag

SEQ ID NO: 39142 - DNA, 20 bp, human
gacctgagacccgacgcccg

SEQ ID NO: 39143 - DNA, 20 bp, human
ggcgaggccgaccggaagct

SEQ ID NO: 39144 - DNA, 20 bp, human
ggagcgccagagcgagtcac

SEQ ID NO: 39145 - DNA, 20 bp, human
gtgccttcccagcttccggt

SEQ ID NO: 39146 - DNA, 20 bp, human
ggcaggaggccgggggacaa

SEQ ID NO: 39147 - DNA, 20 bp, human
gtcaaggagggccctccgtc

SEQ ID NO: 39148 - DNA, 20 bp, human
gtggcatcttgtgggctgac

SEQ ID NO: 39149 - DNA, 20 bp, human
gggggacaatggcatcttgt

SEQ ID NO: 39150 - DNA, 20 bp, human
gcggtggggccaccctccag

SEQ ID NO: 39151 - DNA, 20 bp, human
gggccctccgtcgggtgtct

SEQ ID NO: 39152 - DNA, 20 bp, human
gccgtcgggtgtctgggaaa

SEQ ID NO: 39153 - DNA, 20 bp, human
gagtgtacccgtccactgca

SEQ ID NO: 39154 - DNA, 20 bp, human
gtataactgaaggctctgga

SEQ ID NO: 39155 - DNA, 20 bp, human
gaggatcagtggtctgaatg

SEQ ID NO: 39156 - DNA, 20 bp, human
ggcgcgctctccgtccgcag

SEQ ID NO: 39157 - DNA, 20 bp, human
gggctcggccgtcatctggt

SEQ ID NO: 39158 - DNA, 20 bp, human
ggcccccgcgggcttctccg

SEQ ID NO: 39159 - DNA, 20 bp, human
gcgcgacgcggcgcttgcag

SEQ ID NO: 39160 - DNA, 20 bp, human
gcgcagcgggacactgtccg

SEQ ID NO: 39161 - DNA, 20 bp, human
gtgccgggcggcgtacaacc

SEQ ID NO: 39162 - DNA, 20 bp, human
ggcggcggcggcttccactg

SEQ ID NO: 39163 - DNA, 20 bp, human
gggcacgccgtcccggaata

SEQ ID NO: 39164 - DNA, 20 bp, human
gcgagcgcgcccctggccgg

SEQ ID NO: 39165 - DNA, 20 bp, human
gacacacacatcagcgctgg

SEQ ID NO: 39166 - DNA, 20 bp, human
gcagcgtcccgtgaggagag

SEQ ID NO: 39167 - DNA, 20 bp, human
gagaggacacagggatcccg

SEQ ID NO: 39168 - DNA, 20 bp, human
gcggcgcccagcgtcccgtg

SEQ ID NO: 39169 - DNA, 20 bp, human
gcggaactactcccacaggg

SEQ ID NO: 39170 - DNA, 20 bp, human
gcgcagaagccggatggagg

SEQ ID NO: 39171 - DNA, 20 bp, human
gagaagccgaggctctgata

SEQ ID NO: 39172 - DNA, 20 bp, human
gggccggccaacctcgccaa

SEQ ID NO: 39173 - DNA, 20 bp, human
gagggcagagcagaaccttg

SEQ ID NO: 39174 - DNA, 20 bp, human
gacacagggatcccggggag

SEQ ID NO: 39175 - DNA, 20 bp, human
gttcagatagtggaagctgg

SEQ ID NO: 39176 - DNA, 20 bp, human
gaaggaacgcacctccatcc

SEQ ID NO: 39177 - DNA, 20 bp, human
ggagaggactgaggtggctt

SEQ ID NO: 39178 - DNA, 20 bp, human
ggctctggcgtcctggatgg

SEQ ID NO: 39179 - DNA, 20 bp, human
gggcgcagacgcgagaggtg

SEQ ID NO: 39180 - DNA, 20 bp, human
gtcgctctgcgggtcgtagg

SEQ ID NO: 39181 - DNA, 20 bp, human
gagggtggcgcagacgcgag

SEQ ID NO: 39182 - DNA, 20 bp, human
ggccggcgccgcccgcaggg

SEQ ID NO: 39183 - DNA, 20 bp, human
gcggctctattgccaggtag

SEQ ID NO: 39184 - DNA, 20 bp, human
gggggtgcaagacaaatccc

SEQ ID NO: 39185 - DNA, 20 bp, human
gtgcgggtcgtaggtggaag

SEQ ID NO: 39186 - DNA, 20 bp, human
gtgggaagttgcgtagacag

SEQ ID NO: 39187 - DNA, 20 bp, human
gatccaaccgaggcctcctc

SEQ ID NO: 39188 - DNA, 20 bp, human
gtcaggcaggcagggtctcg

SEQ ID NO: 39189 - DNA, 20 bp, human
gggtctatagagcaaggaag

SEQ ID NO: 39190 - DNA, 20 bp, human
gctcggaaccagacacgtga

SEQ ID NO: 39191 - DNA, 20 bp, human
gatatgcacgaagggtgccc

SEQ ID NO: 39192 - DNA, 20 bp, human
gcctgataagtggctctccg

SEQ ID NO: 39193 - DNA, 20 bp, human
gtgcctgaggaggcctcggt

SEQ ID NO: 39194 - DNA, 20 bp, human
ggccacttatcaggacgcag

SEQ ID NO: 39195 - DNA, 20 bp, human
ggatagccgatatgcacgaa

SEQ ID NO: 39196 - DNA, 20 bp, human
gccctgggttgtggaagagg

SEQ ID NO: 39197 - DNA, 20 bp, human
gcggcgggagtcgtagtcag

SEQ ID NO: 39198 - DNA, 20 bp, human
gaaacggagggcgtgacgag

SEQ ID NO: 39199 - DNA, 20 bp, human
gtcgctgcatactgatgaca

SEQ ID NO: 39200 - DNA, 20 bp, human
gccttcaaggccctcaacgg

SEQ ID NO: 39201 - DNA, 20 bp, human
gctgccctaggagccaggag

SEQ ID NO: 39202 - DNA, 20 bp, human
ggatagaaggtgccgcccaa

SEQ ID NO: 39203 - DNA, 20 bp, human
ggctccggaaacgtgatgtg

SEQ ID NO: 39204 - DNA, 20 bp, human
gagagaagcacttccgggtc

SEQ ID NO: 39205 - DNA, 20 bp, human
gctgccgctcctggctccta

SEQ ID NO: 39206 - DNA, 20 bp, human
ggttaaggacgtactcgtct

SEQ ID NO: 39207 - DNA, 20 bp, human
gcttgatcctgccaaggagg

SEQ ID NO: 39208 - DNA, 20 bp, human
gcttggcaggatcaagacct

SEQ ID NO: 39209 - DNA, 20 bp, human
gtcggctcagaactccaagc

SEQ ID NO: 39210 - DNA, 20 bp, human
gtaggaaggagctagcgacg

SEQ ID NO: 39211 - DNA, 20 bp, human
gcatgagtgaactcttccat

SEQ ID NO: 39212 - DNA, 20 bp, human
gaaccgggagtgggggacag

SEQ ID NO: 39213 - DNA, 20 bp, human
gggggtgtggaaaagactgg

SEQ ID NO: 39214 - DNA, 20 bp, human
ggaggaggatcttccgcaag

SEQ ID NO: 39215 - DNA, 20 bp, human
gagtctgcgctaggcccgct

SEQ ID NO: 39216 - DNA, 20 bp, human
gcaagaaggcgcgcgatgcg

SEQ ID NO: 39217 - DNA, 20 bp, human
ggtagggcagaggcaccgga

SEQ ID NO: 39218 - DNA, 20 bp, human
gcgactgccggaagtgactg

SEQ ID NO: 39219 - DNA, 20 bp, human
ggcagagggcagaggccgta

SEQ ID NO: 39220 - DNA, 20 bp, human
ggaagtgactgcggacgaat

SEQ ID NO: 39221 - DNA, 20 bp, human
gtcgtcggccgcgccctctc

SEQ ID NO: 39222 - DNA, 20 bp, human
gcggggggggggggcagaca

SEQ ID NO: 39223 - DNA, 20 bp, human
gtctccagagcgccgcaatg

SEQ ID NO: 39224 - DNA, 20 bp, human
gccagagcgccgcaatgggg

SEQ ID NO: 39225 - DNA, 20 bp, human
gcgctctggagataattatt

SEQ ID NO: 39226 - DNA, 20 bp, human
ggtatgtccgctggattgtg

SEQ ID NO: 39227 - DNA, 20 bp, human
gctggccggtgtatgtccgc

SEQ ID NO: 39228 - DNA, 20 bp, human
gcccgggcctcacaatccag

SEQ ID NO: 39229 - DNA, 20 bp, human
gcaatccagcggacatacac

SEQ ID NO: 39230 - DNA, 20 bp, human
gagtgctggtaggctgccaa

SEQ ID NO: 39231 - DNA, 20 bp, human
ggccaggatgtagtgctggt

SEQ ID NO: 39232 - DNA, 20 bp, human
ggacatacaccggccagcca

SEQ ID NO: 39233 - DNA, 20 bp, human
ggcaccccgtaaggccacgg

SEQ ID NO: 39234 - DNA, 20 bp, human
gcgggatctgggctccgccg

SEQ ID NO: 39235 - DNA, 20 bp, human
gacagcaccccgtaaggcca

SEQ ID NO: 39236 - DNA, 20 bp, human
gatctagcgcggtgcaggcg

SEQ ID NO: 39237 - DNA, 20 bp, human
gggtctgcgatggggggtct

SEQ ID NO: 39238 - DNA, 20 bp, human
ggcaaggcgctcgcagactc

SEQ ID NO: 39239 - DNA, 20 bp, human
ggccccgctctgcaaacccg

SEQ ID NO: 39240 - DNA, 20 bp, human
gcccgccgggtgagtcaggg

SEQ ID NO: 39241 - DNA, 20 bp, human
gtccgccctgactcacccgg

SEQ ID NO: 39242 - DNA, 20 bp, human
gtgcagagcggggcattcgg

SEQ ID NO: 39243 - DNA, 20 bp, human
gcccagcgcggagccctatg

SEQ ID NO: 39244 - DNA, 20 bp, human
gagccgcggcccccggacaa

SEQ ID NO: 39245 - DNA, 20 bp, human
gttggtcccgaaattcatgg

SEQ ID NO: 39246 - DNA, 20 bp, human
gtctgcttccgcgaccccgg

SEQ ID NO: 39247 - DNA, 20 bp, human
gcgaccccggcggtgcaggg

SEQ ID NO: 39248 - DNA, 20 bp, human
gcacccgccctgcaccgccg

SEQ ID NO: 39249 - DNA, 20 bp, human
gcgggctcaccgggctccgg

SEQ ID NO: 39250 - DNA, 20 bp, human
gatagtttcaagcccatggg

SEQ ID NO: 39251 - DNA, 20 bp, human
ggaggcttgggataaggact

SEQ ID NO: 39252 - DNA, 20 bp, human
gccgcgaccccggcggtgca

SEQ ID NO: 39253 - DNA, 20 bp, human
gtggcttctctgccacccat

SEQ ID NO: 39254 - DNA, 20 bp, human
gatacaacgtgttaaagaca

SEQ ID NO: 39255 - DNA, 20 bp, human
gtgtactacgatgagatgaa

SEQ ID NO: 39256 - DNA, 20 bp, human
gggacaccgggtgtagaggg

SEQ ID NO: 39257 - DNA, 20 bp, human
ggcgggacaccgggtgtaga

SEQ ID NO: 39258 - DNA, 20 bp, human
gcagtggcggcaggtgagac

SEQ ID NO: 39259 - DNA, 20 bp, human
gcgggtgtagagggcggtcg

SEQ ID NO: 39260 - DNA, 20 bp, human
gtgtagagggcggtcgcggc

SEQ ID NO: 39261 - DNA, 20 bp, human
gacacccggtgtcccgcgac

SEQ ID NO: 39262 - DNA, 20 bp, human
gagccccgcaaaacccggga

SEQ ID NO: 39263 - DNA, 20 bp, human
gccgggagccccgcaaaacc

SEQ ID NO: 39264 - DNA, 20 bp, human
gccgcgccgcggagcaccac

SEQ ID NO: 39265 - DNA, 20 bp, human
gcttccggtcgcgggacacc

SEQ ID NO: 39266 - DNA, 20 bp, human
gaaggggagtcccacatcta

SEQ ID NO: 39267 - DNA, 20 bp, human
gggagggagacacacatctg

SEQ ID NO: 39268 - DNA, 20 bp, human
gggcagtgggagcgcgacct

SEQ ID NO: 39269 - DNA, 20 bp, human
gacttaactgggtcagaggg

SEQ ID NO: 39270 - DNA, 20 bp, human
ggcccgcgaggtgagtgagt

SEQ ID NO: 39271 - DNA, 20 bp, human
gttgctcgctgggcagaccc

SEQ ID NO: 39272 - DNA, 20 bp, human
gcccaactcactcacctcgc

SEQ ID NO: 39273 - DNA, 20 bp, human
gagaggatggggacttaact

SEQ ID NO: 39274 - DNA, 20 bp, human
gacctcgcgggctcggcagt

SEQ ID NO: 39275 - DNA, 20 bp, human
gtcccactgccgagcccgcg

SEQ ID NO: 39276 - DNA, 20 bp, human
ggcaacccgcgagcttacac

SEQ ID NO: 39277 - DNA, 20 bp, human
ggttgctccggagcgggcgg

SEQ ID NO: 39278 - DNA, 20 bp, human
gggtcaccgcaaggacacga

SEQ ID NO: 39279 - DNA, 20 bp, human
ggaagccggtgtaagctcgc

SEQ ID NO: 39280 - DNA, 20 bp, human
gtcatggcccgggaaccgaa

SEQ ID NO: 39281 - DNA, 20 bp, human
gagagcggcgcccagcatga

SEQ ID NO: 39282 - DNA, 20 bp, human
ggggttcagtaaccagggta

SEQ ID NO: 39283 - DNA, 20 bp, human
gacatctgacctgtccgcgg

SEQ ID NO: 39284 - DNA, 20 bp, human
gctgctgtgggcgccgagga

SEQ ID NO: 39285 - DNA, 20 bp, human
gctcgcgggttgctccggag

SEQ ID NO: 39286 - DNA, 20 bp, human
gctgctagtcgcggacgcaa

SEQ ID NO: 39287 - DNA, 20 bp, human
gggacccctccccatcccgg

SEQ ID NO: 39288 - DNA, 20 bp, human
gaacccactctgcttgaggt

SEQ ID NO: 39289 - DNA, 20 bp, human
gaggtgggcgcaggtttgaa

SEQ ID NO: 39290 - DNA, 20 bp, human
gtccttactaggctggttag

SEQ ID NO: 39291 - DNA, 20 bp, human
gcagcttctcgaggtcccag

SEQ ID NO: 39292 - DNA, 20 bp, human
gcgcggacgcaatggcttca

SEQ ID NO: 39293 - DNA, 20 bp, human
gagacaggagggacttccgg

SEQ ID NO: 39294 - DNA, 20 bp, human
ggccactaaccagcctagta

SEQ ID NO: 39295 - DNA, 20 bp, human
gcgcccacctcaagcagagt

SEQ ID NO: 39296 - DNA, 20 bp, human
gcccagcagccgagaaaccg

SEQ ID NO: 39297 - DNA, 20 bp, human
gcatctccgcatcaggacca

SEQ ID NO: 39298 - DNA, 20 bp, human
gcgcttgaagagatgtacaa

SEQ ID NO: 39299 - DNA, 20 bp, human
ggaatgaagaacttgcacta

SEQ ID NO: 39300 - DNA, 20 bp, human
ggcggtagttggtgtgtcct

SEQ ID NO: 39301 - DNA, 20 bp, human
gacttccgcttccggcgctg

SEQ ID NO: 39302 - DNA, 20 bp, human
gcactcgggcgagacaggga

SEQ ID NO: 39303 - DNA, 20 bp, human
gacacataacgaaaagagaa

SEQ ID NO: 39304 - DNA, 20 bp, human
ggccccactcgggcgagaca

SEQ ID NO: 39305 - DNA, 20 bp, human
ggatgtacaagggcgtacct

SEQ ID NO: 39306 - DNA, 20 bp, human
gtggccaagccccgggtcag

SEQ ID NO: 39307 - DNA, 20 bp, human
gctcagaggcaaagccatga

SEQ ID NO: 39308 - DNA, 20 bp, human
ggtggttgccgtccccccag

SEQ ID NO: 39309 - DNA, 20 bp, human
gtggccagcgctgccaaagg

SEQ ID NO: 39310 - DNA, 20 bp, human
gggcgggcctgtgaacaggt

SEQ ID NO: 39311 - DNA, 20 bp, human
gggcaaagccatgatggtgc

SEQ ID NO: 39312 - DNA, 20 bp, human
gtgccgtccccccaggggta

SEQ ID NO: 39313 - DNA, 20 bp, human
gggcgcggactccggactca

SEQ ID NO: 39314 - DNA, 20 bp, human
gtgattggcccagagagggg

SEQ ID NO: 39315 - DNA, 20 bp, human
gcgaggacagcgctggttcc

SEQ ID NO: 39316 - DNA, 20 bp, human
gtaccggcgagatctctacc

SEQ ID NO: 39317 - DNA, 20 bp, human
gactacgggagtcttgcgag

SEQ ID NO: 39318 - DNA, 20 bp, human
gaccagccggaagctgagag

SEQ ID NO: 39319 - DNA, 20 bp, human
gaccacagtcggacaggaag

SEQ ID NO: 39320 - DNA, 20 bp, human
gaaagacaccacagtcggac

SEQ ID NO: 39321 - DNA, 20 bp, human
ggagctgcaggttgaatccg

SEQ ID NO: 39322 - DNA, 20 bp, human
gtccgcttcctgtccgactg

SEQ ID NO: 39323 - DNA, 20 bp, human
gccctggaggacaaactcct

SEQ ID NO: 39324 - DNA, 20 bp, human
ggccggaagctgagagaggt

SEQ ID NO: 39325 - DNA, 20 bp, human
gaccctccacactcacctaa

SEQ ID NO: 39326 - DNA, 20 bp, human
gccgcggactcagaagcgag

SEQ ID NO: 39327 - DNA, 20 bp, human
ggccctcaccagcctgacgt

SEQ ID NO: 39328 - DNA, 20 bp, human
gtccagtggccgccaacgtc

SEQ ID NO: 39329 - DNA, 20 bp, human
gctgctgtgggatggtcccg

SEQ ID NO: 39330 - DNA, 20 bp, human
gtctccgcgggacttagggt

SEQ ID NO: 39331 - DNA, 20 bp, human
gagtcccgcggagaccgtta

SEQ ID NO: 39332 - DNA, 20 bp, human
gcggccactggatctgctgt

SEQ ID NO: 39333 - DNA, 20 bp, human
gcagaagcgagcggcacccc

SEQ ID NO: 39334 - DNA, 20 bp, human
gcaggctggtgagggcacga

SEQ ID NO: 39335 - DNA, 20 bp, human
gctcaccagcctgacgttgg

SEQ ID NO: 39336 - DNA, 20 bp, human
gttgtgacaacccgcagtgt

SEQ ID NO: 39337 - DNA, 20 bp, human
ggcggaccacggaccggggt

SEQ ID NO: 39338 - DNA, 20 bp, human
gcggcgggcggaccacggac

SEQ ID NO: 39339 - DNA, 20 bp, human
gtctcacgggagaaacaccg

SEQ ID NO: 39340 - DNA, 20 bp, human
ggtagggatgcaaaagggac

SEQ ID NO: 39341 - DNA, 20 bp, human
gcctgcgcgcggctacagca

SEQ ID NO: 39342 - DNA, 20 bp, human
gcaacccgcagtgtcggggt

SEQ ID NO: 39343 - DNA, 20 bp, human
ggaggcgcaagggttagtgt

SEQ ID NO: 39344 - DNA, 20 bp, human
ggtttctcccgtgagaaaag

SEQ ID NO: 39345 - DNA, 20 bp, human
gtcggggtagggatgcaaaa

SEQ ID NO: 39346 - DNA, 20 bp, human
gactccggcggaagaggaca

SEQ ID NO: 39347 - DNA, 20 bp, human
gcggagaagggaggtgactc

SEQ ID NO: 39348 - DNA, 20 bp, human
ggtccttgggcggagaaggg

SEQ ID NO: 39349 - DNA, 20 bp, human
ggactacgcgtgtccttggg

SEQ ID NO: 39350 - DNA, 20 bp, human
gtggggttcctggacagagg

SEQ ID NO: 39351 - DNA, 20 bp, human
ggcctggggttcctggacag

SEQ ID NO: 39352 - DNA, 20 bp, human
gcgtgtccttgggcggagaa

SEQ ID NO: 39353 - DNA, 20 bp, human
gaaccaggtcccgggaacgt

SEQ ID NO: 39354 - DNA, 20 bp, human
gcttcgggtgaggcccccat

SEQ ID NO: 39355 - DNA, 20 bp, human
ggaggactacgcgtgtcctt

SEQ ID NO: 39356 - DNA, 20 bp, human
gcggctctatccgctctagc

SEQ ID NO: 39357 - DNA, 20 bp, human
gtaaaaccaagacccaggtg

SEQ ID NO: 39358 - DNA, 20 bp, human
gtgtcagacactccccacct

SEQ ID NO: 39359 - DNA, 20 bp, human
gtggtggtgttcagttgtgg

SEQ ID NO: 39360 - DNA, 20 bp, human
ggcgagaggaatagacggaa

SEQ ID NO: 39361 - DNA, 20 bp, human
ggaagtgaccagagactcgt

SEQ ID NO: 39362 - DNA, 20 bp, human
ggtggggagtgtctgacacc

SEQ ID NO: 39363 - DNA, 20 bp, human
gcgttggtggtgttcagttg

SEQ ID NO: 39364 - DNA, 20 bp, human
gtgaccgacagggttagagg

SEQ ID NO: 39365 - DNA, 20 bp, human
gctgagtaaaaccaagaccc

SEQ ID NO: 39366 - DNA, 20 bp, human
ggtacatgacgcccagagtc

SEQ ID NO: 39367 - DNA, 20 bp, human
gtggcagatgacaaacgaca

SEQ ID NO: 39368 - DNA, 20 bp, human
gccagtgtgacccgagtcag

SEQ ID NO: 39369 - DNA, 20 bp, human
gttctctggggcggtcgcgt

SEQ ID NO: 39370 - DNA, 20 bp, human
ggaaggccggacctctgact

SEQ ID NO: 39371 - DNA, 20 bp, human
gcagcgtacggtggtcactg

SEQ ID NO: 39372 - DNA, 20 bp, human
gcagatgacaaacgacaagg

SEQ ID NO: 39373 - DNA, 20 bp, human
gcagaagttggcaggagcat

SEQ ID NO: 39374 - DNA, 20 bp, human
gtatagcccgcaggtacgag

SEQ ID NO: 39375 - DNA, 20 bp, human
gctaatctcgagctcaagtg

SEQ ID NO: 39376 - DNA, 20 bp, human
gaagggtacctgaagcgaat

SEQ ID NO: 39377 - DNA, 20 bp, human
gcaatgacttgggacgagat

SEQ ID NO: 39378 - DNA, 20 bp, human
gaaatgtaggacatcactta

SEQ ID NO: 39379 - DNA, 20 bp, human
ggcgcactaaatcgtctcca

SEQ ID NO: 39380 - DNA, 20 bp, human
gggacatcacttaaggaacg

SEQ ID NO: 39381 - DNA, 20 bp, human
gtttcagggaaggacattct

SEQ ID NO: 39382 - DNA, 20 bp, human
gatccccaaagctaaaatgt

SEQ ID NO: 39383 - DNA, 20 bp, human
gtaaaaggaaagcacacgag

SEQ ID NO: 39384 - DNA, 20 bp, human
gtatttttctatacagggtt

SEQ ID NO: 39385 - DNA, 20 bp, human
gggacatcatcccaatgact

SEQ ID NO: 39386 - DNA, 20 bp, human
gtccaggctgtaaaacggaa

SEQ ID NO: 39387 - DNA, 20 bp, human
gcaaggacgtcacaggtaac

SEQ ID NO: 39388 - DNA, 20 bp, human
gaacttaccaaggacgtcac

SEQ ID NO: 39389 - DNA, 20 bp, human
gacccctccaggctgtaaaa

SEQ ID NO: 39390 - DNA, 20 bp, human
ggcaaaaaaagacggcgcag

SEQ ID NO: 39391 - DNA, 20 bp, human
ggctgtaaaacggaaaggtt

SEQ ID NO: 39392 - DNA, 20 bp, human
ggaatgagacaaacttacca

SEQ ID NO: 39393 - DNA, 20 bp, human
gtggaggggtcgggtaaaac

SEQ ID NO: 39394 - DNA, 20 bp, human
gagctgacagttataagaca

SEQ ID NO: 39395 - DNA, 20 bp, human
gcattgctctaacagttatc

SEQ ID NO: 39396 - DNA, 20 bp, human
gatgaggacagatgaaatgg

SEQ ID NO: 39397 - DNA, 20 bp, human
gctgggaaggttagtgtgta

SEQ ID NO: 39398 - DNA, 20 bp, human
ggcctcccggagccatctca

SEQ ID NO: 39399 - DNA, 20 bp, human
ggcgtagccgctaaaggaat

SEQ ID NO: 39400 - DNA, 20 bp, human
ggcgaaaggcgcagagaatg

SEQ ID NO: 39401 - DNA, 20 bp, human
ggtcgtgaaaaaaaaggtct

SEQ ID NO: 39402 - DNA, 20 bp, human
ggccctgagatggctccggg

SEQ ID NO: 39403 - DNA, 20 bp, human
gaacaaggtcgtgaaaaaaa

SEQ ID NO: 39404 - DNA, 20 bp, human
gcctagcgcgtagccgctaa

SEQ ID NO: 39405 - DNA, 20 bp, human
gctcccacgccacagcccgg

SEQ ID NO: 39406 - DNA, 20 bp, human
gtcagccgtagcccaaggtc

SEQ ID NO: 39407 - DNA, 20 bp, human
gggcgtcaggacggacatga

SEQ ID NO: 39408 - DNA, 20 bp, human
ggaccagacccgagatcctg

SEQ ID NO: 39409 - DNA, 20 bp, human
gcggagtacaccacaaaaaa

SEQ ID NO: 39410 - DNA, 20 bp, human
gtaaagaagtcggcaggagg

SEQ ID NO: 39411 - DNA, 20 bp, human
ggcttcctgaccttgggcta

SEQ ID NO: 39412 - DNA, 20 bp, human
gctatgggcggagcacaaaa

SEQ ID NO: 39413 - DNA, 20 bp, human
gagtgcccgggcgacagtcg

SEQ ID NO: 39414 - DNA, 20 bp, human
gagccccaggatctcgggtc

SEQ ID NO: 39415 - DNA, 20 bp, human
gagagcgcgggaggcgccgt

SEQ ID NO: 39416 - DNA, 20 bp, human
ggacagcgcccacgcaggag

SEQ ID NO: 39417 - DNA, 20 bp, human
gaactcaccgcggcagacag

SEQ ID NO: 39418 - DNA, 20 bp, human
ggaggcccagccatcatggt

SEQ ID NO: 39419 - DNA, 20 bp, human
gcggaaagcccgggaccctg

SEQ ID NO: 39420 - DNA, 20 bp, human
gcggtaaagggtaacaacga

SEQ ID NO: 39421 - DNA, 20 bp, human
gccgcccctgtgcccgacga

SEQ ID NO: 39422 - DNA, 20 bp, human
gaggagaggcatatcgcgtc

SEQ ID NO: 39423 - DNA, 20 bp, human
gcggcgtgcaggcctcgcgt

SEQ ID NO: 39424 - DNA, 20 bp, human
ggcaagctccagtgctcgtg

SEQ ID NO: 39425 - DNA, 20 bp, human
gcggtgaggatgccgtcgtc

SEQ ID NO: 39426 - DNA, 20 bp, human
gatgcagttacgaccatggg

SEQ ID NO: 39427 - DNA, 20 bp, human
ggagatgcagttacgaccat

SEQ ID NO: 39428 - DNA, 20 bp, human
gtcttctcaggctccaagaa

SEQ ID NO: 39429 - DNA, 20 bp, human
gttatgtagtaccccagcct

SEQ ID NO: 39430 - DNA, 20 bp, human
gcgtaactgcatctccgatt

SEQ ID NO: 39431 - DNA, 20 bp, human
gcacatcttactacctccca

SEQ ID NO: 39432 - DNA, 20 bp, human
gggattatgcctctgaccat

SEQ ID NO: 39433 - DNA, 20 bp, human
gaaaaagacagattcctaat

SEQ ID NO: 39434 - DNA, 20 bp, human
gttctttcctgttgttcctg

SEQ ID NO: 39435 - DNA, 20 bp, human
gtgtgtcaatcaagcaaata

SEQ ID NO: 39436 - DNA, 20 bp, human
gtcccggcagcagcatgcgg

SEQ ID NO: 39437 - DNA, 20 bp, human
gcagataagcaaccagggtt

SEQ ID NO: 39438 - DNA, 20 bp, human
ggccaaagacagcccccaac

SEQ ID NO: 39439 - DNA, 20 bp, human
gcaagggtctcaacaaggag

SEQ ID NO: 39440 - DNA, 20 bp, human
ggctggcagataagcaacca

SEQ ID NO: 39441 - DNA, 20 bp, human
gagcaccaagggtctcaaca

SEQ ID NO: 39442 - DNA, 20 bp, human
gtggtgttgagtgtcctgtt

SEQ ID NO: 39443 - DNA, 20 bp, human
gacccccgcatgctgctgcc

SEQ ID NO: 39444 - DNA, 20 bp, human
gggtcagactgaggtcgaga

SEQ ID NO: 39445 - DNA, 20 bp, human
gttggcaaggaggactttgt

SEQ ID NO: 39446 - DNA, 20 bp, human
gcagtagatatgcccaaaaa

SEQ ID NO: 39447 - DNA, 20 bp, human
gtttgttccaggcaactcag

SEQ ID NO: 39448 - DNA, 20 bp, human
gtagggcacaagggctaacg

SEQ ID NO: 39449 - DNA, 20 bp, human
gggatcaacctcatggccat

SEQ ID NO: 39450 - DNA, 20 bp, human
gatcgggggttagggcacaa

SEQ ID NO: 39451 - DNA, 20 bp, human
gaaaaacaggatcaacctca

SEQ ID NO: 39452 - DNA, 20 bp, human
ggtaaggacagagagaaata

SEQ ID NO: 39453 - DNA, 20 bp, human
gctccagtgatcagactgta

SEQ ID NO: 39454 - DNA, 20 bp, human
ggtagggatgatagacatca

SEQ ID NO: 39455 - DNA, 20 bp, human
ggcacaagggctaacgtgga

SEQ ID NO: 39456 - DNA, 20 bp, human
gtggtagcaatcaaacccac

SEQ ID NO: 39457 - DNA, 20 bp, human
gaaactgccagagggtctca

SEQ ID NO: 39458 - DNA, 20 bp, human
gacaggagcaattgcaagag

SEQ ID NO: 39459 - DNA, 20 bp, human
gtgccagagggtctcaaggc

SEQ ID NO: 39460 - DNA, 20 bp, human
gttgggaggaaaaacagaag

SEQ ID NO: 39461 - DNA, 20 bp, human
gtgcctgccttgagaccctc

SEQ ID NO: 39462 - DNA, 20 bp, human
gatgaggctcatcctgcctg

SEQ ID NO: 39463 - DNA, 20 bp, human
gaccagaacaggtgaagtat

SEQ ID NO: 39464 - DNA, 20 bp, human
ggacttggccaaaaccaatg

SEQ ID NO: 39465 - DNA, 20 bp, human
gtttacctgtcaaagcggac

SEQ ID NO: 39466 - DNA, 20 bp, human
gcagatgctggacccaataa

SEQ ID NO: 39467 - DNA, 20 bp, human
gcggggagtcagtcatacag

SEQ ID NO: 39468 - DNA, 20 bp, human
gactccccggggacatgagg

SEQ ID NO: 39469 - DNA, 20 bp, human
gtgaggtggatactgttcat

SEQ ID NO: 39470 - DNA, 20 bp, human
ggttcattggggcccttatt

SEQ ID NO: 39471 - DNA, 20 bp, human
gtatccacctcatgtccccg

SEQ ID NO: 39472 - DNA, 20 bp, human
gcttgtccaggatgacacag

SEQ ID NO: 39473 - DNA, 20 bp, human
ggaccttataagtaagaact

SEQ ID NO: 39474 - DNA, 20 bp, human
gtcttagtaattaataaggt

SEQ ID NO: 39475 - DNA, 20 bp, human
gcatgcataaagggaaaccc

SEQ ID NO: 39476 - DNA, 20 bp, human
gggaggggacaaacaaccag

SEQ ID NO: 39477 - DNA, 20 bp, human
gagatcaccgaagagggcta

SEQ ID NO: 39478 - DNA, 20 bp, human
gtcaccgaagagggctaggg

SEQ ID NO: 39479 - DNA, 20 bp, human
gtagggtggagatgacacgc

SEQ ID NO: 39480 - DNA, 20 bp, human
gtggagatgacacgcaggca

SEQ ID NO: 39481 - DNA, 20 bp, human
gcagatcagatcaccgaaga

SEQ ID NO: 39482 - DNA, 20 bp, human
gctcagagcactggtagacc

SEQ ID NO: 39483 - DNA, 20 bp, human
gctgaaaaagccaccaagga

SEQ ID NO: 39484 - DNA, 20 bp, human
gtctccaccctagccctctt

SEQ ID NO: 39485 - DNA, 20 bp, human
gccgattatggaggaagacg

SEQ ID NO: 39486 - DNA, 20 bp, human
gcacccttaagccaagtaca

SEQ ID NO: 39487 - DNA, 20 bp, human
ggggatagttgtctcatcat

SEQ ID NO: 39488 - DNA, 20 bp, human
gatccctgtacttggcttaa

SEQ ID NO: 39489 - DNA, 20 bp, human
gagacaactatccctgtact

SEQ ID NO: 39490 - DNA, 20 bp, human
gactacgaaataatggagta

SEQ ID NO: 39491 - DNA, 20 bp, human
gccaggatactagaagagtc

SEQ ID NO: 39492 - DNA, 20 bp, human
gctgaagctgaatgttactt

SEQ ID NO: 39493 - DNA, 20 bp, human
ggaacaagaagacgccccat

SEQ ID NO: 39494 - DNA, 20 bp, human
gcattcagcttcagtagcaa

SEQ ID NO: 39495 - DNA, 20 bp, human
gctggctatgtgtgcaaaga

SEQ ID NO: 39496 - DNA, 20 bp, human
gttcccagaaccgcttatgg

SEQ ID NO: 39497 - DNA, 20 bp, human
ggacctggaatcttctgcat

SEQ ID NO: 39498 - DNA, 20 bp, human
gcatcggcgtggatctcaac

SEQ ID NO: 39499 - DNA, 20 bp, human
gttaggagcaccataaactc

SEQ ID NO: 39500 - DNA, 20 bp, human
gtatgcatgagtcacggcca

SEQ ID NO: 39501 - DNA, 20 bp, human
gagaacaagtccatcagacc

SEQ ID NO: 39502 - DNA, 20 bp, human
gatgacagagaaagacttaa

SEQ ID NO: 39503 - DNA, 20 bp, human
gtcagactggctgtgggtac

SEQ ID NO: 39504 - DNA, 20 bp, human
gcgccgatgcagaagattcc

SEQ ID NO: 39505 - DNA, 20 bp, human
gctcaacaggaactggaagt

SEQ ID NO: 39506 - DNA, 20 bp, human
gggaagttgctattacgact

SEQ ID NO: 39507 - DNA, 20 bp, human
gggaggcccagccctttcta

SEQ ID NO: 39508 - DNA, 20 bp, human
gagccacctccagcctcggg

SEQ ID NO: 39509 - DNA, 20 bp, human
ggggagcctgattaaagatc

SEQ ID NO: 39510 - DNA, 20 bp, human
ggctattacgacttggtctt

SEQ ID NO: 39511 - DNA, 20 bp, human
ggaacctgtgcggtgtgtag

SEQ ID NO: 39512 - DNA, 20 bp, human
gccttcccggagaacctgtg

SEQ ID NO: 39513 - DNA, 20 bp, human
gcctccctcgtgctgactca

SEQ ID NO: 39514 - DNA, 20 bp, human
gttacttaagcagccacccg

SEQ ID NO: 39515 - DNA, 20 bp, human
gagcatagcggttgttataa

SEQ ID NO: 39516 - DNA, 20 bp, human
gggtccggtgagtaagtgag

SEQ ID NO: 39517 - DNA, 20 bp, human
gaggccccgtgagtatcctc

SEQ ID NO: 39518 - DNA, 20 bp, human
gtatcctccggcgacagagg

SEQ ID NO: 39519 - DNA, 20 bp, human
gctccggcgacagaggaggt

SEQ ID NO: 39520 - DNA, 20 bp, human
gtgtcgccggaggatactca

SEQ ID NO: 39521 - DNA, 20 bp, human
gggcgggttcggaaggaatc

SEQ ID NO: 39522 - DNA, 20 bp, human
gtaagtgaggggacgatccc

SEQ ID NO: 39523 - DNA, 20 bp, human
gaatcgggcagggcccgggt

SEQ ID NO: 39524 - DNA, 20 bp, human
ggaggggacgatccccggaa

SEQ ID NO: 39525 - DNA, 20 bp, human
gcgggtcggggtccggagat

SEQ ID NO: 39526 - DNA, 20 bp, human
gacctggtcagacacaatgt

SEQ ID NO: 39527 - DNA, 20 bp, human
ggtgtctgaccaggtctagt

SEQ ID NO: 39528 - DNA, 20 bp, human
gccctggcatctgctcatca

SEQ ID NO: 39529 - DNA, 20 bp, human
ggcttatggcaatctaattt

SEQ ID NO: 39530 - DNA, 20 bp, human
ggcagaaaaagaagacatta

SEQ ID NO: 39531 - DNA, 20 bp, human
ggagacctacccactagacc

SEQ ID NO: 39532 - DNA, 20 bp, human
gggtcgtgctggccaactcg

SEQ ID NO: 39533 - DNA, 20 bp, human
gtggtggtgagcactttgaa

SEQ ID NO: 39534 - DNA, 20 bp, human
gctgtagtattataaatcca

SEQ ID NO: 39535 - DNA, 20 bp, human
ggacacaatgttggcactct

SEQ ID NO: 39536 - DNA, 20 bp, human
ggctcacagaagagaacaat

SEQ ID NO: 39537 - DNA, 20 bp, human
gaatgggtacaaggactgca

SEQ ID NO: 39538 - DNA, 20 bp, human
gccccttgtacatggaacat

SEQ ID NO: 39539 - DNA, 20 bp, human
ggaagagaacaatgggtaca

SEQ ID NO: 39540 - DNA, 20 bp, human
gcttgtacatggaacatagg

SEQ ID NO: 39541 - DNA, 20 bp, human
gtgtacagaaaattgctgtt

SEQ ID NO: 39542 - DNA, 20 bp, human
ggacatgaggcaaacaagtg

SEQ ID NO: 39543 - DNA, 20 bp, human
ggcatgtcttcgcgtttcag

SEQ ID NO: 39544 - DNA, 20 bp, human
gactgagctggtggacaaaa

SEQ ID NO: 39545 - DNA, 20 bp, human
gtacgcatatccagtgacta

SEQ ID NO: 39546 - DNA, 20 bp, human
gtagcggcgctgctggaaga

SEQ ID NO: 39547 - DNA, 20 bp, human
gggacgagcggccgccttgg

SEQ ID NO: 39548 - DNA, 20 bp, human
gccagcagcgccgctaaccc

SEQ ID NO: 39549 - DNA, 20 bp, human
gggagcggagccggggttag

SEQ ID NO: 39550 - DNA, 20 bp, human
ggccgccctagccgccaagg

SEQ ID NO: 39551 - DNA, 20 bp, human
gtgaggcgaagcacccacag

SEQ ID NO: 39552 - DNA, 20 bp, human
gggccaagtagatcaacacc

SEQ ID NO: 39553 - DNA, 20 bp, human
gagctggtgggcaacatgca

SEQ ID NO: 39554 - DNA, 20 bp, human
gtggggtcgctaatccctga

SEQ ID NO: 39555 - DNA, 20 bp, human
gtgcccaccagcttcacctg

SEQ ID NO: 39556 - DNA, 20 bp, human
ggggaaggtgaggcgagtag

SEQ ID NO: 39557 - DNA, 20 bp, human
gaggtgaggcgagtagaggc

SEQ ID NO: 39558 - DNA, 20 bp, human
gacactcattcagccgggga

SEQ ID NO: 39559 - DNA, 20 bp, human
gcccctccgggatgccccca

SEQ ID NO: 39560 - DNA, 20 bp, human
ggccatcagcaggatttaca

SEQ ID NO: 39561 - DNA, 20 bp, human
gcggtggggcgcagcttcga

SEQ ID NO: 39562 - DNA, 20 bp, human
gcagcaggatttacacggtg

SEQ ID NO: 39563 - DNA, 20 bp, human
gtcgagctgtccgacaaccc

SEQ ID NO: 39564 - DNA, 20 bp, human
gtcatggacgccagggttgt

SEQ ID NO: 39565 - DNA, 20 bp, human
gtactggccgcggagcccag

SEQ ID NO: 39566 - DNA, 20 bp, human
gaagtcagcctccagatcaa

SEQ ID NO: 39567 - DNA, 20 bp, human
gcaacatcgtcttccatgtc

SEQ ID NO: 39568 - DNA, 20 bp, human
gccaagagttaacataccag

SEQ ID NO: 39569 - DNA, 20 bp, human
gttatgaccccttgatctgg

SEQ ID NO: 39570 - DNA, 20 bp, human
ggagaaccccaatagagaga

SEQ ID NO: 39571 - DNA, 20 bp, human
gattagatgatctggcaaaa

SEQ ID NO: 39572 - DNA, 20 bp, human
gtttaccacagagccaatac

SEQ ID NO: 39573 - DNA, 20 bp, human
gctttcatgatttcctgtat

SEQ ID NO: 39574 - DNA, 20 bp, human
gtccaaaccagtgccagaca

SEQ ID NO: 39575 - DNA, 20 bp, human
gtccatgtctggcactggtt

SEQ ID NO: 39576 - DNA, 20 bp, human
gcgggcgtggggcctcgtgg

SEQ ID NO: 39577 - DNA, 20 bp, human
gaaggccctgagtcacgagg

SEQ ID NO: 39578 - DNA, 20 bp, human
ggctccgaggagcggctcgt

SEQ ID NO: 39579 - DNA, 20 bp, human
ggagagacgcgcacgcacgt

SEQ ID NO: 39580 - DNA, 20 bp, human
gtgctccgcatccggccggg

SEQ ID NO: 39581 - DNA, 20 bp, human
gaggcgccgcagccctgcgg

SEQ ID NO: 39582 - DNA, 20 bp, human
gtgcggctcggaggccccac

SEQ ID NO: 39583 - DNA, 20 bp, human
gaccggacataaaggagcac

SEQ ID NO: 39584 - DNA, 20 bp, human
gcccaccggccgcccccgca

SEQ ID NO: 39585 - DNA, 20 bp, human
gggcgggtggctcttaccag

SEQ ID NO: 39586 - DNA, 20 bp, human
gtaagcggccagggcggcta

SEQ ID NO: 39587 - DNA, 20 bp, human
ggcggctacggcgactgcga

SEQ ID NO: 39588 - DNA, 20 bp, human
gtcggccccaccacccctcg

SEQ ID NO: 39589 - DNA, 20 bp, human
gggacaccgtgactgagcca

SEQ ID NO: 39590 - DNA, 20 bp, human
gccttctccgtccccctcgg

SEQ ID NO: 39591 - DNA, 20 bp, human
gggttcttaagcggccaggg

SEQ ID NO: 39592 - DNA, 20 bp, human
ggaggcggcctctaagaagc

SEQ ID NO: 39593 - DNA, 20 bp, human
gacgcctcgccgcagaacag

SEQ ID NO: 39594 - DNA, 20 bp, human
gctgctgatgcgccaggaac

SEQ ID NO: 39595 - DNA, 20 bp, human
gagccagggggcaccgactt

SEQ ID NO: 39596 - DNA, 20 bp, human
gcgcggtctgcaccgaccag

SEQ ID NO: 39597 - DNA, 20 bp, human
gggcttcggcaccccctggt

SEQ ID NO: 39598 - DNA, 20 bp, human
gcgacacgggcgagaagcta

SEQ ID NO: 39599 - DNA, 20 bp, human
gcacagcggtagccgagaag

SEQ ID NO: 39600 - DNA, 20 bp, human
ggcagcagccgcagagccgg

SEQ ID NO: 39601 - DNA, 20 bp, human
gcgggcgacctccggctctg

SEQ ID NO: 39602 - DNA, 20 bp, human
gctataaccaccaccaggta

SEQ ID NO: 39603 - DNA, 20 bp, human
ggcccggcttcggcaccccc

SEQ ID NO: 39604 - DNA, 20 bp, human
gcgccgcccgccgtacctgg

SEQ ID NO: 39605 - DNA, 20 bp, human
gtgcagccgtgcggcgacac

SEQ ID NO: 39606 - DNA, 20 bp, human
ggagggcgccggccagacgg

SEQ ID NO: 39607 - DNA, 20 bp, human
gctggaggaaggaaacggga

SEQ ID NO: 39608 - DNA, 20 bp, human
gaccaaccgacccctcgcgg

SEQ ID NO: 39609 - DNA, 20 bp, human
gtcccacctgagggcaagag

SEQ ID NO: 39610 - DNA, 20 bp, human
gttcggaccgtctccactag

SEQ ID NO: 39611 - DNA, 20 bp, human
gcacctgagggcaagagcgg

SEQ ID NO: 39612 - DNA, 20 bp, human
gggccagacggcggcaggcg

SEQ ID NO: 39613 - DNA, 20 bp, human
gctggctcggtcccacctga

SEQ ID NO: 39614 - DNA, 20 bp, human
gtgggaccgagccaggtgag

SEQ ID NO: 39615 - DNA, 20 bp, human
gaggcgcggaggcgttggtc

SEQ ID NO: 39616 - DNA, 20 bp, human
gtttccctcatgggacccag

SEQ ID NO: 39617 - DNA, 20 bp, human
gccgcccctgggtcccatga

SEQ ID NO: 39618 - DNA, 20 bp, human
gcgacggcccagcaaccgtg

SEQ ID NO: 39619 - DNA, 20 bp, human
gttcactcggctcggtcctg

SEQ ID NO: 39620 - DNA, 20 bp, human
gctgcggagaatcgaactga

SEQ ID NO: 39621 - DNA, 20 bp, human
gctgcgggaccagggtaaag

SEQ ID NO: 39622 - DNA, 20 bp, human
gaaccccggagccgcagaga

SEQ ID NO: 39623 - DNA, 20 bp, human
gcagggtaaagcggcgacgg

SEQ ID NO: 39624 - DNA, 20 bp, human
gtcgaaccggaagtgtctct

SEQ ID NO: 39625 - DNA, 20 bp, human
gagaaaccgcaggaccttcc

SEQ ID NO: 39626 - DNA, 20 bp, human
ggctcccgccgggcgtgcag

SEQ ID NO: 39627 - DNA, 20 bp, human
gtgcaaagctgaggcagagt

SEQ ID NO: 39628 - DNA, 20 bp, human
gaggaactgctaaggcaacc

SEQ ID NO: 39629 - DNA, 20 bp, human
ggaaaattgaggaactgcta

SEQ ID NO: 39630 - DNA, 20 bp, human
ggaattggagtcatacgact

SEQ ID NO: 39631 - DNA, 20 bp, human
gatgaagggaagcatacaaa

SEQ ID NO: 39632 - DNA, 20 bp, human
gctgttgcacagctgaactc

SEQ ID NO: 39633 - DNA, 20 bp, human
ggttgaaagatgtgagaata

SEQ ID NO: 39634 - DNA, 20 bp, human
gtcggcatcgcagccacccg

SEQ ID NO: 39635 - DNA, 20 bp, human
gcgaggtcctctgctcccgc

SEQ ID NO: 39636 - DNA, 20 bp, human
gtgtggcgcccggtgagctg

SEQ ID NO: 39637 - DNA, 20 bp, human
gggcgcccggtgagctgcgg

SEQ ID NO: 39638 - DNA, 20 bp, human
ggagtgacgcgccctcctcg

SEQ ID NO: 39639 - DNA, 20 bp, human
ggcggagcccgggagagaaa

SEQ ID NO: 39640 - DNA, 20 bp, human
gagctgcggcggcggctgaa

SEQ ID NO: 39641 - DNA, 20 bp, human
gctgaagggcaccgcgagga

SEQ ID NO: 39642 - DNA, 20 bp, human
ggggcgcggttaccttcccg

SEQ ID NO: 39643 - DNA, 20 bp, human
gggccgggaaggagaaaccg

SEQ ID NO: 39644 - DNA, 20 bp, human
gggcgccacatggacccagc

SEQ ID NO: 39645 - DNA, 20 bp, human
gctcgagacaggaagaagcg

SEQ ID NO: 39646 - DNA, 20 bp, human
ggctccggcccgactccacg

SEQ ID NO: 39647 - DNA, 20 bp, human
gctggcggaattgcacgcgg

SEQ ID NO: 39648 - DNA, 20 bp, human
gcgggagctggaatagcaga

SEQ ID NO: 39649 - DNA, 20 bp, human
gccacctcgtggagtcgggc

SEQ ID NO: 39650 - DNA, 20 bp, human
gcgcctggcggaattgcacg

SEQ ID NO: 39651 - DNA, 20 bp, human
gccgcccgcggcagaagccg

SEQ ID NO: 39652 - DNA, 20 bp, human
gggaaccacctcgtggagtc

SEQ ID NO: 39653 - DNA, 20 bp, human
ggggccctagccggagactc

SEQ ID NO: 39654 - DNA, 20 bp, human
gcagctagctgcgaactaag

SEQ ID NO: 39655 - DNA, 20 bp, human
ggcgaactaagaggaagcgt

SEQ ID NO: 39656 - DNA, 20 bp, human
gggcggacagctctctccgg

SEQ ID NO: 39657 - DNA, 20 bp, human
ggcgcgttctacgaacctgt

SEQ ID NO: 39658 - DNA, 20 bp, human
gcccaacgctagcaccgcgg

SEQ ID NO: 39659 - DNA, 20 bp, human
gcgttctacgaacctgttgg

SEQ ID NO: 39660 - DNA, 20 bp, human
gaggagctgcagcctccaac

SEQ ID NO: 39661 - DNA, 20 bp, human
gtagcagccgcgcggaacca

SEQ ID NO: 39662 - DNA, 20 bp, human
gtcggcccgggcgccctcgt

SEQ ID NO: 39663 - DNA, 20 bp, human
ggctcctccgcggccgacga

SEQ ID NO: 39664 - DNA, 20 bp, human
gcagccgcgcggaaccaggg

SEQ ID NO: 39665 - DNA, 20 bp, human
ggcgctcgagagcttcctag

SEQ ID NO: 39666 - DNA, 20 bp, human
gaccgtgtctaggaaagtag

SEQ ID NO: 39667 - DNA, 20 bp, human
gctaccacgcgccaggcacc

SEQ ID NO: 39668 - DNA, 20 bp, human
gtccggccaagggggagtgg

SEQ ID NO: 39669 - DNA, 20 bp, human
gctagacacggtaagagacc

SEQ ID NO: 39670 - DNA, 20 bp, human
ggacacggtaagagaccggg

SEQ ID NO: 39671 - DNA, 20 bp, human
ggaccggacgagggaccgac

SEQ ID NO: 39672 - DNA, 20 bp, human
gccccggccggcgaagacca

SEQ ID NO: 39673 - DNA, 20 bp, human
gatgagccgggaggagtacg

SEQ ID NO: 39674 - DNA, 20 bp, human
gagtcggcagccgaagctca

SEQ ID NO: 39675 - DNA, 20 bp, human
gcagtgtagaggacacctcc

SEQ ID NO: 39676 - DNA, 20 bp, human
gaggtaaacggcaaaaggaa

SEQ ID NO: 39677 - DNA, 20 bp, human
gcacaacctcatctattcaa

SEQ ID NO: 39678 - DNA, 20 bp, human
ggtatgcccttgaatagatg

SEQ ID NO: 39679 - DNA, 20 bp, human
gtccttgggttagaggtaaa

SEQ ID NO: 39680 - DNA, 20 bp, human
gagaagaacaacctttcctt

SEQ ID NO: 39681 - DNA, 20 bp, human
ggcaatacatttaagagcaa

SEQ ID NO: 39682 - DNA, 20 bp, human
gtggagaactgaagaaggta

SEQ ID NO: 39683 - DNA, 20 bp, human
gtgatcctgcagcagctcaa

SEQ ID NO: 39684 - DNA, 20 bp, human
ggctcaagggatgactagag

SEQ ID NO: 39685 - DNA, 20 bp, human
gatagtagctgctgatgtta

SEQ ID NO: 39686 - DNA, 20 bp, human
ggcgcacctctacccacccg

SEQ ID NO: 39687 - DNA, 20 bp, human
gaatccagcgcagctaccaa

SEQ ID NO: 39688 - DNA, 20 bp, human
ggcgcgcccgccctctgacc

SEQ ID NO: 39689 - DNA, 20 bp, human
gtgacgctccctgcctccta

SEQ ID NO: 39690 - DNA, 20 bp, human
gcagccctagccagaggcac

SEQ ID NO: 39691 - DNA, 20 bp, human
gtgggtagaggtgcgcgcct

SEQ ID NO: 39692 - DNA, 20 bp, human
gggcatcaccagctacgtct

SEQ ID NO: 39693 - DNA, 20 bp, human
gcaactaccaccgccaggaa

SEQ ID NO: 39694 - DNA, 20 bp, human
gctgaccgggctataacacc

SEQ ID NO: 39695 - DNA, 20 bp, human
gcgctccctgcctcctaagg

SEQ ID NO: 39696 - DNA, 20 bp, human
gtatagctccccagaggcag

SEQ ID NO: 39697 - DNA, 20 bp, human
gacagggctcgtggattcca

SEQ ID NO: 39698 - DNA, 20 bp, human
ggggctcgtggattccaggg

SEQ ID NO: 39699 - DNA, 20 bp, human
gtggtggcgaaaggtcaccg

SEQ ID NO: 39700 - DNA, 20 bp, human
gcagctcttgagggtgtgtg

SEQ ID NO: 39701 - DNA, 20 bp, human
gtggagttcagcgaccaccc

SEQ ID NO: 39702 - DNA, 20 bp, human
ggtggaggaagactgagagc

SEQ ID NO: 39703 - DNA, 20 bp, human
gtcctggattagagaaagaa

SEQ ID NO: 39704 - DNA, 20 bp, human
gccgcacaagatcatcatag

SEQ ID NO: 39705 - DNA, 20 bp, human
ggctaagagggaaatagcac

SEQ ID NO: 39706 - DNA, 20 bp, human
gagcagagaggagtctggtg

SEQ ID NO: 39707 - DNA, 20 bp, human
gccccgggagcctaccgtga

SEQ ID NO: 39708 - DNA, 20 bp, human
gctctgctcctgaggaagac

SEQ ID NO: 39709 - DNA, 20 bp, human
ggcctaccgtgagggccgag

SEQ ID NO: 39710 - DNA, 20 bp, human
gggagcccttcagcgacccc

SEQ ID NO: 39711 - DNA, 20 bp, human
gtcagggacttctcctcccg

SEQ ID NO: 39712 - DNA, 20 bp, human
ggccacccgctcggccctca

SEQ ID NO: 39713 - DNA, 20 bp, human
gcaaggctggtagtgagtag

SEQ ID NO: 39714 - DNA, 20 bp, human
gggctcccggggtcgctgaa

SEQ ID NO: 39715 - DNA, 20 bp, human
gcagggtctgcagggacgtg

SEQ ID NO: 39716 - DNA, 20 bp, human
gtggtggctgcgttgggctc

SEQ ID NO: 39717 - DNA, 20 bp, human
gcaactagcgccccacacaa

SEQ ID NO: 39718 - DNA, 20 bp, human
gtgtgaagcggcgaaggagg

SEQ ID NO: 39719 - DNA, 20 bp, human
gtcccccgtggtctgagagg

SEQ ID NO: 39720 - DNA, 20 bp, human
gtggccgtcggcccgctcag

SEQ ID NO: 39721 - DNA, 20 bp, human
gcccgccccgggccaccaag

SEQ ID NO: 39722 - DNA, 20 bp, human
gcatagcgaggactcccccg

SEQ ID NO: 39723 - DNA, 20 bp, human
gcccagcccgaacggcttcc

SEQ ID NO: 39724 - DNA, 20 bp, human
gaggaggtggtggctgcgtt

SEQ ID NO: 39725 - DNA, 20 bp, human
ggagcctgcgtaccgaagtg

SEQ ID NO: 39726 - DNA, 20 bp, human
gaggaggaccggaccccgag

SEQ ID NO: 39727 - DNA, 20 bp, human
gctccgacccggccacgcgg

SEQ ID NO: 39728 - DNA, 20 bp, human
gcagccccaaggccgaagtt

SEQ ID NO: 39729 - DNA, 20 bp, human
ggctgggctcggacccccga

SEQ ID NO: 39730 - DNA, 20 bp, human
gacgccctccaagcccctcg

SEQ ID NO: 39731 - DNA, 20 bp, human
ggtgcgctcccagccgctcg

SEQ ID NO: 39732 - DNA, 20 bp, human
gggctgggagcgcacgcgag

SEQ ID NO: 39733 - DNA, 20 bp, human
ggaccggaccccgagcggct

SEQ ID NO: 39734 - DNA, 20 bp, human
gcggtgactcagctccgacc

SEQ ID NO: 39735 - DNA, 20 bp, human
ggtggcgcccgcgggacctg

SEQ ID NO: 39736 - DNA, 20 bp, human
gggagaacctagggctggac

SEQ ID NO: 39737 - DNA, 20 bp, human
gcacgtgggagtcttagagg

SEQ ID NO: 39738 - DNA, 20 bp, human
gggtggaagtcgagcgacgg

SEQ ID NO: 39739 - DNA, 20 bp, human
gggagcgacgctgggaccgc

SEQ ID NO: 39740 - DNA, 20 bp, human
ggaccctctccgcccaggga

SEQ ID NO: 39741 - DNA, 20 bp, human
gcctggcgctcgcgcacctg

SEQ ID NO: 39742 - DNA, 20 bp, human
gtcgagcgacggtggagaac

SEQ ID NO: 39743 - DNA, 20 bp, human
ggagacgcccgcactcacgt

SEQ ID NO: 39744 - DNA, 20 bp, human
gagaacaggttggcagcgtc

SEQ ID NO: 39745 - DNA, 20 bp, human
ggggcttgtggcccagagaa

SEQ ID NO: 39746 - DNA, 20 bp, human
gcagcaacccggcaagagac

SEQ ID NO: 39747 - DNA, 20 bp, human
ggtgtgccaatctcgaagag

SEQ ID NO: 39748 - DNA, 20 bp, human
gcacagcgccccaggaacac

SEQ ID NO: 39749 - DNA, 20 bp, human
gtgacctcggaggacgagag

SEQ ID NO: 39750 - DNA, 20 bp, human
ggcgggacagacctcgtccc

SEQ ID NO: 39751 - DNA, 20 bp, human
ggccgggttgctgggtgcat

SEQ ID NO: 39752 - DNA, 20 bp, human
gcttcgagattggcacaccc

SEQ ID NO: 39753 - DNA, 20 bp, human
ggcccccaggatgcaaaatc

SEQ ID NO: 39754 - DNA, 20 bp, human
ggtgcatgggattcgtcaga

SEQ ID NO: 39755 - DNA, 20 bp, human
gcatgggattcgtcagaagg

SEQ ID NO: 39756 - DNA, 20 bp, human
gcaaggagcccagggagcgg

SEQ ID NO: 39757 - DNA, 20 bp, human
gcggcgacggggctgagacg

SEQ ID NO: 39758 - DNA, 20 bp, human
gtgacgccgcgaggaggcta

SEQ ID NO: 39759 - DNA, 20 bp, human
ggaggaggctaggggcccag

SEQ ID NO: 39760 - DNA, 20 bp, human
gcccctctggcgttcccggg

SEQ ID NO: 39761 - DNA, 20 bp, human
gaagagggcggagggagcgg

SEQ ID NO: 39762 - DNA, 20 bp, human
gccgccggcgccaagaccca

SEQ ID NO: 39763 - DNA, 20 bp, human
gctcgggtgacgccgcgagg

SEQ ID NO: 39764 - DNA, 20 bp, human
ggagcgccacctcctcggct

SEQ ID NO: 39765 - DNA, 20 bp, human
ggacgcgcgtctgtgggcag

SEQ ID NO: 39766 - DNA, 20 bp, human
ggctcacctgggctctcggt

SEQ ID NO: 39767 - DNA, 20 bp, human
ggggtccccgagataggcag

SEQ ID NO: 39768 - DNA, 20 bp, human
gcacctgggctctcggtcgg

SEQ ID NO: 39769 - DNA, 20 bp, human
gcgacatggggggacagaca

SEQ ID NO: 39770 - DNA, 20 bp, human
gctggagcagcaagggagtc

SEQ ID NO: 39771 - DNA, 20 bp, human
gaacggacacacgacatggg

SEQ ID NO: 39772 - DNA, 20 bp, human
gatggggggacagacacgga

SEQ ID NO: 39773 - DNA, 20 bp, human
gtggagccggcgccagcggc

SEQ ID NO: 39774 - DNA, 20 bp, human
gccacttctgagggaggtac

SEQ ID NO: 39775 - DNA, 20 bp, human
gtggaaacggacacacgaca

SEQ ID NO: 39776 - DNA, 20 bp, human
gcgcggcgcccgggaaatgg

SEQ ID NO: 39777 - DNA, 20 bp, human
gcgcgcccggcaggcgttca

SEQ ID NO: 39778 - DNA, 20 bp, human
gcagcaggcgcagggccagt

SEQ ID NO: 39779 - DNA, 20 bp, human
gatggtggccggcccaggcg

SEQ ID NO: 39780 - DNA, 20 bp, human
ggcaggcgttcagggaagcg

SEQ ID NO: 39781 - DNA, 20 bp, human
gcccggctgggcgcactgag

SEQ ID NO: 39782 - DNA, 20 bp, human
ggggccagtgggtgcaggta

SEQ ID NO: 39783 - DNA, 20 bp, human
gagcgcggccacgcctgggc

SEQ ID NO: 39784 - DNA, 20 bp, human
gctgcagcaacgccacgctg

SEQ ID NO: 39785 - DNA, 20 bp, human
gcgccgcggcgcccgggaaa

SEQ ID NO: 39786 - DNA, 20 bp, human
gtgggcgccggacaagtcca

SEQ ID NO: 39787 - DNA, 20 bp, human
gagcggctgtccatattggg

SEQ ID NO: 39788 - DNA, 20 bp, human
gcacagctcgggcggactga

SEQ ID NO: 39789 - DNA, 20 bp, human
ggaggcgccttggacttgtc

SEQ ID NO: 39790 - DNA, 20 bp, human
ggcccgcagtgctgttgtag

SEQ ID NO: 39791 - DNA, 20 bp, human
ggagcgctcggggtaccacg

SEQ ID NO: 39792 - DNA, 20 bp, human
gccgcccgagctgtggttgt

SEQ ID NO: 39793 - DNA, 20 bp, human
ggactcagctgtgggaacac

SEQ ID NO: 39794 - DNA, 20 bp, human
gtgtagcggctgtccatatt

SEQ ID NO: 39795 - DNA, 20 bp, human
gctgagggctagctcccgtc

SEQ ID NO: 39796 - DNA, 20 bp, human
gccgccggcggccactgtca

SEQ ID NO: 39797 - DNA, 20 bp, human
gccatgtgccgcggtgtcgg

SEQ ID NO: 39798 - DNA, 20 bp, human
ggccgctcgcgccctgacag

SEQ ID NO: 39799 - DNA, 20 bp, human
ggacagggcgagtagctggt

SEQ ID NO: 39800 - DNA, 20 bp, human
ggccactgtcagggcgcgag

SEQ ID NO: 39801 - DNA, 20 bp, human
gagcggctggagcgcacgca

SEQ ID NO: 39802 - DNA, 20 bp, human
gtgggtcgcagatatccggt

SEQ ID NO: 39803 - DNA, 20 bp, human
ggtaggagctcggccccagg

SEQ ID NO: 39804 - DNA, 20 bp, human
gggcccatgtgccgcggtgt

SEQ ID NO: 39805 - DNA, 20 bp, human
gggggtgggtcgcagatatc

SEQ ID NO: 39806 - DNA, 20 bp, human
gtatatatgagtagcaagga

SEQ ID NO: 39807 - DNA, 20 bp, human
gtggagggctgggatatgat

SEQ ID NO: 39808 - DNA, 20 bp, human
gaaggagaagccagctgcat

SEQ ID NO: 39809 - DNA, 20 bp, human
gcagcatccccaaaagataa

SEQ ID NO: 39810 - DNA, 20 bp, human
gcttgatgcattcattctca

SEQ ID NO: 39811 - DNA, 20 bp, human
ggtgagtgtaaagtgggaag

SEQ ID NO: 39812 - DNA, 20 bp, human
gtgataggtgagtgtaaagt

SEQ ID NO: 39813 - DNA, 20 bp, human
gaattttctaacttactgtg

SEQ ID NO: 39814 - DNA, 20 bp, human
ggtggtatatatgagtagca

SEQ ID NO: 39815 - DNA, 20 bp, human
gtattattctcatctcatgg

SEQ ID NO: 39816 - DNA, 20 bp, human
gcgctgcacatgcccgaagg

SEQ ID NO: 39817 - DNA, 20 bp, human
gtcgccggctcaatactccg

SEQ ID NO: 39818 - DNA, 20 bp, human
ggacccccggagtattgagc

SEQ ID NO: 39819 - DNA, 20 bp, human
gttgagccggcgagctgcac

SEQ ID NO: 39820 - DNA, 20 bp, human
ggaagtggcccgcgtccccg

SEQ ID NO: 39821 - DNA, 20 bp, human
ggatgttgcctaagacctcg

SEQ ID NO: 39822 - DNA, 20 bp, human
gtgcagcggctcttctcgaa

SEQ ID NO: 39823 - DNA, 20 bp, human
gcgagaggcggcccctgggt

SEQ ID NO: 39824 - DNA, 20 bp, human
gcccgcgtccccgaggtctt

SEQ ID NO: 39825 - DNA, 20 bp, human
ggcccgctgcacatgcccga

SEQ ID NO: 39826 - DNA, 20 bp, human
ggccagtcggacaccatccg

SEQ ID NO: 39827 - DNA, 20 bp, human
gcccgcctctgcagccgaca

SEQ ID NO: 39828 - DNA, 20 bp, human
gcgaggccgagagagcgatc

SEQ ID NO: 39829 - DNA, 20 bp, human
gttcacttagaacactgcgt

SEQ ID NO: 39830 - DNA, 20 bp, human
gttccaggggcgcagttgag

SEQ ID NO: 39831 - DNA, 20 bp, human
ggccccggtgcagccccgga

SEQ ID NO: 39832 - DNA, 20 bp, human
ggccccggatggtgtccgac

SEQ ID NO: 39833 - DNA, 20 bp, human
ggcagtacctgcgggaaacg

SEQ ID NO: 39834 - DNA, 20 bp, human
gagaaactcgctcgccatgt

SEQ ID NO: 39835 - DNA, 20 bp, human
ggaacaaaaggttcccccgg

SEQ ID NO: 39836 - DNA, 20 bp, human
gaggccgcgagcttagtcct

SEQ ID NO: 39837 - DNA, 20 bp, human
ggctgcaaacacacctgata

SEQ ID NO: 39838 - DNA, 20 bp, human
gtgtggccgccgccaccgta

SEQ ID NO: 39839 - DNA, 20 bp, human
gtcgcggcctagccttacgg

SEQ ID NO: 39840 - DNA, 20 bp, human
ggactccactgtcaccgaag

SEQ ID NO: 39841 - DNA, 20 bp, human
ggctcccaggactaagctcg

SEQ ID NO: 39842 - DNA, 20 bp, human
ggagggccccagcccagtca

SEQ ID NO: 39843 - DNA, 20 bp, human
gggcggccacacccctgact

SEQ ID NO: 39844 - DNA, 20 bp, human
gccgccgccaccgtaaggct

SEQ ID NO: 39845 - DNA, 20 bp, human
gcggcctagccttacggtgg

SEQ ID NO: 39846 - DNA, 20 bp, human
gtgtaaaagaaatctgggag

SEQ ID NO: 39847 - DNA, 20 bp, human
gtcagtaggttccacagtaa

SEQ ID NO: 39848 - DNA, 20 bp, human
gggggtgcagtcagtgttta

SEQ ID NO: 39849 - DNA, 20 bp, human
gtagcatttgctaagtcagt

SEQ ID NO: 39850 - DNA, 20 bp, human
gcagaaaggagcctgatgcc

SEQ ID NO: 39851 - DNA, 20 bp, human
gagcaaaggtgtcccttaca

SEQ ID NO: 39852 - DNA, 20 bp, human
gcatttaatggcagaatgaa

SEQ ID NO: 39853 - DNA, 20 bp, human
gtgtgactgcacaccaaaaa

SEQ ID NO: 39854 - DNA, 20 bp, human
ggggtattaccttgacagaa

SEQ ID NO: 39855 - DNA, 20 bp, human
gtagtttagcagtgaagcaa

SEQ ID NO: 39856 - DNA, 20 bp, human
gtacatggagaactccagac

SEQ ID NO: 39857 - DNA, 20 bp, human
ggacagcagcgaactcagtc

SEQ ID NO: 39858 - DNA, 20 bp, human
gagccgactcgagaggaacc

SEQ ID NO: 39859 - DNA, 20 bp, human
gtcggctccaactgccaggt

SEQ ID NO: 39860 - DNA, 20 bp, human
gcagttggagccgactcgag

SEQ ID NO: 39861 - DNA, 20 bp, human
gtggagaactccagaccggt

SEQ ID NO: 39862 - DNA, 20 bp, human
ggtcccggttcctctcgagt

SEQ ID NO: 39863 - DNA, 20 bp, human
gcgagtcggctccaactgcc

SEQ ID NO: 39864 - DNA, 20 bp, human
gcttcccggtggggtaggaa

SEQ ID NO: 39865 - DNA, 20 bp, human
gaactgccaggtgggcggcc

SEQ ID NO: 39866 - DNA, 20 bp, human
gactagcggcggagacgagg

SEQ ID NO: 39867 - DNA, 20 bp, human
gagcgccagggactaccggc

SEQ ID NO: 39868 - DNA, 20 bp, human
gtcccgggagggaaccgtac

SEQ ID NO: 39869 - DNA, 20 bp, human
gggcgctgctgacccagcat

SEQ ID NO: 39870 - DNA, 20 bp, human
gaaaggagggaagaagatcc

SEQ ID NO: 39871 - DNA, 20 bp, human
gtggagctggagactagcgg

SEQ ID NO: 39872 - DNA, 20 bp, human
gtctgccggccggtagtccc

SEQ ID NO: 39873 - DNA, 20 bp, human
gggcctgacgaggcaagtga

SEQ ID NO: 39874 - DNA, 20 bp, human
ggcccgtacggttccctccc

SEQ ID NO: 39875 - DNA, 20 bp, human
gtccagcgccaagagatgaa

SEQ ID NO: 39876 - DNA, 20 bp, human
gggtgaggaacaggtcgccg

SEQ ID NO: 39877 - DNA, 20 bp, human
gagccaccggtaaataaaaa

SEQ ID NO: 39878 - DNA, 20 bp, human
gtagcgtgtacgaaagcgag

SEQ ID NO: 39879 - DNA, 20 bp, human
ggacggaggaggccagtctc

SEQ ID NO: 39880 - DNA, 20 bp, human
gttccaatttaggaagaccc

SEQ ID NO: 39881 - DNA, 20 bp, human
gaagtgtgagggcgaagcgg

SEQ ID NO: 39882 - DNA, 20 bp, human
ggtgggagcgcgggcgacgg

SEQ ID NO: 39883 - DNA, 20 bp, human
gcgtgtacgaaagcgagcgg

SEQ ID NO: 39884 - DNA, 20 bp, human
gcgccggggtcttcctaaat

SEQ ID NO: 39885 - DNA, 20 bp, human
ggtttcaggggagggtatgt

SEQ ID NO: 39886 - DNA, 20 bp, human
ggggctccgtatgcggctcc

SEQ ID NO: 39887 - DNA, 20 bp, human
gctgcgcagtgcatcaccgc

SEQ ID NO: 39888 - DNA, 20 bp, human
gcaccccacagccctcccgg

SEQ ID NO: 39889 - DNA, 20 bp, human
ggacccgcgaggcccgcctg

SEQ ID NO: 39890 - DNA, 20 bp, human
ggcgcggcacggggaggtca

SEQ ID NO: 39891 - DNA, 20 bp, human
gcgcgcggggaggagaccgg

SEQ ID NO: 39892 - DNA, 20 bp, human
gcacggccgcctgaacctcg

SEQ ID NO: 39893 - DNA, 20 bp, human
gggcagcgcgcggcacgggg

SEQ ID NO: 39894 - DNA, 20 bp, human
gagatcagagtcacgccctt

SEQ ID NO: 39895 - DNA, 20 bp, human
gtccccgcgcgggccctggt

SEQ ID NO: 39896 - DNA, 20 bp, human
ggtctcgggaccacagatga

SEQ ID NO: 39897 - DNA, 20 bp, human
gggaggtctcaggatggagt

SEQ ID NO: 39898 - DNA, 20 bp, human
gggatcccaggacccggagg

SEQ ID NO: 39899 - DNA, 20 bp, human
gactctcaagacctagaggg

SEQ ID NO: 39900 - DNA, 20 bp, human
gggcgctcccggcatccctc

SEQ ID NO: 39901 - DNA, 20 bp, human
gcggcgaggcgaagcgaagg

SEQ ID NO: 39902 - DNA, 20 bp, human
ggggagttcggtaactaaag

SEQ ID NO: 39903 - DNA, 20 bp, human
ggcagagggccaaagatccg

SEQ ID NO: 39904 - DNA, 20 bp, human
gagggactctcaagacctag

SEQ ID NO: 39905 - DNA, 20 bp, human
gcggcggcgaggcgaagcga

SEQ ID NO: 39906 - DNA, 20 bp, human
gcccacgaagagctcactcg

SEQ ID NO: 39907 - DNA, 20 bp, human
ggagctcttcgtgggagaca

SEQ ID NO: 39908 - DNA, 20 bp, human
ggtctgcccctgcactgggt

SEQ ID NO: 39909 - DNA, 20 bp, human
gtgcaggggcagacacccca

SEQ ID NO: 39910 - DNA, 20 bp, human
gggccagaaaaggggtgtca

SEQ ID NO: 39911 - DNA, 20 bp, human
ggccccgagtgagctcttcg

SEQ ID NO: 39912 - DNA, 20 bp, human
gaggctcactcggataggga

SEQ ID NO: 39913 - DNA, 20 bp, human
gttgtcactcaggccagaaa

SEQ ID NO: 39914 - DNA, 20 bp, human
gccctgctcctgtacagccc

SEQ ID NO: 39915 - DNA, 20 bp, human
gcacaaggctcactcggata

SEQ ID NO: 39916 - DNA, 20 bp, human
gcgcggcccagaggcggcaa

SEQ ID NO: 39917 - DNA, 20 bp, human
gacctgggctctcacgtacc

SEQ ID NO: 39918 - DNA, 20 bp, human
gccgggtgccgccaacaata

SEQ ID NO: 39919 - DNA, 20 bp, human
ggcagcagcagcggatctag

SEQ ID NO: 39920 - DNA, 20 bp, human
gccgcggcgggcagacctgc

SEQ ID NO: 39921 - DNA, 20 bp, human
gcgcggcccgtgaaacgacg

SEQ ID NO: 39922 - DNA, 20 bp, human
ggcagcagcggatctagcgg

SEQ ID NO: 39923 - DNA, 20 bp, human
gtgtaagcggcggagagaac

SEQ ID NO: 39924 - DNA, 20 bp, human
gaacgacgcggtagaacgag

SEQ ID NO: 39925 - DNA, 20 bp, human
gggggcgccacgccaggggt

SEQ ID NO: 39926 - DNA, 20 bp, human
ggagagcggttcgcgcgctt

SEQ ID NO: 39927 - DNA, 20 bp, human
gccggaggatggacaaagta

SEQ ID NO: 39928 - DNA, 20 bp, human
gcccgttaccgggaatatgg

SEQ ID NO: 39929 - DNA, 20 bp, human
gtagggccactaggacccga

SEQ ID NO: 39930 - DNA, 20 bp, human
ggccactaggacccgagggt

SEQ ID NO: 39931 - DNA, 20 bp, human
ggttaccgggaatatggcgg

SEQ ID NO: 39932 - DNA, 20 bp, human
gggtcgggcccgagggtgat

SEQ ID NO: 39933 - DNA, 20 bp, human
ggcccccgttaccgggaata

SEQ ID NO: 39934 - DNA, 20 bp, human
gtcccaccctcgggtcctag

SEQ ID NO: 39935 - DNA, 20 bp, human
ggtcgcgccataggcagctg

SEQ ID NO: 39936 - DNA, 20 bp, human
gcggcggtggagtgaacgag

SEQ ID NO: 39937 - DNA, 20 bp, human
gcgagtcagctacggaggtg

SEQ ID NO: 39938 - DNA, 20 bp, human
gccagggcggattaaggagt

SEQ ID NO: 39939 - DNA, 20 bp, human
gcgcaggctgaccgacccct

SEQ ID NO: 39940 - DNA, 20 bp, human
gattaaggagtgggagacaa

SEQ ID NO: 39941 - DNA, 20 bp, human
gggaggcgtccagccaagtc

SEQ ID NO: 39942 - DNA, 20 bp, human
gggcctcaccgagtcagcta

SEQ ID NO: 39943 - DNA, 20 bp, human
gctcaccgagtcagctacgg

SEQ ID NO: 39944 - DNA, 20 bp, human
ggcgtccagccaagtccgga

SEQ ID NO: 39945 - DNA, 20 bp, human
gagtctgagggtctgcccag

SEQ ID NO: 39946 - DNA, 20 bp, human
ggaacccgagctgtgagtag

SEQ ID NO: 39947 - DNA, 20 bp, human
gcggcccctactcacagctc

SEQ ID NO: 39948 - DNA, 20 bp, human
gtggtcggcacctaggacgg

SEQ ID NO: 39949 - DNA, 20 bp, human
gaggccggctccacttccag

SEQ ID NO: 39950 - DNA, 20 bp, human
ggtggggacacgggccagag

SEQ ID NO: 39951 - DNA, 20 bp, human
gtgagggcccagacccccgc

SEQ ID NO: 39952 - DNA, 20 bp, human
gtcgcgccagccttccgggt

SEQ ID NO: 39953 - DNA, 20 bp, human
ggagccccaaggacggcgaa

SEQ ID NO: 39954 - DNA, 20 bp, human
ggagtggctggccccacgca

SEQ ID NO: 39955 - DNA, 20 bp, human
ggctggccccacgcacggac

SEQ ID NO: 39956 - DNA, 20 bp, human
ggtgacggtgatctcggggt

SEQ ID NO: 39957 - DNA, 20 bp, human
gtctgggtgacggtgatctc

SEQ ID NO: 39958 - DNA, 20 bp, human
ggacaccatccccctcgcct

SEQ ID NO: 39959 - DNA, 20 bp, human
gggacctgaatacccggcta

SEQ ID NO: 39960 - DNA, 20 bp, human
gctcgccttggcatgaaaag

SEQ ID NO: 39961 - DNA, 20 bp, human
ggtgcaaggagtccaccacc

SEQ ID NO: 39962 - DNA, 20 bp, human
ggcccgtgctggagggaatg

SEQ ID NO: 39963 - DNA, 20 bp, human
gggtaagtactggaccccag

SEQ ID NO: 39964 - DNA, 20 bp, human
ggaccccaggatccgatcag

SEQ ID NO: 39965 - DNA, 20 bp, human
ggagcgtcgaggacaagtga

SEQ ID NO: 39966 - DNA, 20 bp, human
gcactgcgtcaggactcctg

SEQ ID NO: 39967 - DNA, 20 bp, human
ggtgtcttgggcgctaacgg

SEQ ID NO: 39968 - DNA, 20 bp, human
gccccaagcccctaccatgg

SEQ ID NO: 39969 - DNA, 20 bp, human
ggagtcctgacgcagtgtct

SEQ ID NO: 39970 - DNA, 20 bp, human
gggagccgatggccttacag

SEQ ID NO: 39971 - DNA, 20 bp, human
ggcggaaacgggttcactag

SEQ ID NO: 39972 - DNA, 20 bp, human
ggcagtgtcttgggcgctaa

SEQ ID NO: 39973 - DNA, 20 bp, human
gtcttgggcgctaacggcgg

SEQ ID NO: 39974 - DNA, 20 bp, human
gcccaagacttccagattag

SEQ ID NO: 39975 - DNA, 20 bp, human
gcgcccccaagcccctacca

SEQ ID NO: 39976 - DNA, 20 bp, human
gcaccctcccgcgctaagag

SEQ ID NO: 39977 - DNA, 20 bp, human
gacacgcgttgagggagtaa

SEQ ID NO: 39978 - DNA, 20 bp, human
gagctggcacgacccacgca

SEQ ID NO: 39979 - DNA, 20 bp, human
gtctagcctggaagaacccc

SEQ ID NO: 39980 - DNA, 20 bp, human
gcttctgcctaggaacgcat

SEQ ID NO: 39981 - DNA, 20 bp, human
gaagccctcagcaccaacag

SEQ ID NO: 39982 - DNA, 20 bp, human
gggtgctcctccctgagccg

SEQ ID NO: 39983 - DNA, 20 bp, human
gcagcttcgtacttccccgg

SEQ ID NO: 39984 - DNA, 20 bp, human
gagggtcctcgtgactgggt

SEQ ID NO: 39985 - DNA, 20 bp, human
gagtgccgcctgccctgcgt

SEQ ID NO: 39986 - DNA, 20 bp, human
ggagtaagtggagaggtaga

SEQ ID NO: 39987 - DNA, 20 bp, human
ggaaacaggagtaagtggag

SEQ ID NO: 39988 - DNA, 20 bp, human
gtaggaaaggtgtgcttcac

SEQ ID NO: 39989 - DNA, 20 bp, human
gtggccagtcatgagtgcat

SEQ ID NO: 39990 - DNA, 20 bp, human
gtcgtcaaaatccttaggaa

SEQ ID NO: 39991 - DNA, 20 bp, human
gaattgaagaaattaggata

SEQ ID NO: 39992 - DNA, 20 bp, human
ggaagaaattaggatatggt

SEQ ID NO: 39993 - DNA, 20 bp, human
gctcattcgtcaaaatcctt

SEQ ID NO: 39994 - DNA, 20 bp, human
ggagttgtcgctctgggtca

SEQ ID NO: 39995 - DNA, 20 bp, human
ggtcaaaagaactgtgaaac

SEQ ID NO: 39996 - DNA, 20 bp, human
ggcgagcaggagcccccaca

SEQ ID NO: 39997 - DNA, 20 bp, human
gctcaatccccgccatgtgg

SEQ ID NO: 39998 - DNA, 20 bp, human
gcgccggcggagacagctaa

SEQ ID NO: 39999 - DNA, 20 bp, human
ggcaggagcccccacatggc

SEQ ID NO: 40000 - DNA, 20 bp, human
gagggagggatcgccccacg

SEQ ID NO: 40001 - DNA, 20 bp, human
gcccgcctcggacctcggag

SEQ ID NO: 40002 - DNA, 20 bp, human
ggcgcagcccgggaccacca

SEQ ID NO: 40003 - DNA, 20 bp, human
gggcccagcaccgagttcct

SEQ ID NO: 40004 - DNA, 20 bp, human
gaggggcgcgcgggctacgg

SEQ ID NO: 40005 - DNA, 20 bp, human
ggcctcggacctcggagagg

SEQ ID NO: 40006 - DNA, 20 bp, human
ggcagggtcacggtcaccgg

SEQ ID NO: 40007 - DNA, 20 bp, human
gcctggaggcgcgcaaccac

SEQ ID NO: 40008 - DNA, 20 bp, human
ggcggggcccggggaggagt

SEQ ID NO: 40009 - DNA, 20 bp, human
gagaagctggcgcggggcaa

SEQ ID NO: 40010 - DNA, 20 bp, human
gcaaccaccggcgccccctc

SEQ ID NO: 40011 - DNA, 20 bp, human
gtaataatcagggtcctcga

SEQ ID NO: 40012 - DNA, 20 bp, human
gtacctggtggaggcggctc

SEQ ID NO: 40013 - DNA, 20 bp, human
ggcttggtggccctcttggg

SEQ ID NO: 40014 - DNA, 20 bp, human
gcagaaagttccttacctgg

SEQ ID NO: 40015 - DNA, 20 bp, human
ggaagccagttgtcccctgg

SEQ ID NO: 40016 - DNA, 20 bp, human
gacaccagggaggctctcta

SEQ ID NO: 40017 - DNA, 20 bp, human
gggcgacgaccaggactgta

SEQ ID NO: 40018 - DNA, 20 bp, human
ggacggccagcgcagtgatg

SEQ ID NO: 40019 - DNA, 20 bp, human
gctggacggggacaccaggg

SEQ ID NO: 40020 - DNA, 20 bp, human
gtcactgcgctggccgtcca

SEQ ID NO: 40021 - DNA, 20 bp, human
gcccctggacggggacacca

SEQ ID NO: 40022 - DNA, 20 bp, human
gccataggcgcgtgacctac

SEQ ID NO: 40023 - DNA, 20 bp, human
ggcgcagtgatgtggcactc

SEQ ID NO: 40024 - DNA, 20 bp, human
ggcagagggtcaccacgcct

SEQ ID NO: 40025 - DNA, 20 bp, human
ggcgagaacgtctccaaagt

SEQ ID NO: 40026 - DNA, 20 bp, human
gccggcggcccgacaggctc

SEQ ID NO: 40027 - DNA, 20 bp, human
gaagaagcccggagcctgtc

SEQ ID NO: 40028 - DNA, 20 bp, human
ggctggctatagccaagacg

SEQ ID NO: 40029 - DNA, 20 bp, human
ggatgtgcttggggagaatg

SEQ ID NO: 40030 - DNA, 20 bp, human
gcgggcgccggcggcccgac

SEQ ID NO: 40031 - DNA, 20 bp, human
gtaggatcaacgccacgtct

SEQ ID NO: 40032 - DNA, 20 bp, human
gcgggcggacgaggaacccg

SEQ ID NO: 40033 - DNA, 20 bp, human
gagcgcgcgacccggcaggg

SEQ ID NO: 40034 - DNA, 20 bp, human
ggcttacccagaagcagcga

SEQ ID NO: 40035 - DNA, 20 bp, human
gtcctagtgaaagggaactt

SEQ ID NO: 40036 - DNA, 20 bp, human
gccactaaccggactcagaa

SEQ ID NO: 40037 - DNA, 20 bp, human
gggagaccccgtgatttatc

SEQ ID NO: 40038 - DNA, 20 bp, human
ggaccccgtgatttatccgg

SEQ ID NO: 40039 - DNA, 20 bp, human
gggacgggaggcgccatgag

SEQ ID NO: 40040 - DNA, 20 bp, human
gtcacctccggataaatcac

SEQ ID NO: 40041 - DNA, 20 bp, human
ggggaagtcccttctgagtc

SEQ ID NO: 40042 - DNA, 20 bp, human
gagggacgctcgagacggac

SEQ ID NO: 40043 - DNA, 20 bp, human
ggacgcgcgaatccaccccg

SEQ ID NO: 40044 - DNA, 20 bp, human
ggattgttgtgtccactaac

SEQ ID NO: 40045 - DNA, 20 bp, human
ggaggccagggttctccgag

SEQ ID NO: 40046 - DNA, 20 bp, human
gtcagaactagcacgtgtgc

SEQ ID NO: 40047 - DNA, 20 bp, human
gtggaggctgcgccacagag

SEQ ID NO: 40048 - DNA, 20 bp, human
gtccgagacccgcgagcgtc

SEQ ID NO: 40049 - DNA, 20 bp, human
gctgtctggtcggcccggtg

SEQ ID NO: 40050 - DNA, 20 bp, human
ggccacggccgaagcccccg

SEQ ID NO: 40051 - DNA, 20 bp, human
ggccaaaagcgagacggtgg

SEQ ID NO: 40052 - DNA, 20 bp, human
gaccagacagcgcccctctg

SEQ ID NO: 40053 - DNA, 20 bp, human
gcagagctgccggacgctcg

SEQ ID NO: 40054 - DNA, 20 bp, human
ggcagtgggtaggtttcccg

SEQ ID NO: 40055 - DNA, 20 bp, human
ggtccctcaaagctagcggg

SEQ ID NO: 40056 - DNA, 20 bp, human
gcggcggcaggtacggacag

SEQ ID NO: 40057 - DNA, 20 bp, human
gcggcaggtacggacagcgg

SEQ ID NO: 40058 - DNA, 20 bp, human
gcatagcgaggagagattac

SEQ ID NO: 40059 - DNA, 20 bp, human
gtccaggtgccggcgaagtt

SEQ ID NO: 40060 - DNA, 20 bp, human
gacggacagcggcggcgcag

SEQ ID NO: 40061 - DNA, 20 bp, human
gacactctgagctcgcaagg

SEQ ID NO: 40062 - DNA, 20 bp, human
gaagtccgcaccatcgagga

SEQ ID NO: 40063 - DNA, 20 bp, human
gctggagagcaaggaggatc

SEQ ID NO: 40064 - DNA, 20 bp, human
ggagctcgcaaggcggagac

SEQ ID NO: 40065 - DNA, 20 bp, human
ggtgccggcgaagttgggca

SEQ ID NO: 40066 - DNA, 20 bp, human
gtggaaccaagacaagtcca

SEQ ID NO: 40067 - DNA, 20 bp, human
gccaacactgcggtgactca

SEQ ID NO: 40068 - DNA, 20 bp, human
gccgcagtgttggcaccggt

SEQ ID NO: 40069 - DNA, 20 bp, human
ggttccagaacctgacgacc

SEQ ID NO: 40070 - DNA, 20 bp, human
ggaacctgacgacccggcga

SEQ ID NO: 40071 - DNA, 20 bp, human
gtcgccgtcgccgggtcgtc

SEQ ID NO: 40072 - DNA, 20 bp, human
ggcggtccccgtagactcct

SEQ ID NO: 40073 - DNA, 20 bp, human
ggcaggggcggttccgtaca

SEQ ID NO: 40074 - DNA, 20 bp, human
gttggggatgagaaagacag

SEQ ID NO: 40075 - DNA, 20 bp, human
ggaagcctggacccacacgc

SEQ ID NO: 40076 - DNA, 20 bp, human
gggcaggttccctaacagtc

SEQ ID NO: 40077 - DNA, 20 bp, human
gaccggaatcctgactgtta

SEQ ID NO: 40078 - DNA, 20 bp, human
ggttcaggaggtgacaggtg

SEQ ID NO: 40079 - DNA, 20 bp, human
gcacccgggcagtacgacca

SEQ ID NO: 40080 - DNA, 20 bp, human
gaacaaagatggtgcttatg

SEQ ID NO: 40081 - DNA, 20 bp, human
gtccctaacagtcaggattc

SEQ ID NO: 40082 - DNA, 20 bp, human
gcaaccacgtatctttgggg

SEQ ID NO: 40083 - DNA, 20 bp, human
gcaaccctgtaaagttcagg

SEQ ID NO: 40084 - DNA, 20 bp, human
gttggcccggatcggaaatg

SEQ ID NO: 40085 - DNA, 20 bp, human
gctgggaatgaactaaagag

SEQ ID NO: 40086 - DNA, 20 bp, human
gcggcgggccggcttcgcta

SEQ ID NO: 40087 - DNA, 20 bp, human
gccggaactgctgctgaggg

SEQ ID NO: 40088 - DNA, 20 bp, human
gtagccggaactgctgctga

SEQ ID NO: 40089 - DNA, 20 bp, human
gccgtccgtgaggtccccac

SEQ ID NO: 40090 - DNA, 20 bp, human
ggacgcgagccggtgcggag

SEQ ID NO: 40091 - DNA, 20 bp, human
gccggctcgcgtctcgggat

SEQ ID NO: 40092 - DNA, 20 bp, human
gaactggcctcagggcgagg

SEQ ID NO: 40093 - DNA, 20 bp, human
ggccccgtcccgctccgcac

SEQ ID NO: 40094 - DNA, 20 bp, human
ggaactgctgctgagggcgg

SEQ ID NO: 40095 - DNA, 20 bp, human
gacagccacaactggcctca

SEQ ID NO: 40096 - DNA, 20 bp, human
gcccacagccacctacccgg

SEQ ID NO: 40097 - DNA, 20 bp, human
gcagtgaagttgggcgacgg

SEQ ID NO: 40098 - DNA, 20 bp, human
gcgcaggccgggaagtttag

SEQ ID NO: 40099 - DNA, 20 bp, human
gagaggggaggcggccggtg

SEQ ID NO: 40100 - DNA, 20 bp, human
ggcaggatgacagtgaagtt

SEQ ID NO: 40101 - DNA, 20 bp, human
gcatgagccgcggccccgcc

SEQ ID NO: 40102 - DNA, 20 bp, human
gccccgacgcgctctcaaca

SEQ ID NO: 40103 - DNA, 20 bp, human
gcgggccgagccgccgagag

SEQ ID NO: 40104 - DNA, 20 bp, human
gggggatttggaacaaacaa

SEQ ID NO: 40105 - DNA, 20 bp, human
ggagccgccgagaggggatt

SEQ ID NO: 40106 - DNA, 20 bp, human
gtggaggccgggtcgaacag

SEQ ID NO: 40107 - DNA, 20 bp, human
gcccgctcggcccagagggt

SEQ ID NO: 40108 - DNA, 20 bp, human
gcaggcgggcgtcccaggtt

SEQ ID NO: 40109 - DNA, 20 bp, human
ggaacagcggccgcaggacg

SEQ ID NO: 40110 - DNA, 20 bp, human
gcccagagacaggccggtag

SEQ ID NO: 40111 - DNA, 20 bp, human
ggacccaccgaccccagccg

SEQ ID NO: 40112 - DNA, 20 bp, human
gttggcagagcaggagattg

SEQ ID NO: 40113 - DNA, 20 bp, human
ggccccacagccaacctccc

SEQ ID NO: 40114 - DNA, 20 bp, human
ggaacggagaccgcgtcctg

SEQ ID NO: 40115 - DNA, 20 bp, human
gctgcggccgctgttcgacc

SEQ ID NO: 40116 - DNA, 20 bp, human
gctgtgaaggagctgtaagt

SEQ ID NO: 40117 - DNA, 20 bp, human
ggctccttcacagaaaatac

SEQ ID NO: 40118 - DNA, 20 bp, human
ggaaggagctgtaagtaggg

SEQ ID NO: 40119 - DNA, 20 bp, human
gtcacttacacgggaggatg

SEQ ID NO: 40120 - DNA, 20 bp, human
gttagcatcacttacacggg

SEQ ID NO: 40121 - DNA, 20 bp, human
gtgggacagagatggcacct

SEQ ID NO: 40122 - DNA, 20 bp, human
gactgactgttcacattgac

SEQ ID NO: 40123 - DNA, 20 bp, human
gctccagctcactactacaa

SEQ ID NO: 40124 - DNA, 20 bp, human
gtggtggtctggtcccagtc

SEQ ID NO: 40125 - DNA, 20 bp, human
gttcttagcatcacttacac

SEQ ID NO: 40126 - DNA, 20 bp, human
gccaggcctggccagcgcca

SEQ ID NO: 40127 - DNA, 20 bp, human
ggccgagcagagcgcagagc

SEQ ID NO: 40128 - DNA, 20 bp, human
gcggctgctgtgagaacggg

SEQ ID NO: 40129 - DNA, 20 bp, human
gagcgcagagcgggctgcca

SEQ ID NO: 40130 - DNA, 20 bp, human
ggctcggctgctgtgagaac

SEQ ID NO: 40131 - DNA, 20 bp, human
gagtagcaggacagaggcca

SEQ ID NO: 40132 - DNA, 20 bp, human
ggctgatgcgggtgagggat

SEQ ID NO: 40133 - DNA, 20 bp, human
gggagccccacagagtctgg

SEQ ID NO: 40134 - DNA, 20 bp, human
ggagcgggctgccatggcgc

SEQ ID NO: 40135 - DNA, 20 bp, human
gggcccagagcagcagtagc

SEQ ID NO: 40136 - DNA, 20 bp, human
ggatccctagagggaggatg

SEQ ID NO: 40137 - DNA, 20 bp, human
gcctgagcaggctccgaagg

SEQ ID NO: 40138 - DNA, 20 bp, human
gcagacaggttgagagtggt

SEQ ID NO: 40139 - DNA, 20 bp, human
gtgaagggatccctagaggg

SEQ ID NO: 40140 - DNA, 20 bp, human
gattcctgagcaggctccga

SEQ ID NO: 40141 - DNA, 20 bp, human
ggtacccaaggcactctgag

SEQ ID NO: 40142 - DNA, 20 bp, human
gcactctcaacctgtctgga

SEQ ID NO: 40143 - DNA, 20 bp, human
gggctccgaaggaggcagct

SEQ ID NO: 40144 - DNA, 20 bp, human
ggctcaggaatgccaggcac

SEQ ID NO: 40145 - DNA, 20 bp, human
gcacctgaagggatccctag

SEQ ID NO: 40146 - DNA, 20 bp, human
gcccagcgggccagcaggaa

SEQ ID NO: 40147 - DNA, 20 bp, human
gcgacggaccgagggttcga

SEQ ID NO: 40148 - DNA, 20 bp, human
ggtgcccctggccggagatg

SEQ ID NO: 40149 - DNA, 20 bp, human
gggaccgagggttcgaggga

SEQ ID NO: 40150 - DNA, 20 bp, human
gggacccacagaacgaccga

SEQ ID NO: 40151 - DNA, 20 bp, human
ggccaggggcacctgcgacg

SEQ ID NO: 40152 - DNA, 20 bp, human
gccctggccggagatgcggt

SEQ ID NO: 40153 - DNA, 20 bp, human
gtagaagcgctgggtatctg

SEQ ID NO: 40154 - DNA, 20 bp, human
gggagagacaactggcgcca

SEQ ID NO: 40155 - DNA, 20 bp, human
gccgagcctgggggcaaagt

SEQ ID NO: 40156 - DNA, 20 bp, human
gaggacgctgcgcacaacat

SEQ ID NO: 40157 - DNA, 20 bp, human
ggaccgggtcagattcacag

SEQ ID NO: 40158 - DNA, 20 bp, human
gtacagggaactactccggg

SEQ ID NO: 40159 - DNA, 20 bp, human
ggactacagggaactactcc

SEQ ID NO: 40160 - DNA, 20 bp, human
ggccggcgaaggagatcagc

SEQ ID NO: 40161 - DNA, 20 bp, human
gactactccgggcggttacc

SEQ ID NO: 40162 - DNA, 20 bp, human
gaaacagacatggccggcga

SEQ ID NO: 40163 - DNA, 20 bp, human
ggctctgaaactagaggacc

SEQ ID NO: 40164 - DNA, 20 bp, human
gtcggccagcgatggagtcg

SEQ ID NO: 40165 - DNA, 20 bp, human
ggttaccaggcaggagcggc

SEQ ID NO: 40166 - DNA, 20 bp, human
ggaccctcgtacgggagtga

SEQ ID NO: 40167 - DNA, 20 bp, human
gaccttggcgctgttggtgg

SEQ ID NO: 40168 - DNA, 20 bp, human
ggccgccaccaacagcgcca

SEQ ID NO: 40169 - DNA, 20 bp, human
ggcgatcccggcgagcacct

SEQ ID NO: 40170 - DNA, 20 bp, human
gggcaccttggcgctgttgg

SEQ ID NO: 40171 - DNA, 20 bp, human
gcggggtcggataccagact

SEQ ID NO: 40172 - DNA, 20 bp, human
ggcatgcagcgcggcgatcc

SEQ ID NO: 40173 - DNA, 20 bp, human
ggactgggcgaccctcgtac

SEQ ID NO: 40174 - DNA, 20 bp, human
gctcggccccgcaccagaca

SEQ ID NO: 40175 - DNA, 20 bp, human
ggcgacgaggcgggacgtca

SEQ ID NO: 40176 - DNA, 20 bp, human
gtgtggggcatgagaggcgt

SEQ ID NO: 40177 - DNA, 20 bp, human
gcaagcccgtgtagacagta

SEQ ID NO: 40178 - DNA, 20 bp, human
gctgggtctaaataatccac

SEQ ID NO: 40179 - DNA, 20 bp, human
gggagcagcatcctgagctc

SEQ ID NO: 40180 - DNA, 20 bp, human
gggattcgagagccatgcgt

SEQ ID NO: 40181 - DNA, 20 bp, human
gggaggagcaaacagaacac

SEQ ID NO: 40182 - DNA, 20 bp, human
gtgcgtggctgagaacaaag

SEQ ID NO: 40183 - DNA, 20 bp, human
gaacgtagtgagtctttcag

SEQ ID NO: 40184 - DNA, 20 bp, human
gggaagatacagtcgaaggt

SEQ ID NO: 40185 - DNA, 20 bp, human
gtggaccctactgtctacac

SEQ ID NO: 40186 - DNA, 20 bp, human
gggagtgttggtgagtgacg

SEQ ID NO: 40187 - DNA, 20 bp, human
ggctgcggctcctcagtcgg

SEQ ID NO: 40188 - DNA, 20 bp, human
gctgctgcctgtggcccggg

SEQ ID NO: 40189 - DNA, 20 bp, human
gtcccagccgcccgggccac

SEQ ID NO: 40190 - DNA, 20 bp, human
ggctgggagaagcggagtgt

SEQ ID NO: 40191 - DNA, 20 bp, human
ggcggctcctcagtcggcgg

SEQ ID NO: 40192 - DNA, 20 bp, human
gggagccagagagagccggg

SEQ ID NO: 40193 - DNA, 20 bp, human
gccagcggcggcgctcatgg

SEQ ID NO: 40194 - DNA, 20 bp, human
gggccgcccgcacacacccc

SEQ ID NO: 40195 - DNA, 20 bp, human
gcaccggtaagaggagcagg

SEQ ID NO: 40196 - DNA, 20 bp, human
gtgggaggcgggtccggaga

SEQ ID NO: 40197 - DNA, 20 bp, human
gaccccgagggcgggggttc

SEQ ID NO: 40198 - DNA, 20 bp, human
gcccggccgtagagggacag

SEQ ID NO: 40199 - DNA, 20 bp, human
gccgtagagggacagtggat

SEQ ID NO: 40200 - DNA, 20 bp, human
gcgagccccaggccagctgt

SEQ ID NO: 40201 - DNA, 20 bp, human
gtacggccgggattccccgc

SEQ ID NO: 40202 - DNA, 20 bp, human
gagccgccggcggggaatcc

SEQ ID NO: 40203 - DNA, 20 bp, human
gggggaatcccggccgtaga

SEQ ID NO: 40204 - DNA, 20 bp, human
ggagggctatggaaagccgc

SEQ ID NO: 40205 - DNA, 20 bp, human
ggcgcaggtaccgagcgact

SEQ ID NO: 40206 - DNA, 20 bp, human
gctgggcttccctcactcca

SEQ ID NO: 40207 - DNA, 20 bp, human
gggcttccctcactccaggg

SEQ ID NO: 40208 - DNA, 20 bp, human
gcggcagccacccagtctcg

SEQ ID NO: 40209 - DNA, 20 bp, human
gcccgggacccccttccact

SEQ ID NO: 40210 - DNA, 20 bp, human
gcaggcaggagctctggact

SEQ ID NO: 40211 - DNA, 20 bp, human
ggtgagggaagcccagtgga

SEQ ID NO: 40212 - DNA, 20 bp, human
gtaagtgctcccccgagact

SEQ ID NO: 40213 - DNA, 20 bp, human
gacagcctgtcggccgggaa

SEQ ID NO: 40214 - DNA, 20 bp, human
gggagccccccggacagggt

SEQ ID NO: 40215 - DNA, 20 bp, human
gcagcggctaggagcgggat

SEQ ID NO: 40216 - DNA, 20 bp, human
gtggagccgtagcggcaagt

SEQ ID NO: 40217 - DNA, 20 bp, human
gtttgtgtctggagccgtag

SEQ ID NO: 40218 - DNA, 20 bp, human
gagcagagccgaggagccct

SEQ ID NO: 40219 - DNA, 20 bp, human
gggatgtgcatccaaaatga

SEQ ID NO: 40220 - DNA, 20 bp, human
gcaaactttgagggacccca

SEQ ID NO: 40221 - DNA, 20 bp, human
ggaggccctcatgtaccaca

SEQ ID NO: 40222 - DNA, 20 bp, human
gctcaccgtgtggtacatga

SEQ ID NO: 40223 - DNA, 20 bp, human
ggcgcagagctgcctcggac

SEQ ID NO: 40224 - DNA, 20 bp, human
gtgagggcctcgccgtcccc

SEQ ID NO: 40225 - DNA, 20 bp, human
gcaagcacacgcggagagag

SEQ ID NO: 40226 - DNA, 20 bp, human
ggaggctgtgaaggcctgag

SEQ ID NO: 40227 - DNA, 20 bp, human
gttggagcagagaccccccg

SEQ ID NO: 40228 - DNA, 20 bp, human
gccaagtgcccgctcctagg

SEQ ID NO: 40229 - DNA, 20 bp, human
gtctccctggggacctagta

SEQ ID NO: 40230 - DNA, 20 bp, human
gcggccccaggtaacgctgg

SEQ ID NO: 40231 - DNA, 20 bp, human
gtgtctgcagatgcctcggg

SEQ ID NO: 40232 - DNA, 20 bp, human
gcaagcggcatctctagcta

SEQ ID NO: 40233 - DNA, 20 bp, human
gggtaacgctggcggtgggt

SEQ ID NO: 40234 - DNA, 20 bp, human
gcccaggtaacgctggcggt

SEQ ID NO: 40235 - DNA, 20 bp, human
gaagatgctgaagcggtcac

SEQ ID NO: 40236 - DNA, 20 bp, human
gcaagagggagatcatggca

SEQ ID NO: 40237 - DNA, 20 bp, human
gcttgccaggagccacggta

SEQ ID NO: 40238 - DNA, 20 bp, human
gatggcagggttgtaaacaa

SEQ ID NO: 40239 - DNA, 20 bp, human
gaaagcgagggctacagaac

SEQ ID NO: 40240 - DNA, 20 bp, human
ggggctatgctggcttgaca

SEQ ID NO: 40241 - DNA, 20 bp, human
gctccctcttgcaaaagcga

SEQ ID NO: 40242 - DNA, 20 bp, human
gtgtctaaacctgagggata

SEQ ID NO: 40243 - DNA, 20 bp, human
gtgggttccgccagcctaaa

SEQ ID NO: 40244 - DNA, 20 bp, human
gttttgcaagagggagatca

SEQ ID NO: 40245 - DNA, 20 bp, human
gatgctggcttgacagggct

SEQ ID NO: 40246 - DNA, 20 bp, human
ggagtctaggaggtacctct

SEQ ID NO: 40247 - DNA, 20 bp, human
ggagggaggtaccagagtct

SEQ ID NO: 40248 - DNA, 20 bp, human
gaattacttctgcaacccag

SEQ ID NO: 40249 - DNA, 20 bp, human
ggaaacttagagaacgaggg

SEQ ID NO: 40250 - DNA, 20 bp, human
ggagcatgtagctgcttgcg

SEQ ID NO: 40251 - DNA, 20 bp, human
gcatagatggaattcagaaa

SEQ ID NO: 40252 - DNA, 20 bp, human
gaaagaaacttagagaacga

SEQ ID NO: 40253 - DNA, 20 bp, human
gtccatgtcagttaaatcta

SEQ ID NO: 40254 - DNA, 20 bp, human
gcttctggtctgaaatactg

SEQ ID NO: 40255 - DNA, 20 bp, human
gctagggagttcaagactac

SEQ ID NO: 40256 - DNA, 20 bp, human
ggtcacagaacatgtcagag

SEQ ID NO: 40257 - DNA, 20 bp, human
gcattaatgaagccagtgaa

SEQ ID NO: 40258 - DNA, 20 bp, human
ggatctcatttacctgaatg

SEQ ID NO: 40259 - DNA, 20 bp, human
gttttaaagtggcctttcac

SEQ ID NO: 40260 - DNA, 20 bp, human
gagagtggcttgtggcatga

SEQ ID NO: 40261 - DNA, 20 bp, human
gggatttgaggaagcgacct

SEQ ID NO: 40262 - DNA, 20 bp, human
gaacatgtcagagtggcttg

SEQ ID NO: 40263 - DNA, 20 bp, human
gttattttcagggtaagtgg

SEQ ID NO: 40264 - DNA, 20 bp, human
gctggaagattggtgactct

SEQ ID NO: 40265 - DNA, 20 bp, human
gggtattactcacccctttc

SEQ ID NO: 40266 - DNA, 20 bp, human
ggcttcgagcgcgatctact

SEQ ID NO: 40267 - DNA, 20 bp, human
gtcgcgctcgaagccccggt

SEQ ID NO: 40268 - DNA, 20 bp, human
gcgggtccgcgacaagatgg

SEQ ID NO: 40269 - DNA, 20 bp, human
gggtcgggtccgcgacaaga

SEQ ID NO: 40270 - DNA, 20 bp, human
gtcccgagcgcgacactccg

SEQ ID NO: 40271 - DNA, 20 bp, human
ggcggcggcaccatgttctc

SEQ ID NO: 40272 - DNA, 20 bp, human
gtcgcggcccgacgacgagg

SEQ ID NO: 40273 - DNA, 20 bp, human
gcgagcgcgacactccgcgg

SEQ ID NO: 40274 - DNA, 20 bp, human
gttgtggggcccgggaccgg

SEQ ID NO: 40275 - DNA, 20 bp, human
gagtgtcgcgctcgggaggc

SEQ ID NO: 40276 - DNA, 20 bp, human
gatcgggcagtggactggag

SEQ ID NO: 40277 - DNA, 20 bp, human
gcccagagactgtcatggag

SEQ ID NO: 40278 - DNA, 20 bp, human
gccccgccccgaggaagaag

SEQ ID NO: 40279 - DNA, 20 bp, human
ggcccaccctccggtctcgg

SEQ ID NO: 40280 - DNA, 20 bp, human
ggttggcgtggactacatag

SEQ ID NO: 40281 - DNA, 20 bp, human
ggagagccgccgagaccgga

SEQ ID NO: 40282 - DNA, 20 bp, human
ggcattgagcgacaagaagg

SEQ ID NO: 40283 - DNA, 20 bp, human
ggccgcgatggatgacagta

SEQ ID NO: 40284 - DNA, 20 bp, human
ggtaccatcgggcagtggac

SEQ ID NO: 40285 - DNA, 20 bp, human
gttcctggctgggtaccatc

SEQ ID NO: 40286 - DNA, 20 bp, human
gcccgaggcagcatggagag

SEQ ID NO: 40287 - DNA, 20 bp, human
gagtaggctaggccggggat

SEQ ID NO: 40288 - DNA, 20 bp, human
gcataaacaaaacaaacccg

SEQ ID NO: 40289 - DNA, 20 bp, human
gttccgggaacccgtcagga

SEQ ID NO: 40290 - DNA, 20 bp, human
gcgctcacctgtgggtgtag

SEQ ID NO: 40291 - DNA, 20 bp, human
gcgggcagtaggctaggccg

SEQ ID NO: 40292 - DNA, 20 bp, human
gaaacaaacccgaggcagca

SEQ ID NO: 40293 - DNA, 20 bp, human
gcgatttccgggaacccgtc

SEQ ID NO: 40294 - DNA, 20 bp, human
gcggcggtagatgggactcg

SEQ ID NO: 40295 - DNA, 20 bp, human
gggaccacggccgagtgcta

SEQ ID NO: 40296 - DNA, 20 bp, human
gctcctcacacgagctgagg

SEQ ID NO: 40297 - DNA, 20 bp, human
gtcagctcgtgtgaggagaa

SEQ ID NO: 40298 - DNA, 20 bp, human
gggaggcagggaagtaccga

SEQ ID NO: 40299 - DNA, 20 bp, human
gagaaaggcgggtcgaggtc

SEQ ID NO: 40300 - DNA, 20 bp, human
gcggaccaggaagtagctca

SEQ ID NO: 40301 - DNA, 20 bp, human
gtgaggagaaaggcgggtcg

SEQ ID NO: 40302 - DNA, 20 bp, human
ggtccgaaggcgagtccgat

SEQ ID NO: 40303 - DNA, 20 bp, human
gcaggcctcagataagagac

SEQ ID NO: 40304 - DNA, 20 bp, human
gaggcgagtccgatcggacc

SEQ ID NO: 40305 - DNA, 20 bp, human
gtcccaggaaccacccccag

SEQ ID NO: 40306 - DNA, 20 bp, human
ggagggacgggagaacgaag

SEQ ID NO: 40307 - DNA, 20 bp, human
ggaccgcgccacccagacaa

SEQ ID NO: 40308 - DNA, 20 bp, human
ggtcaggctatgcctcatga

SEQ ID NO: 40309 - DNA, 20 bp, human
ggcgcggtcgagtcatcgca

SEQ ID NO: 40310 - DNA, 20 bp, human
gtagtcgaccccccgcgcca

SEQ ID NO: 40311 - DNA, 20 bp, human
ggcgatcgccagcctcccgg

SEQ ID NO: 40312 - DNA, 20 bp, human
gcggcgtagccggaagtcag

SEQ ID NO: 40313 - DNA, 20 bp, human
gggctacgccgttgtctggg

SEQ ID NO: 40314 - DNA, 20 bp, human
gggccccggccgctaagagt

SEQ ID NO: 40315 - DNA, 20 bp, human
gactagccaagtgaggcggg

SEQ ID NO: 40316 - DNA, 20 bp, human
gccatggccgggctatcccg

SEQ ID NO: 40317 - DNA, 20 bp, human
gagcgtcgacgccagcaggg

SEQ ID NO: 40318 - DNA, 20 bp, human
gcttcctggagacaccgcca

SEQ ID NO: 40319 - DNA, 20 bp, human
gcagtgcgcgcgcggacccg

SEQ ID NO: 40320 - DNA, 20 bp, human
ggtgtctccaggaagagtcc

SEQ ID NO: 40321 - DNA, 20 bp, human
gtggagacaccgccatggcc

SEQ ID NO: 40322 - DNA, 20 bp, human
gagaattctggggagagtga

SEQ ID NO: 40323 - DNA, 20 bp, human
ggcctccagcgtggagatgg

SEQ ID NO: 40324 - DNA, 20 bp, human
gaagtggagcgtggctcgaa

SEQ ID NO: 40325 - DNA, 20 bp, human
gtggggcccgggactcttcc

SEQ ID NO: 40326 - DNA, 20 bp, human
ggccggtaggagaacatccc

SEQ ID NO: 40327 - DNA, 20 bp, human
gcgcgcagtctagggcccgg

SEQ ID NO: 40328 - DNA, 20 bp, human
gcagccccagacgctggcat

SEQ ID NO: 40329 - DNA, 20 bp, human
gaccgctcgggactgagatc

SEQ ID NO: 40330 - DNA, 20 bp, human
gtggcccatgccagcgtctg

SEQ ID NO: 40331 - DNA, 20 bp, human
gaggtgcgcgtcctccttgt

SEQ ID NO: 40332 - DNA, 20 bp, human
gctggacagcgcctccactg

SEQ ID NO: 40333 - DNA, 20 bp, human
gggtaggagaacatcccggg

SEQ ID NO: 40334 - DNA, 20 bp, human
gggtggcggcgcgcagtcta

SEQ ID NO: 40335 - DNA, 20 bp, human
ggcccggcagcgccccactg

SEQ ID NO: 40336 - DNA, 20 bp, human
ggaaggatccagaccctcgt

SEQ ID NO: 40337 - DNA, 20 bp, human
gccctcgtaggccacggaga

SEQ ID NO: 40338 - DNA, 20 bp, human
ggccaaactgggtattgcag

SEQ ID NO: 40339 - DNA, 20 bp, human
gcagcgacgcggtgaggaga

SEQ ID NO: 40340 - DNA, 20 bp, human
gggccggatccgcagaatta

SEQ ID NO: 40341 - DNA, 20 bp, human
ggcggtgaggagacggccca

SEQ ID NO: 40342 - DNA, 20 bp, human
gctgtggcagcgacgcggtg

SEQ ID NO: 40343 - DNA, 20 bp, human
gtcgctagcatggggtggag

SEQ ID NO: 40344 - DNA, 20 bp, human
gaaaggcacggcccacgagc

SEQ ID NO: 40345 - DNA, 20 bp, human
ggacggcccacggcgcccgc

SEQ ID NO: 40346 - DNA, 20 bp, human
gtggcagggcgtcggcttct

SEQ ID NO: 40347 - DNA, 20 bp, human
ggcagcacggccgcaggacc

SEQ ID NO: 40348 - DNA, 20 bp, human
gccagggtcgacgccaccgt

SEQ ID NO: 40349 - DNA, 20 bp, human
gtgacccgggtccagggtgg

SEQ ID NO: 40350 - DNA, 20 bp, human
gatccgggtcaagggtgagg

SEQ ID NO: 40351 - DNA, 20 bp, human
gtggatccgggtcaagggtg

SEQ ID NO: 40352 - DNA, 20 bp, human
gcacccccaccgtggaacca

SEQ ID NO: 40353 - DNA, 20 bp, human
gagcccaggtcgagggtgag

SEQ ID NO: 40354 - DNA, 20 bp, human
gaccacctgacccgggtcca

SEQ ID NO: 40355 - DNA, 20 bp, human
ggggggtggatccgggtcaa

SEQ ID NO: 40356 - DNA, 20 bp, human
ggcagtctccggagtgggaa

SEQ ID NO: 40357 - DNA, 20 bp, human
gggccgagcggagccgtggg

SEQ ID NO: 40358 - DNA, 20 bp, human
gccggggccgggccaaggac

SEQ ID NO: 40359 - DNA, 20 bp, human
ggccgcgtcaggtgaactcg

SEQ ID NO: 40360 - DNA, 20 bp, human
gccctaaaaaggcaagactc

SEQ ID NO: 40361 - DNA, 20 bp, human
gtggagcagcagaggccgag

SEQ ID NO: 40362 - DNA, 20 bp, human
gcggctgccccgccagtcct

SEQ ID NO: 40363 - DNA, 20 bp, human
gagccgcgaccgctctcgga

SEQ ID NO: 40364 - DNA, 20 bp, human
gcgcgggcagtctccggagt

SEQ ID NO: 40365 - DNA, 20 bp, human
ggccgggccaaggactggcg

SEQ ID NO: 40366 - DNA, 20 bp, human
gggctccgcggcgcacatcg

SEQ ID NO: 40367 - DNA, 20 bp, human
gaaggagcaactggcagcac

SEQ ID NO: 40368 - DNA, 20 bp, human
gtgcagagagacgtctccgg

SEQ ID NO: 40369 - DNA, 20 bp, human
gcgaagcgcctgggaaggta

SEQ ID NO: 40370 - DNA, 20 bp, human
gacagccagcaaggagcaac

SEQ ID NO: 40371 - DNA, 20 bp, human
gtacaatagtagctgggatg

SEQ ID NO: 40372 - DNA, 20 bp, human
gcaagtccattgagagactg

SEQ ID NO: 40373 - DNA, 20 bp, human
ggcgcacatcgcggcagctc

SEQ ID NO: 40374 - DNA, 20 bp, human
gagctcaggcaacgcaaagt

SEQ ID NO: 40375 - DNA, 20 bp, human
gccactccagagcctggagt

SEQ ID NO: 40376 - DNA, 20 bp, human
gtcccgtgtccggagaagac

SEQ ID NO: 40377 - DNA, 20 bp, human
ggctctgctccggaggtcct

SEQ ID NO: 40378 - DNA, 20 bp, human
gcaggccagggtatccccag

SEQ ID NO: 40379 - DNA, 20 bp, human
gtcagtctgcgcgagggtgt

SEQ ID NO: 40380 - DNA, 20 bp, human
gtagctctcagtctgcgcga

SEQ ID NO: 40381 - DNA, 20 bp, human
gctgagagctagaagctggt

SEQ ID NO: 40382 - DNA, 20 bp, human
ggtgagatgggtcagtccag

SEQ ID NO: 40383 - DNA, 20 bp, human
ggtgtccggagaagacggga

SEQ ID NO: 40384 - DNA, 20 bp, human
gtctgcgcgagggtgtagga

SEQ ID NO: 40385 - DNA, 20 bp, human
ggcatagcgaataaagagag

SEQ ID NO: 40386 - DNA, 20 bp, human
ggggctgcgtcgggaaacgg

SEQ ID NO: 40387 - DNA, 20 bp, human
gagcgagcccgaggatggga

SEQ ID NO: 40388 - DNA, 20 bp, human
gtacccaaccctggctccaa

SEQ ID NO: 40389 - DNA, 20 bp, human
ggacctttggagccagggtt

SEQ ID NO: 40390 - DNA, 20 bp, human
ggccgagcgagcccgaggat

SEQ ID NO: 40391 - DNA, 20 bp, human
gaacggcggccagacttccc

SEQ ID NO: 40392 - DNA, 20 bp, human
gcggccagacttccccggga

SEQ ID NO: 40393 - DNA, 20 bp, human
ggccccttcccggggaagtc

SEQ ID NO: 40394 - DNA, 20 bp, human
gcgggtgccctcccatcctc

SEQ ID NO: 40395 - DNA, 20 bp, human
gaggacccgggcattcagga

SEQ ID NO: 40396 - DNA, 20 bp, human
gcgcagctccgtgcactcgg

SEQ ID NO: 40397 - DNA, 20 bp, human
ggacagctctgggcgaccgg

SEQ ID NO: 40398 - DNA, 20 bp, human
gggcgggagagagcgcagta

SEQ ID NO: 40399 - DNA, 20 bp, human
ggaccggaggtggcgcccaa

SEQ ID NO: 40400 - DNA, 20 bp, human
gaaggctgcccgggagatcg

SEQ ID NO: 40401 - DNA, 20 bp, human
ggtcgcccagagctgtcaag

SEQ ID NO: 40402 - DNA, 20 bp, human
ggtccccacttgacagctct

SEQ ID NO: 40403 - DNA, 20 bp, human
gcggcggctcctctccggga

SEQ ID NO: 40404 - DNA, 20 bp, human
gagctctgggcgaccggagg

SEQ ID NO: 40405 - DNA, 20 bp, human
ggtcgtgttgcagtaggagt

SEQ ID NO: 40406 - DNA, 20 bp, human
gaaacaagcgcccggaggag

SEQ ID NO: 40407 - DNA, 20 bp, human
gtggcgcagcacaagatccg

SEQ ID NO: 40408 - DNA, 20 bp, human
ggaggagcggcgcaggagtg

SEQ ID NO: 40409 - DNA, 20 bp, human
ggccataaacaagcgcccgg

SEQ ID NO: 40410 - DNA, 20 bp, human
ggtcggcgcggcccgcagaa

SEQ ID NO: 40411 - DNA, 20 bp, human
ggcctcccgagctgccgagt

SEQ ID NO: 40412 - DNA, 20 bp, human
ggtcctcaccgcccctctcg

SEQ ID NO: 40413 - DNA, 20 bp, human
ggcgcaggagtgaggcgagc

SEQ ID NO: 40414 - DNA, 20 bp, human
ggagtcggccggccccgcag

SEQ ID NO: 40415 - DNA, 20 bp, human
gcgccggcgccaaggctcgt

SEQ ID NO: 40416 - DNA, 20 bp, human
gcctgcgggtcccccactca

SEQ ID NO: 40417 - DNA, 20 bp, human
ggtaggacccagagacgggg

SEQ ID NO: 40418 - DNA, 20 bp, human
gcagccccgggcctctgcgg

SEQ ID NO: 40419 - DNA, 20 bp, human
ggaccgctcaggaggaccgg

SEQ ID NO: 40420 - DNA, 20 bp, human
gtagcaggcagagatcgcca

SEQ ID NO: 40421 - DNA, 20 bp, human
gaggaaacggcagagaccgt

SEQ ID NO: 40422 - DNA, 20 bp, human
gttgggacacttgggcatga

SEQ ID NO: 40423 - DNA, 20 bp, human
ggggcgaggccgagggtcag

SEQ ID NO: 40424 - DNA, 20 bp, human
gcgggcctctgcggtggcaa

SEQ ID NO: 40425 - DNA, 20 bp, human
gacctcagcgtggcccccag

SEQ ID NO: 40426 - DNA, 20 bp, human
gcggcggcccggaggagaac

SEQ ID NO: 40427 - DNA, 20 bp, human
gcgaccgggcgcaccgacca

SEQ ID NO: 40428 - DNA, 20 bp, human
gaaacactggcctcatcccg

SEQ ID NO: 40429 - DNA, 20 bp, human
gccggaggagaacgggcgga

SEQ ID NO: 40430 - DNA, 20 bp, human
gcggcgccgtccgaggaacc

SEQ ID NO: 40431 - DNA, 20 bp, human
ggggagcgctcggggatccg

SEQ ID NO: 40432 - DNA, 20 bp, human
gacgcactcaccgaagtaca

SEQ ID NO: 40433 - DNA, 20 bp, human
gggaccgaggatgcgcgtcc

SEQ ID NO: 40434 - DNA, 20 bp, human
gcgcatcccggttcctcgga

SEQ ID NO: 40435 - DNA, 20 bp, human
gcacggtcttgtcgcacttg

SEQ ID NO: 40436 - DNA, 20 bp, human
gggggagtgtgaaaccggag

SEQ ID NO: 40437 - DNA, 20 bp, human
gagcgcacgcggcacacagt

SEQ ID NO: 40438 - DNA, 20 bp, human
ggagctccctgggcaagaac

SEQ ID NO: 40439 - DNA, 20 bp, human
gctggagcggagctatgagc

SEQ ID NO: 40440 - DNA, 20 bp, human
gccgctccaggcagcgcacg

SEQ ID NO: 40441 - DNA, 20 bp, human
ggggcctcaccgaagaaaac

SEQ ID NO: 40442 - DNA, 20 bp, human
ggaagggagaagacccgagt

SEQ ID NO: 40443 - DNA, 20 bp, human
gtagagggccgaagagggaa

SEQ ID NO: 40444 - DNA, 20 bp, human
gcacagtaggtacgccgctg

SEQ ID NO: 40445 - DNA, 20 bp, human
gaggagcctgtccaagcata

SEQ ID NO: 40446 - DNA, 20 bp, human
ggtgtgattactgagaaagt

SEQ ID NO: 40447 - DNA, 20 bp, human
ggacggacttacaatctaaa

SEQ ID NO: 40448 - DNA, 20 bp, human
ggttcatctgaacacttgat

SEQ ID NO: 40449 - DNA, 20 bp, human
gctggtctctgctgtttgag

SEQ ID NO: 40450 - DNA, 20 bp, human
gacaaagctacttgaagtga

SEQ ID NO: 40451 - DNA, 20 bp, human
gatttccttgtctgttttac

SEQ ID NO: 40452 - DNA, 20 bp, human
gacagcaccaagaagctgag

SEQ ID NO: 40453 - DNA, 20 bp, human
gataattacaagactgctga

SEQ ID NO: 40454 - DNA, 20 bp, human
gatttaacacaaaaaagtaa

SEQ ID NO: 40455 - DNA, 20 bp, human
gtttctgctgtctctgttgc

SEQ ID NO: 40456 - DNA, 20 bp, human
gggttgacgtagcccggaag

SEQ ID NO: 40457 - DNA, 20 bp, human
gcaaaaatggtcaaagggta

SEQ ID NO: 40458 - DNA, 20 bp, human
ggaaccgtcgtggggaagga

SEQ ID NO: 40459 - DNA, 20 bp, human
gacaccatccttccccacga

SEQ ID NO: 40460 - DNA, 20 bp, human
gggctaggggaaccgtcgtg

SEQ ID NO: 40461 - DNA, 20 bp, human
gggactgtatggtcgttggg

SEQ ID NO: 40462 - DNA, 20 bp, human
gctgctgctgttgcggctag

SEQ ID NO: 40463 - DNA, 20 bp, human
gagccagtcgcagaaaggga

SEQ ID NO: 40464 - DNA, 20 bp, human
gcaagacagaaaggtgtcgt

SEQ ID NO: 40465 - DNA, 20 bp, human
gggttctagtgtctagcatt

SEQ ID NO: 40466 - DNA, 20 bp, human
ggatctgaaaatgacaacgt

SEQ ID NO: 40467 - DNA, 20 bp, human
ggccatagtcaaacaggtag

SEQ ID NO: 40468 - DNA, 20 bp, human
gtaaggggccatagtcaaac

SEQ ID NO: 40469 - DNA, 20 bp, human
gaaatacactacatagagaa

SEQ ID NO: 40470 - DNA, 20 bp, human
gtatcaggacacaaatttaa

SEQ ID NO: 40471 - DNA, 20 bp, human
gcactacatagagaaaggct

SEQ ID NO: 40472 - DNA, 20 bp, human
gcgtagggacaattaccata

SEQ ID NO: 40473 - DNA, 20 bp, human
ggactatggccccttattac

SEQ ID NO: 40474 - DNA, 20 bp, human
gcaagttataaaagtgacag

SEQ ID NO: 40475 - DNA, 20 bp, human
gaaagaattagccagtaata

SEQ ID NO: 40476 - DNA, 20 bp, human
gttgcggcgttgaggagctg

SEQ ID NO: 40477 - DNA, 20 bp, human
gaacgcgccggcccaactgc

SEQ ID NO: 40478 - DNA, 20 bp, human
gcacagaccttcctgcagtt

SEQ ID NO: 40479 - DNA, 20 bp, human
gccgggtcttacatttaccc

SEQ ID NO: 40480 - DNA, 20 bp, human
gcctggcaagtgaacaatcg

SEQ ID NO: 40481 - DNA, 20 bp, human
gagggcacatagctaatgcc

SEQ ID NO: 40482 - DNA, 20 bp, human
gtgaacaatcgcggtgagag

SEQ ID NO: 40483 - DNA, 20 bp, human
ggaaatggctagggacgggg

SEQ ID NO: 40484 - DNA, 20 bp, human
gtcctcttccggcatctgga

SEQ ID NO: 40485 - DNA, 20 bp, human
gtggagactagaaatggcta

SEQ ID NO: 40486 - DNA, 20 bp, human
gtcatctattgacagaagga

SEQ ID NO: 40487 - DNA, 20 bp, human
gttccacaagtcatagacat

SEQ ID NO: 40488 - DNA, 20 bp, human
gaatgttcaccttgaaataa

SEQ ID NO: 40489 - DNA, 20 bp, human
gtatcactttatcattgata

SEQ ID NO: 40490 - DNA, 20 bp, human
gtatattactttagaatgaa

SEQ ID NO: 40491 - DNA, 20 bp, human
gttcccatgtctatgacttg

SEQ ID NO: 40492 - DNA, 20 bp, human
gaactggataaaagtgcttt

SEQ ID NO: 40493 - DNA, 20 bp, human
gtaccagtggtttccagagc

SEQ ID NO: 40494 - DNA, 20 bp, human
gttaaaacatacagctatat

SEQ ID NO: 40495 - DNA, 20 bp, human
gcaaatacttcatcctgctc

SEQ ID NO: 40496 - DNA, 20 bp, human
gggacacgaacgaggctcgg

SEQ ID NO: 40497 - DNA, 20 bp, human
gcttcacactggagaggtaa

SEQ ID NO: 40498 - DNA, 20 bp, human
gctcccaggaaacttcacac

SEQ ID NO: 40499 - DNA, 20 bp, human
gcacgaacgaggctcggcgg

SEQ ID NO: 40500 - DNA, 20 bp, human
gaggggcggggacacgaacg

SEQ ID NO: 40501 - DNA, 20 bp, human
gtagctgcaggagcgagggg

SEQ ID NO: 40502 - DNA, 20 bp, human
gagaggtgagccaaaccgga

SEQ ID NO: 40503 - DNA, 20 bp, human
gctctgcggctccctcaacc

SEQ ID NO: 40504 - DNA, 20 bp, human
gtctgcgcgtactggctgta

SEQ ID NO: 40505 - DNA, 20 bp, human
ggagcgtccgggggcgacgt

SEQ ID NO: 40506 - DNA, 20 bp, human
gtcgcatcccagggcgtctc

SEQ ID NO: 40507 - DNA, 20 bp, human
ggacgccctgggatgcgagt

SEQ ID NO: 40508 - DNA, 20 bp, human
gggcacccactcgcatccca

SEQ ID NO: 40509 - DNA, 20 bp, human
gggagcagccggagacgccc

SEQ ID NO: 40510 - DNA, 20 bp, human
gagcgagcagacagctcaat

SEQ ID NO: 40511 - DNA, 20 bp, human
gctagtgaactgcacgagga

SEQ ID NO: 40512 - DNA, 20 bp, human
gacagctcaataggagcagc

SEQ ID NO: 40513 - DNA, 20 bp, human
gagagagtaaacagcctcta

SEQ ID NO: 40514 - DNA, 20 bp, human
gccgagaagctggaataact

SEQ ID NO: 40515 - DNA, 20 bp, human
gctcccgcgtccagcagacg

SEQ ID NO: 40516 - DNA, 20 bp, human
gctcgagagcggaccctcgg

SEQ ID NO: 40517 - DNA, 20 bp, human
gccggagccggtccgctggg

SEQ ID NO: 40518 - DNA, 20 bp, human
gcgcccgccgcccagcggac

SEQ ID NO: 40519 - DNA, 20 bp, human
gacagcagcgcccgaaatgg

SEQ ID NO: 40520 - DNA, 20 bp, human
gcggtgagggactgacggga

SEQ ID NO: 40521 - DNA, 20 bp, human
ggctggctggtcctcgagag

SEQ ID NO: 40522 - DNA, 20 bp, human
ggcagcgcccgaaatggcgg

SEQ ID NO: 40523 - DNA, 20 bp, human
gcgcccggtgagggactgac

SEQ ID NO: 40524 - DNA, 20 bp, human
gagccaggctgggagttccg

SEQ ID NO: 40525 - DNA, 20 bp, human
ggcggaccctcgggggtcgt

SEQ ID NO: 40526 - DNA, 20 bp, human
gagccacagcaacaaaatgg

SEQ ID NO: 40527 - DNA, 20 bp, human
gctgggcaaaagcaccccgg

SEQ ID NO: 40528 - DNA, 20 bp, human
ggagcagcccgagaaccccg

SEQ ID NO: 40529 - DNA, 20 bp, human
gcacgaggcaccgaactcga

SEQ ID NO: 40530 - DNA, 20 bp, human
gtggctattgggaacaagct

SEQ ID NO: 40531 - DNA, 20 bp, human
ggactctgcggcggtagggg

SEQ ID NO: 40532 - DNA, 20 bp, human
gagagccgcccgggaatgca

SEQ ID NO: 40533 - DNA, 20 bp, human
gtggaccggggactctgcgg

SEQ ID NO: 40534 - DNA, 20 bp, human
gaagctgggcaaaagcaccc

SEQ ID NO: 40535 - DNA, 20 bp, human
gtgctctgcacgccttagcc

SEQ ID NO: 40536 - DNA, 20 bp, human
ggcgcggaagcaggactctc

SEQ ID NO: 40537 - DNA, 20 bp, human
gtcgctgggcgcggacgcgg

SEQ ID NO: 40538 - DNA, 20 bp, human
gctggacggccggggaacaa

SEQ ID NO: 40539 - DNA, 20 bp, human
gtggggcgccgggtactcac

SEQ ID NO: 40540 - DNA, 20 bp, human
ggcccgaggccctgttacct

SEQ ID NO: 40541 - DNA, 20 bp, human
gccgtgtgccccgcaggtga

SEQ ID NO: 40542 - DNA, 20 bp, human
gtactcacgggctcctgatc

SEQ ID NO: 40543 - DNA, 20 bp, human
gacgtcgctgggcgcggacg

SEQ ID NO: 40544 - DNA, 20 bp, human
ggcaggtgagggcgccccga

SEQ ID NO: 40545 - DNA, 20 bp, human
gcggctgctcagacttgctc

SEQ ID NO: 40546 - DNA, 20 bp, human
gcagcctcccagcagaaaga

SEQ ID NO: 40547 - DNA, 20 bp, human
ggtggagagtgaggtcctca

SEQ ID NO: 40548 - DNA, 20 bp, human
gtcctgtttcaggcatgggg

SEQ ID NO: 40549 - DNA, 20 bp, human
ggccgccccatgcctgaaac

SEQ ID NO: 40550 - DNA, 20 bp, human
ggggcggctggttctgctgt

SEQ ID NO: 40551 - DNA, 20 bp, human
ggagctgccgtctttctgct

SEQ ID NO: 40552 - DNA, 20 bp, human
ggatagatgagatacattga

SEQ ID NO: 40553 - DNA, 20 bp, human
gtgttcgttgtaggtccctg

SEQ ID NO: 40554 - DNA, 20 bp, human
gggatggctttggggcaagg

SEQ ID NO: 40555 - DNA, 20 bp, human
gccactcctgtttcaggcat

SEQ ID NO: 40556 - DNA, 20 bp, human
gccgcgcggccagatgaggg

SEQ ID NO: 40557 - DNA, 20 bp, human
gcggagggccacacccacag

SEQ ID NO: 40558 - DNA, 20 bp, human
gggccggcgaaacctagcgc

SEQ ID NO: 40559 - DNA, 20 bp, human
gggaggcgcccggtgcagtc

SEQ ID NO: 40560 - DNA, 20 bp, human
gtgcaccgggcgcctccaag

SEQ ID NO: 40561 - DNA, 20 bp, human
ggaggcccgcgagaacgtgg

SEQ ID NO: 40562 - DNA, 20 bp, human
gcggccgcgcggccagatga

SEQ ID NO: 40563 - DNA, 20 bp, human
ggtctgggaacggggaaggt

SEQ ID NO: 40564 - DNA, 20 bp, human
gaggagcgttcactaaactg

SEQ ID NO: 40565 - DNA, 20 bp, human
gggagttggggaggtcgtaa

SEQ ID NO: 40566 - DNA, 20 bp, human
gggtgtgtaaagtagtatgg

SEQ ID NO: 40567 - DNA, 20 bp, human
gcggcaaccactcagacact

SEQ ID NO: 40568 - DNA, 20 bp, human
gtaaagtagtatggaggcag

SEQ ID NO: 40569 - DNA, 20 bp, human
gagtggttgccgggtctcca

SEQ ID NO: 40570 - DNA, 20 bp, human
gctggtacgtaccgatgagg

SEQ ID NO: 40571 - DNA, 20 bp, human
gctggcgagccgcttctcca

SEQ ID NO: 40572 - DNA, 20 bp, human
gagcctggtacgtaccgatg

SEQ ID NO: 40573 - DNA, 20 bp, human
gccgctgccgaagccccggg

SEQ ID NO: 40574 - DNA, 20 bp, human
gccgcttctccatggagacc

SEQ ID NO: 40575 - DNA, 20 bp, human
gcgcgccgcggggtctcggg

SEQ ID NO: 40576 - DNA, 20 bp, human
ggccgcgcgtgggcatccac

SEQ ID NO: 40577 - DNA, 20 bp, human
gcgctgacaaaggcccggga

SEQ ID NO: 40578 - DNA, 20 bp, human
gctgccagcaccgcccggat

SEQ ID NO: 40579 - DNA, 20 bp, human
gccctcctcgccgatccggg

SEQ ID NO: 40580 - DNA, 20 bp, human
ggggatagagacacggacgg

SEQ ID NO: 40581 - DNA, 20 bp, human
gagccggggcagccgcgcgt

SEQ ID NO: 40582 - DNA, 20 bp, human
gcggcagggtccagatccac

SEQ ID NO: 40583 - DNA, 20 bp, human
gggcgcgctgacaaaggccc

SEQ ID NO: 40584 - DNA, 20 bp, human
gagggggccatgtcgtacca

SEQ ID NO: 40585 - DNA, 20 bp, human
gctctggcacatcccgtggg

SEQ ID NO: 40586 - DNA, 20 bp, human
gccgccgcaggcccgcaccg

SEQ ID NO: 40587 - DNA, 20 bp, human
gccccgcgccagaagtacgg

SEQ ID NO: 40588 - DNA, 20 bp, human
gcgcgactgcggcccaggga

SEQ ID NO: 40589 - DNA, 20 bp, human
ggcaggcccgcaccgaggcg

SEQ ID NO: 40590 - DNA, 20 bp, human
gacaatggccaggtaccctc

SEQ ID NO: 40591 - DNA, 20 bp, human
gtcccggagagcgcgacgag

SEQ ID NO: 40592 - DNA, 20 bp, human
gggccattgtcccggccgag

SEQ ID NO: 40593 - DNA, 20 bp, human
gagaccccgcgccagaagta

SEQ ID NO: 40594 - DNA, 20 bp, human
gggcggcggatgcgcagcgt

SEQ ID NO: 40595 - DNA, 20 bp, human
gtcgtaggcgccctccaccg

SEQ ID NO: 40596 - DNA, 20 bp, human
gcggcacggacgctagaaat

SEQ ID NO: 40597 - DNA, 20 bp, human
gcccaacccgggcaccctca

SEQ ID NO: 40598 - DNA, 20 bp, human
ggaacactctctcccaaccc

SEQ ID NO: 40599 - DNA, 20 bp, human
ggccggggacaggtgtccag

SEQ ID NO: 40600 - DNA, 20 bp, human
gaggatctcggaaccggaag

SEQ ID NO: 40601 - DNA, 20 bp, human
gggctcaagcgagaggtcaa

SEQ ID NO: 40602 - DNA, 20 bp, human
ggccatgggcgtgaataagg

SEQ ID NO: 40603 - DNA, 20 bp, human
gtcagggtgagccttctccc

SEQ ID NO: 40604 - DNA, 20 bp, human
gcagaaaacaaacaggatct

SEQ ID NO: 40605 - DNA, 20 bp, human
gacaaacaggatctcggaac

SEQ ID NO: 40606 - DNA, 20 bp, human
gccaggtgggatgaaacaag

SEQ ID NO: 40607 - DNA, 20 bp, human
gacttacctaatgcccaggt

SEQ ID NO: 40608 - DNA, 20 bp, human
gtcaccctggtgtaggagag

SEQ ID NO: 40609 - DNA, 20 bp, human
gggggacttacctaatgccc

SEQ ID NO: 40610 - DNA, 20 bp, human
gattcccctctcctacacca

SEQ ID NO: 40611 - DNA, 20 bp, human
ggaaagaggtttcttatgag

SEQ ID NO: 40612 - DNA, 20 bp, human
gctgatccaggaaggcacat

SEQ ID NO: 40613 - DNA, 20 bp, human
gctctcactgggaaactgtg

SEQ ID NO: 40614 - DNA, 20 bp, human
gctaaatatcaccctggtgt

SEQ ID NO: 40615 - DNA, 20 bp, human
gaggagagcatgtttcccaa

SEQ ID NO: 40616 - DNA, 20 bp, human
gaactcccaaaccccactgg

SEQ ID NO: 40617 - DNA, 20 bp, human
ggtcttggggatcaaggggt

SEQ ID NO: 40618 - DNA, 20 bp, human
gttagggcttgggggacctc

SEQ ID NO: 40619 - DNA, 20 bp, human
gtagggtcggaaccggattg

SEQ ID NO: 40620 - DNA, 20 bp, human
gtgtgcgtcttggggatcaa

SEQ ID NO: 40621 - DNA, 20 bp, human
gttccgaccctagatggatg

SEQ ID NO: 40622 - DNA, 20 bp, human
gatcctcatccatctagggt

SEQ ID NO: 40623 - DNA, 20 bp, human
gccagatcctcatccatcta

SEQ ID NO: 40624 - DNA, 20 bp, human
gggattggggcccccaacac

SEQ ID NO: 40625 - DNA, 20 bp, human
ggaggatctggctatgccag

SEQ ID NO: 40626 - DNA, 20 bp, human
ggcacctttgaggcccaagg

SEQ ID NO: 40627 - DNA, 20 bp, human
gtccattagacgggttcaaa

SEQ ID NO: 40628 - DNA, 20 bp, human
ggctcccccttgggcctcaa

SEQ ID NO: 40629 - DNA, 20 bp, human
ggagggcaatgagagctcgg

SEQ ID NO: 40630 - DNA, 20 bp, human
ggcaccggctcgctccccct

SEQ ID NO: 40631 - DNA, 20 bp, human
ggcgggcggtgaggacggac

SEQ ID NO: 40632 - DNA, 20 bp, human
gtaacaggttcgtcgcagag

SEQ ID NO: 40633 - DNA, 20 bp, human
ggttcgtcgcagagtggcaa

SEQ ID NO: 40634 - DNA, 20 bp, human
gccccgagttgaaggattag

SEQ ID NO: 40635 - DNA, 20 bp, human
gggtctcaggggtaccctca

SEQ ID NO: 40636 - DNA, 20 bp, human
ggcaggaggaggtagctcta

SEQ ID NO: 40637 - DNA, 20 bp, human
gtattcggctgaaagttcag

SEQ ID NO: 40638 - DNA, 20 bp, human
gctggctcacagacatgtcg

SEQ ID NO: 40639 - DNA, 20 bp, human
gtataaatccaggcaggagg

SEQ ID NO: 40640 - DNA, 20 bp, human
gaggcctgcaatgcatatag

SEQ ID NO: 40641 - DNA, 20 bp, human
gcctgctgccagtgatacaa

SEQ ID NO: 40642 - DNA, 20 bp, human
ggactgtatgaacagaacag

SEQ ID NO: 40643 - DNA, 20 bp, human
gggtgctttgagggatacat

SEQ ID NO: 40644 - DNA, 20 bp, human
gaagctgggagtccgcctca

SEQ ID NO: 40645 - DNA, 20 bp, human
gctggccaaaagcatgagag

SEQ ID NO: 40646 - DNA, 20 bp, human
gcagctggcagagaaagtgt

SEQ ID NO: 40647 - DNA, 20 bp, human
gaccggtgccccccacccta

SEQ ID NO: 40648 - DNA, 20 bp, human
gactggaggtcagctgtcag

SEQ ID NO: 40649 - DNA, 20 bp, human
gtgctcccagccccggtccc

SEQ ID NO: 40650 - DNA, 20 bp, human
gaagcgagcgcgcggcgtcg

SEQ ID NO: 40651 - DNA, 20 bp, human
gggtgccccccaccctaagg

SEQ ID NO: 40652 - DNA, 20 bp, human
gtctcggccccgccgcctag

SEQ ID NO: 40653 - DNA, 20 bp, human
gaggtgggagctgatgtgtg

SEQ ID NO: 40654 - DNA, 20 bp, human
gcgcttcccacgcccctagg

SEQ ID NO: 40655 - DNA, 20 bp, human
ggagcgcgcggcgtcggggc

SEQ ID NO: 40656 - DNA, 20 bp, human
gagtacatcggagattgaca

SEQ ID NO: 40657 - DNA, 20 bp, human
gacggaagattctagtacat

SEQ ID NO: 40658 - DNA, 20 bp, human
gagtatgtcaagaagccgag

SEQ ID NO: 40659 - DNA, 20 bp, human
gagtgggtgacacttaccgg

SEQ ID NO: 40660 - DNA, 20 bp, human
gttcactttagtctcagtaa

SEQ ID NO: 40661 - DNA, 20 bp, human
gctaaatcaaggagggacaa

SEQ ID NO: 40662 - DNA, 20 bp, human
gacttaccggtggtcaagtc

SEQ ID NO: 40663 - DNA, 20 bp, human
gaagatcctgacttgaccac

SEQ ID NO: 40664 - DNA, 20 bp, human
ggaggtaactaaatcaagga

SEQ ID NO: 40665 - DNA, 20 bp, human
gggcagaaaggtcaagaaaa

SEQ ID NO: 40666 - DNA, 20 bp, human
gacgcgctggacaagtacag

SEQ ID NO: 40667 - DNA, 20 bp, human
ggcgcagcaggcccccgaag

SEQ ID NO: 40668 - DNA, 20 bp, human
gcgcccggcgaaaggaagga

SEQ ID NO: 40669 - DNA, 20 bp, human
gcgaactgcaggaacttgta

SEQ ID NO: 40670 - DNA, 20 bp, human
gagcactgggccgagagcgt

SEQ ID NO: 40671 - DNA, 20 bp, human
ggctgggactggcggaaggc

SEQ ID NO: 40672 - DNA, 20 bp, human
gtagcagcgccgcggccccc

SEQ ID NO: 40673 - DNA, 20 bp, human
ggccgggcgcgatggagccg

SEQ ID NO: 40674 - DNA, 20 bp, human
gatcgcgcccggcgaaagga

SEQ ID NO: 40675 - DNA, 20 bp, human
gcaggaacttgtagggctcg

SEQ ID NO: 40676 - DNA, 20 bp, human
gcccctgtcaggtaacgacg

SEQ ID NO: 40677 - DNA, 20 bp, human
gctgcatcactgctccccgg

SEQ ID NO: 40678 - DNA, 20 bp, human
ggaggcccctgtctcctccg

SEQ ID NO: 40679 - DNA, 20 bp, human
gggcgacttcgaacaatccg

SEQ ID NO: 40680 - DNA, 20 bp, human
gctgcacaatcagaagcagg

SEQ ID NO: 40681 - DNA, 20 bp, human
gcctcgggtaacaatgatgt

SEQ ID NO: 40682 - DNA, 20 bp, human
gcacaatcagaagcaggcgg

SEQ ID NO: 40683 - DNA, 20 bp, human
gagggcacctgtaccccatc

SEQ ID NO: 40684 - DNA, 20 bp, human
gtcttctcgctgaatttccg

SEQ ID NO: 40685 - DNA, 20 bp, human
ggcgctgcacaatcagaagc

SEQ ID NO: 40686 - DNA, 20 bp, human
gccccgcgcgcaacaggtca

SEQ ID NO: 40687 - DNA, 20 bp, human
gacctgcgcctcccaaacgg

SEQ ID NO: 40688 - DNA, 20 bp, human
gggagaccgaaacaccggag

SEQ ID NO: 40689 - DNA, 20 bp, human
gtacggagcggagaccggag

SEQ ID NO: 40690 - DNA, 20 bp, human
ggggttcgcggtgctcgctg

SEQ ID NO: 40691 - DNA, 20 bp, human
gagcggtgctgtgtatagtg

SEQ ID NO: 40692 - DNA, 20 bp, human
ggcggtgctcgctgaggcgg

SEQ ID NO: 40693 - DNA, 20 bp, human
gcctcgaggggactccgtca

SEQ ID NO: 40694 - DNA, 20 bp, human
gttcgcggtgctcgctgagg

SEQ ID NO: 40695 - DNA, 20 bp, human
ggccgcggctggtactggga

SEQ ID NO: 40696 - DNA, 20 bp, human
gggccgcgcccgggaaccgg

SEQ ID NO: 40697 - DNA, 20 bp, human
gcggccccggagccagcgag

SEQ ID NO: 40698 - DNA, 20 bp, human
gccgcccgaagccagtcgtc

SEQ ID NO: 40699 - DNA, 20 bp, human
gccagtcgtccggcgcgacc

SEQ ID NO: 40700 - DNA, 20 bp, human
gcggcggcctgtggacggac

SEQ ID NO: 40701 - DNA, 20 bp, human
ggccccgtgtgcgggaagat

SEQ ID NO: 40702 - DNA, 20 bp, human
gggcctgtggacggacgggt

SEQ ID NO: 40703 - DNA, 20 bp, human
gcgcgatcccgggctgaggt

SEQ ID NO: 40704 - DNA, 20 bp, human
gcctcacccgcgacagggtg

SEQ ID NO: 40705 - DNA, 20 bp, human
gggcccacccgtccgtccac

SEQ ID NO: 40706 - DNA, 20 bp, human
ggcccaggacctagacagag

SEQ ID NO: 40707 - DNA, 20 bp, human
gccttcagaaaggagggacg

SEQ ID NO: 40708 - DNA, 20 bp, human
gacgctcaccttcagaaagg

SEQ ID NO: 40709 - DNA, 20 bp, human
gaggtgagcgtctgcaggag

SEQ ID NO: 40710 - DNA, 20 bp, human
ggccgctctgtctaggtcct

SEQ ID NO: 40711 - DNA, 20 bp, human
gccaacagagcggtatgctg

SEQ ID NO: 40712 - DNA, 20 bp, human
gtgtctaggtcctgggccac

SEQ ID NO: 40713 - DNA, 20 bp, human
gattgcagcaggagggagta

SEQ ID NO: 40714 - DNA, 20 bp, human
gcaagccctgacggcatccg

SEQ ID NO: 40715 - DNA, 20 bp, human
ggcttctcaccgtggttcta

SEQ ID NO: 40716 - DNA, 20 bp, human
gcagcctcgggaccggtcac

SEQ ID NO: 40717 - DNA, 20 bp, human
ggagaaaggaccgggaacgg

SEQ ID NO: 40718 - DNA, 20 bp, human
ggaccgggaacggaggctag

SEQ ID NO: 40719 - DNA, 20 bp, human
gccggccggcaaccgtccag

SEQ ID NO: 40720 - DNA, 20 bp, human
gccggggcgtgaggaaaggg

SEQ ID NO: 40721 - DNA, 20 bp, human
gctcgggaccggtcaccggc

SEQ ID NO: 40722 - DNA, 20 bp, human
gggtggtcgaggccgctgga

SEQ ID NO: 40723 - DNA, 20 bp, human
gaggctagaggcggtggtcg

SEQ ID NO: 40724 - DNA, 20 bp, human
gggcgcagtggaaagatgaa

SEQ ID NO: 40725 - DNA, 20 bp, human
gtcggcccgggagaaaggac

SEQ ID NO: 40726 - DNA, 20 bp, human
gggagcagtctggacagtca

SEQ ID NO: 40727 - DNA, 20 bp, human
gacagtcatggcggcgactg

SEQ ID NO: 40728 - DNA, 20 bp, human
ggcagttgtgaggctcaaag

SEQ ID NO: 40729 - DNA, 20 bp, human
gcggaaccagtgcaccgaag

SEQ ID NO: 40730 - DNA, 20 bp, human
gcgttccacaggcagttgtg

SEQ ID NO: 40731 - DNA, 20 bp, human
ggaagaggcgctgtccgtgc

SEQ ID NO: 40732 - DNA, 20 bp, human
gggaggaggccgcgaaccac

SEQ ID NO: 40733 - DNA, 20 bp, human
gtgcgaacgcgctttgtcag

SEQ ID NO: 40734 - DNA, 20 bp, human
gatggaggtgaggggacccg

SEQ ID NO: 40735 - DNA, 20 bp, human
gctcagtcgggatcaaccga

SEQ ID NO: 40736 - DNA, 20 bp, human
gcagggtgcgcttgaaccag

SEQ ID NO: 40737 - DNA, 20 bp, human
gtgatggtggacgacaggaa

SEQ ID NO: 40738 - DNA, 20 bp, human
gaggagtcagcggggcctct

SEQ ID NO: 40739 - DNA, 20 bp, human
gctgccacgtggctgcagtg

SEQ ID NO: 40740 - DNA, 20 bp, human
gcacggtgcggaagagggac

SEQ ID NO: 40741 - DNA, 20 bp, human
ggagggactggcggtagtag

SEQ ID NO: 40742 - DNA, 20 bp, human
gggtgcggaagagggactgg

SEQ ID NO: 40743 - DNA, 20 bp, human
ggcctctgggcagcgcagtg

SEQ ID NO: 40744 - DNA, 20 bp, human
gtccgcaccgtgctggactc

SEQ ID NO: 40745 - DNA, 20 bp, human
gagagcttcccctggcactg

SEQ ID NO: 40746 - DNA, 20 bp, human
gaccctcagggccagctgag

SEQ ID NO: 40747 - DNA, 20 bp, human
gagcccaggcactgagaggt

SEQ ID NO: 40748 - DNA, 20 bp, human
gaggggctgaatgctactgg

SEQ ID NO: 40749 - DNA, 20 bp, human
ggacctgtctccaaaccctc

SEQ ID NO: 40750 - DNA, 20 bp, human
ggcccctcagctggccctga

SEQ ID NO: 40751 - DNA, 20 bp, human
gctgaatgctactggtgggc

SEQ ID NO: 40752 - DNA, 20 bp, human
gctgaggggctgaatgctac

SEQ ID NO: 40753 - DNA, 20 bp, human
gagcagggacggcaccctct

SEQ ID NO: 40754 - DNA, 20 bp, human
ggttgggcgcgaggacaagg

SEQ ID NO: 40755 - DNA, 20 bp, human
gatgctactggtgggccggc

SEQ ID NO: 40756 - DNA, 20 bp, human
gtggatggcgatgtccatgg

SEQ ID NO: 40757 - DNA, 20 bp, human
ggaaggggcggcggatccag

SEQ ID NO: 40758 - DNA, 20 bp, human
gggtggctaggtgagtgtga

SEQ ID NO: 40759 - DNA, 20 bp, human
gggggcggcggatccagggg

SEQ ID NO: 40760 - DNA, 20 bp, human
gtggtggatggcgatgtcca

SEQ ID NO: 40761 - DNA, 20 bp, human
gtagagaagttaggggacgg

SEQ ID NO: 40762 - DNA, 20 bp, human
gtatcctgtagagaagttag

SEQ ID NO: 40763 - DNA, 20 bp, human
gctgtagagaagttagggga

SEQ ID NO: 40764 - DNA, 20 bp, human
gcggatccaggggtggtgga

SEQ ID NO: 40765 - DNA, 20 bp, human
ggtctccccacagctaggac

SEQ ID NO: 40766 - DNA, 20 bp, human
gagggctcgataggaggtgg

SEQ ID NO: 40767 - DNA, 20 bp, human
gccagctgcccggagagcca

SEQ ID NO: 40768 - DNA, 20 bp, human
gagagccagggctcgatagg

SEQ ID NO: 40769 - DNA, 20 bp, human
gcggagagccagggctcgat

SEQ ID NO: 40770 - DNA, 20 bp, human
ggggacaaggaggcacaccc

SEQ ID NO: 40771 - DNA, 20 bp, human
ggccagggctcgataggagg

SEQ ID NO: 40772 - DNA, 20 bp, human
gacccaggccggcaaagagc

SEQ ID NO: 40773 - DNA, 20 bp, human
ggctgacctcaagacacact

SEQ ID NO: 40774 - DNA, 20 bp, human
gcagcgcttcggagaaggta

SEQ ID NO: 40775 - DNA, 20 bp, human
ggctctccgggcagctggag

SEQ ID NO: 40776 - DNA, 20 bp, human
gagcaggagctgggtgagta

SEQ ID NO: 40777 - DNA, 20 bp, human
gtggtaccagatggagaccc

SEQ ID NO: 40778 - DNA, 20 bp, human
ggagaactgggccctctcct

SEQ ID NO: 40779 - DNA, 20 bp, human
gacgagcagggagaaggtat

SEQ ID NO: 40780 - DNA, 20 bp, human
gcccccagccttagttgcta

SEQ ID NO: 40781 - DNA, 20 bp, human
gctgggtgagtaaggccctc

SEQ ID NO: 40782 - DNA, 20 bp, human
gctagaaggctctacacact

SEQ ID NO: 40783 - DNA, 20 bp, human
gaccactgccctagcaacta

SEQ ID NO: 40784 - DNA, 20 bp, human
gcagagcaagtggtaccaga

SEQ ID NO: 40785 - DNA, 20 bp, human
gcacactaggcaggagaact

SEQ ID NO: 40786 - DNA, 20 bp, human
gcagagggcattcaccgggt

SEQ ID NO: 40787 - DNA, 20 bp, human
gcccagcagagggcattcac

SEQ ID NO: 40788 - DNA, 20 bp, human
ggcacgcgagggaaatggac

SEQ ID NO: 40789 - DNA, 20 bp, human
gcccagggtgcgctcggtca

SEQ ID NO: 40790 - DNA, 20 bp, human
gtagcggatgaagaacccgg

SEQ ID NO: 40791 - DNA, 20 bp, human
gcctcaacccagcccagccg

SEQ ID NO: 40792 - DNA, 20 bp, human
gtgaggctctgagcctaggc

SEQ ID NO: 40793 - DNA, 20 bp, human
gatgccgctgcggacaggaa

SEQ ID NO: 40794 - DNA, 20 bp, human
ggctcggtcaaggtggaaaa

SEQ ID NO: 40795 - DNA, 20 bp, human
ggagcgcggaggcctgccca

SEQ ID NO: 40796 - DNA, 20 bp, human
ggacagcacctagctcaaag

SEQ ID NO: 40797 - DNA, 20 bp, human
gtctcggtaagtcccaggtt

SEQ ID NO: 40798 - DNA, 20 bp, human
ggcctatctcggtaagtccc

SEQ ID NO: 40799 - DNA, 20 bp, human
gggtgacagatggaaaggac

SEQ ID NO: 40800 - DNA, 20 bp, human
gacccaggtccccagtccta

SEQ ID NO: 40801 - DNA, 20 bp, human
gtctgagaccagccgaggtc

SEQ ID NO: 40802 - DNA, 20 bp, human
ggataagagaatacagagtg

SEQ ID NO: 40803 - DNA, 20 bp, human
gtaagtcccaggtttggagg

SEQ ID NO: 40804 - DNA, 20 bp, human
gacttaccgagataggccca

SEQ ID NO: 40805 - DNA, 20 bp, human
gatgttccctgggcctatct

SEQ ID NO: 40806 - DNA, 20 bp, human
gcatcaggccctatagtctg

SEQ ID NO: 40807 - DNA, 20 bp, human
gcaggaagtagcaagtcccc

SEQ ID NO: 40808 - DNA, 20 bp, human
gcaggcagataggcagaaag

SEQ ID NO: 40809 - DNA, 20 bp, human
gaatgagggagagatagtgg

SEQ ID NO: 40810 - DNA, 20 bp, human
gctacttcctgctggaggac

SEQ ID NO: 40811 - DNA, 20 bp, human
gtatagtctgtggcacaaag

SEQ ID NO: 40812 - DNA, 20 bp, human
gaagtaagaaacagatagag

SEQ ID NO: 40813 - DNA, 20 bp, human
gtgccagactataaaatggg

SEQ ID NO: 40814 - DNA, 20 bp, human
gtacaatgagggagagatag

SEQ ID NO: 40815 - DNA, 20 bp, human
ggtgggttccctcttacctg

SEQ ID NO: 40816 - DNA, 20 bp, human
gagcttcacggcactcgcag

SEQ ID NO: 40817 - DNA, 20 bp, human
gctagcctctgggagtgcta

SEQ ID NO: 40818 - DNA, 20 bp, human
gctccacatctgcaattagg

SEQ ID NO: 40819 - DNA, 20 bp, human
gctcccatgcttgcggacag

SEQ ID NO: 40820 - DNA, 20 bp, human
gatgcttgcggacaggggtg

SEQ ID NO: 40821 - DNA, 20 bp, human
ggggacctgtcacatacctg

SEQ ID NO: 40822 - DNA, 20 bp, human
ggtgaagctcggccagcggg

SEQ ID NO: 40823 - DNA, 20 bp, human
gtctgggagtgctaggggat

SEQ ID NO: 40824 - DNA, 20 bp, human
gaggaggagaatgtaactga

SEQ ID NO: 40825 - DNA, 20 bp, human
gcactctgtgcctagcctct

SEQ ID NO: 40826 - DNA, 20 bp, human
gctagcctcagcaggaaaca

SEQ ID NO: 40827 - DNA, 20 bp, human
gtggccgtgctgggagccgt

SEQ ID NO: 40828 - DNA, 20 bp, human
ggcccacatactctggatgt

SEQ ID NO: 40829 - DNA, 20 bp, human
gggctcctctgttcttcccg

SEQ ID NO: 40830 - DNA, 20 bp, human
gggcccacatccagagtatg

SEQ ID NO: 40831 - DNA, 20 bp, human
gagacaggcgagtctgcaga

SEQ ID NO: 40832 - DNA, 20 bp, human
gctgcacagcccacatactc

SEQ ID NO: 40833 - DNA, 20 bp, human
gccgcaggctgtgcatggtt

SEQ ID NO: 40834 - DNA, 20 bp, human
ggccctaagcacatgtccag

SEQ ID NO: 40835 - DNA, 20 bp, human
gaacctgttgctgtagcctc

SEQ ID NO: 40836 - DNA, 20 bp, human
gcattaagtaaggattatga

SEQ ID NO: 40837 - DNA, 20 bp, human
gtatccccaggttgaaaatc

SEQ ID NO: 40838 - DNA, 20 bp, human
gtcagaaatgttcttatcag

SEQ ID NO: 40839 - DNA, 20 bp, human
gaaatgggagacaatgctaa

SEQ ID NO: 40840 - DNA, 20 bp, human
ggacttcctacatatttcag

SEQ ID NO: 40841 - DNA, 20 bp, human
gacttgtcctcctcttgaag

SEQ ID NO: 40842 - DNA, 20 bp, human
ggaaatgttcttatcagtgg

SEQ ID NO: 40843 - DNA, 20 bp, human
gcatatcccctgaaatatgt

SEQ ID NO: 40844 - DNA, 20 bp, human
gataatccttacttaatgta

SEQ ID NO: 40845 - DNA, 20 bp, human
gcttttgtctagtcttactg

SEQ ID NO: 40846 - DNA, 20 bp, human
gcatggcacagcacctccac

SEQ ID NO: 40847 - DNA, 20 bp, human
gcacagacccccaatagaca

SEQ ID NO: 40848 - DNA, 20 bp, human
gactccatccgagtagacag

SEQ ID NO: 40849 - DNA, 20 bp, human
gcctcgtagaaggtgatctg

SEQ ID NO: 40850 - DNA, 20 bp, human
gcatggggaaggtgagcctg

SEQ ID NO: 40851 - DNA, 20 bp, human
gtagtatgatagggacaaag

SEQ ID NO: 40852 - DNA, 20 bp, human
gccccatggttgttgacaga

SEQ ID NO: 40853 - DNA, 20 bp, human
gaccctctgtcaacaaccat

SEQ ID NO: 40854 - DNA, 20 bp, human
ggctgtgccatgtctattgg

SEQ ID NO: 40855 - DNA, 20 bp, human
ggaagtagacccgcaggttg

SEQ ID NO: 40856 - DNA, 20 bp, human
gaatgggaaaggtaagtcct

SEQ ID NO: 40857 - DNA, 20 bp, human
gaatgcagtggcctcagtgg

SEQ ID NO: 40858 - DNA, 20 bp, human
gagccttggccctaatgcag

SEQ ID NO: 40859 - DNA, 20 bp, human
ggggccaccagtacttcctg

SEQ ID NO: 40860 - DNA, 20 bp, human
gcacactcaccggggggatg

SEQ ID NO: 40861 - DNA, 20 bp, human
ggacagagccacactcaccg

SEQ ID NO: 40862 - DNA, 20 bp, human
gtgtgggagcatggagtgat

SEQ ID NO: 40863 - DNA, 20 bp, human
gctggtggccctggtagttg

SEQ ID NO: 40864 - DNA, 20 bp, human
ggcggctgaaatagggttgt

SEQ ID NO: 40865 - DNA, 20 bp, human
ggaaatagggttgtaggttg

SEQ ID NO: 40866 - DNA, 20 bp, human
gaatacagtggggactctgg

SEQ ID NO: 40867 - DNA, 20 bp, human
gtccccatggctggttgaca

SEQ ID NO: 40868 - DNA, 20 bp, human
gacacaaaaggggccctcag

SEQ ID NO: 40869 - DNA, 20 bp, human
gtccgtgtcaaccagccatg

SEQ ID NO: 40870 - DNA, 20 bp, human
ggtcaatgtgggttacaggg

SEQ ID NO: 40871 - DNA, 20 bp, human
ggccatcctgctatatagac

SEQ ID NO: 40872 - DNA, 20 bp, human
gattgtcaatgtgggttaca

SEQ ID NO: 40873 - DNA, 20 bp, human
gtgatgtccatctaaccctt

SEQ ID NO: 40874 - DNA, 20 bp, human
gcccacattgacaatacagt

SEQ ID NO: 40875 - DNA, 20 bp, human
gggggactctggcggcatga

SEQ ID NO: 40876 - DNA, 20 bp, human
gtgaggatgtactcacgtgg

SEQ ID NO: 40877 - DNA, 20 bp, human
gccgcgatggaggaagctcc

SEQ ID NO: 40878 - DNA, 20 bp, human
gagtcaggacccaggccctc

SEQ ID NO: 40879 - DNA, 20 bp, human
ggggcctgggtcctgacttg

SEQ ID NO: 40880 - DNA, 20 bp, human
ggtgagtacatcctcaagtc

SEQ ID NO: 40881 - DNA, 20 bp, human
gcatccagtgagtgtcctga

SEQ ID NO: 40882 - DNA, 20 bp, human
gcatcgcgggggccagagac

SEQ ID NO: 40883 - DNA, 20 bp, human
gcagtcacaataactgagag

SEQ ID NO: 40884 - DNA, 20 bp, human
gaggccctcaggacactcac

SEQ ID NO: 40885 - DNA, 20 bp, human
gtgcaaggcaaggcgggaca

SEQ ID NO: 40886 - DNA, 20 bp, human
ggaggctcgggagctaaacg

SEQ ID NO: 40887 - DNA, 20 bp, human
gagctaaacgcggagagcac

SEQ ID NO: 40888 - DNA, 20 bp, human
ggtgtccctgaagagaccct

SEQ ID NO: 40889 - DNA, 20 bp, human
gctgcactcgcggtggcaca

SEQ ID NO: 40890 - DNA, 20 bp, human
ggcagggcgggctgcactcg

SEQ ID NO: 40891 - DNA, 20 bp, human
gatggcgcagcgctcgggga

SEQ ID NO: 40892 - DNA, 20 bp, human
gaaccgcctggtggcccctc

SEQ ID NO: 40893 - DNA, 20 bp, human
gaccccaaggaaaccgagtg

SEQ ID NO: 40894 - DNA, 20 bp, human
gcggtgtaaacggggacccg

SEQ ID NO: 40895 - DNA, 20 bp, human
gtgactgcagggcgaggggt

SEQ ID NO: 40896 - DNA, 20 bp, human
gcattaggtgaaaagcgggt

SEQ ID NO: 40897 - DNA, 20 bp, human
ggatattctccataggaata

SEQ ID NO: 40898 - DNA, 20 bp, human
gctagaggtgagtatgatag

SEQ ID NO: 40899 - DNA, 20 bp, human
gggaataaggcatgctaatg

SEQ ID NO: 40900 - DNA, 20 bp, human
gtgcaactgatattctccat

SEQ ID NO: 40901 - DNA, 20 bp, human
ggtgttcggtaattctgtta

SEQ ID NO: 40902 - DNA, 20 bp, human
gtcaatatgactacttacct

SEQ ID NO: 40903 - DNA, 20 bp, human
gctaaaaggccaaagtggat

SEQ ID NO: 40904 - DNA, 20 bp, human
gacatttttggtgcatagac

SEQ ID NO: 40905 - DNA, 20 bp, human
gtcggtaattctgttaaggg

SEQ ID NO: 40906 - DNA, 20 bp, human
gcgcggaggacgccatggtt

SEQ ID NO: 40907 - DNA, 20 bp, human
gccggctgcgtggtgatcgt

SEQ ID NO: 40908 - DNA, 20 bp, human
gcgcgtccccggcccaacca

SEQ ID NO: 40909 - DNA, 20 bp, human
ggcgtctccccgggctccag

SEQ ID NO: 40910 - DNA, 20 bp, human
gaggtccacatagaagtgcc

SEQ ID NO: 40911 - DNA, 20 bp, human
gccccgagggccccacgcga

SEQ ID NO: 40912 - DNA, 20 bp, human
gcggcctgggcggtcaacct

SEQ ID NO: 40913 - DNA, 20 bp, human
ggagcccgccagcgccgtag

SEQ ID NO: 40914 - DNA, 20 bp, human
gggacgccatggttgggccg

SEQ ID NO: 40915 - DNA, 20 bp, human
gggtgcctggcacttctatg

SEQ ID NO: 40916 - DNA, 20 bp, human
ggactgaggttagaaggcac

SEQ ID NO: 40917 - DNA, 20 bp, human
gcagcgggcgcgctcataaa

SEQ ID NO: 40918 - DNA, 20 bp, human
gctctagaggcgggatgagg

SEQ ID NO: 40919 - DNA, 20 bp, human
gtcataaagggcacagccga

SEQ ID NO: 40920 - DNA, 20 bp, human
ggccgagggtacgtggatcg

SEQ ID NO: 40921 - DNA, 20 bp, human
ggggtacgtggatcgcggtg

SEQ ID NO: 40922 - DNA, 20 bp, human
gtggccagggccgtctctag

SEQ ID NO: 40923 - DNA, 20 bp, human
ggcacactctccacctaggg

SEQ ID NO: 40924 - DNA, 20 bp, human
gcggccgcgctcaggaacgc

SEQ ID NO: 40925 - DNA, 20 bp, human
ggggtagcgcctattaaaag

SEQ ID NO: 40926 - DNA, 20 bp, human
ggggtggagcctgcaaaagt

SEQ ID NO: 40927 - DNA, 20 bp, human
gacttaccagaatctagagt

SEQ ID NO: 40928 - DNA, 20 bp, human
gtgggaattaaaatctgcgt

SEQ ID NO: 40929 - DNA, 20 bp, human
gcaacggacacctcatggtg

SEQ ID NO: 40930 - DNA, 20 bp, human
gaatccccaaacccaggcac

SEQ ID NO: 40931 - DNA, 20 bp, human
gtgggcaggggtagtgccaa

SEQ ID NO: 40932 - DNA, 20 bp, human
ggagcctaaacgcaggacca

SEQ ID NO: 40933 - DNA, 20 bp, human
gtgggggacagggagtgcgg

SEQ ID NO: 40934 - DNA, 20 bp, human
gcgaagccattcccctccag

SEQ ID NO: 40935 - DNA, 20 bp, human
ggctgcagggaaaaatcaag

SEQ ID NO: 40936 - DNA, 20 bp, human
gacagtttcctggaccttga

SEQ ID NO: 40937 - DNA, 20 bp, human
gttcgcgtcgaaccctaacc

SEQ ID NO: 40938 - DNA, 20 bp, human
gtctctgacgaaggactgga

SEQ ID NO: 40939 - DNA, 20 bp, human
ggggctctctgacgaaggac

SEQ ID NO: 40940 - DNA, 20 bp, human
ggtgaaggtgcaggccgttg

SEQ ID NO: 40941 - DNA, 20 bp, human
gtgcctctgagccgccccaa

SEQ ID NO: 40942 - DNA, 20 bp, human
ggcctgaccaatgggagcag

SEQ ID NO: 40943 - DNA, 20 bp, human
gtgacgagcggcctgaccaa

SEQ ID NO: 40944 - DNA, 20 bp, human
gctgggcccgaacaagtccc

SEQ ID NO: 40945 - DNA, 20 bp, human
gggggcgggctctctgacga

SEQ ID NO: 40946 - DNA, 20 bp, human
ggaaagagtagacgaaccgg

SEQ ID NO: 40947 - DNA, 20 bp, human
gggagcacgccgtcccaggg

SEQ ID NO: 40948 - DNA, 20 bp, human
ggagccgagacaggaacctc

SEQ ID NO: 40949 - DNA, 20 bp, human
gccgcagtccagaacgcgtg

SEQ ID NO: 40950 - DNA, 20 bp, human
gcagtccagaacgcgtgagg

SEQ ID NO: 40951 - DNA, 20 bp, human
gtcacccccaggagccagaa

SEQ ID NO: 40952 - DNA, 20 bp, human
ggacatgcggggtgacagca

SEQ ID NO: 40953 - DNA, 20 bp, human
gctggactgcgggccgaggg

SEQ ID NO: 40954 - DNA, 20 bp, human
gcggcgtgcacttcaccccc

SEQ ID NO: 40955 - DNA, 20 bp, human
gagagtagacgaaccggcgg

SEQ ID NO: 40956 - DNA, 20 bp, human
gcgctcggcggagaggacga

SEQ ID NO: 40957 - DNA, 20 bp, human
ggctcggcagctagactagc

SEQ ID NO: 40958 - DNA, 20 bp, human
gcggccgccatcgagactga

SEQ ID NO: 40959 - DNA, 20 bp, human
gtagctgccgagcccggaag

SEQ ID NO: 40960 - DNA, 20 bp, human
gacgctgggtgctcgatggg

SEQ ID NO: 40961 - DNA, 20 bp, human
gagactgagggcaggaccct

SEQ ID NO: 40962 - DNA, 20 bp, human
gagcttggggacgcacggag

SEQ ID NO: 40963 - DNA, 20 bp, human
gcttcccgcgcggcacccca

SEQ ID NO: 40964 - DNA, 20 bp, human
gctgccctcagtctcgatgg

SEQ ID NO: 40965 - DNA, 20 bp, human
gtgtacgctgggtgctcgat

SEQ ID NO: 40966 - DNA, 20 bp, human
gatggggatccagatggagg

SEQ ID NO: 40967 - DNA, 20 bp, human
gctgtggtcccactacgtgg

SEQ ID NO: 40968 - DNA, 20 bp, human
ggcttacctccacctccatc

SEQ ID NO: 40969 - DNA, 20 bp, human
gagcatgaagatggtgttgg

SEQ ID NO: 40970 - DNA, 20 bp, human
gacttccctgggttcacagc

SEQ ID NO: 40971 - DNA, 20 bp, human
gtccaccctcccccacgtag

SEQ ID NO: 40972 - DNA, 20 bp, human
gggtcccactacgtggggga

SEQ ID NO: 40973 - DNA, 20 bp, human
gtgtcagccctgataaactt

SEQ ID NO: 40974 - DNA, 20 bp, human
gcctgaagtggcactggggg

SEQ ID NO: 40975 - DNA, 20 bp, human
ggttggatgaagtgattggc

SEQ ID NO: 40976 - DNA, 20 bp, human
gtccccatccgggcagaatc

SEQ ID NO: 40977 - DNA, 20 bp, human
gcccatccagatccccatcc

SEQ ID NO: 40978 - DNA, 20 bp, human
gcctgggttcacggcaaggg

SEQ ID NO: 40979 - DNA, 20 bp, human
gttccctgggttcacggcaa

SEQ ID NO: 40980 - DNA, 20 bp, human
gaccggattctgcccggatg

SEQ ID NO: 40981 - DNA, 20 bp, human
gactctgagtcggcccgaag

SEQ ID NO: 40982 - DNA, 20 bp, human
gtccaccctcacccacatag

SEQ ID NO: 40983 - DNA, 20 bp, human
gtgtcagccctggtacacac

SEQ ID NO: 40984 - DNA, 20 bp, human
gggtcccactatgtgggtga

SEQ ID NO: 40985 - DNA, 20 bp, human
gttctgcccggatggggatc

SEQ ID NO: 40986 - DNA, 20 bp, human
ggtaggagtcagagcttggg

SEQ ID NO: 40987 - DNA, 20 bp, human
gaaagaggcgaggaagtgga

SEQ ID NO: 40988 - DNA, 20 bp, human
ggcctcccccaggacagtga

SEQ ID NO: 40989 - DNA, 20 bp, human
gcttctgggccagggttgag

SEQ ID NO: 40990 - DNA, 20 bp, human
gccacccaccaacaccaaag

SEQ ID NO: 40991 - DNA, 20 bp, human
gtggtgcaagatatgtgcaa

SEQ ID NO: 40992 - DNA, 20 bp, human
gtgggccgttcactttgata

SEQ ID NO: 40993 - DNA, 20 bp, human
ggaagccctatcaaagtgaa

SEQ ID NO: 40994 - DNA, 20 bp, human
ggaaggcatcctctcaaccc

SEQ ID NO: 40995 - DNA, 20 bp, human
gcaccaacaccaaagaggcg

SEQ ID NO: 40996 - DNA, 20 bp, human
gcagatgcgcagatgctcag

SEQ ID NO: 40997 - DNA, 20 bp, human
gtccccatccgggcagaatc

SEQ ID NO: 40998 - DNA, 20 bp, human
gcccatccagatccccatcc

SEQ ID NO: 40999 - DNA, 20 bp, human
gcctgggttcacggcaaggg

SEQ ID NO: 41000 - DNA, 20 bp, human
gactctgagtcggcccgaag

SEQ ID NO: 41001 - DNA, 20 bp, human
gaccggattctgcccggatg

SEQ ID NO: 41002 - DNA, 20 bp, human
ggaagatggtgttggtgtag

SEQ ID NO: 41003 - DNA, 20 bp, human
gtgtcagccctggtacacac

SEQ ID NO: 41004 - DNA, 20 bp, human
gttccctgggttcacggcaa

SEQ ID NO: 41005 - DNA, 20 bp, human
gatggtgttggtgtaggggt

SEQ ID NO: 41006 - DNA, 20 bp, human
gagagcgcggacgccgcagg

SEQ ID NO: 41007 - DNA, 20 bp, human
gtggccaggccgaaggagag

SEQ ID NO: 41008 - DNA, 20 bp, human
gagctgcccaggagaggtga

SEQ ID NO: 41009 - DNA, 20 bp, human
gaggtacaacgtgaaggtgg

SEQ ID NO: 41010 - DNA, 20 bp, human
ggcaactggaagcggcactg

SEQ ID NO: 41011 - DNA, 20 bp, human
gtcccagcccaacattccag

SEQ ID NO: 41012 - DNA, 20 bp, human
gggagagaggtacaacgtga

SEQ ID NO: 41013 - DNA, 20 bp, human
gagaggtgaggggctagatg

SEQ ID NO: 41014 - DNA, 20 bp, human
gctcccgctgcttcccagac

SEQ ID NO: 41015 - DNA, 20 bp, human
ggacacagacatgctcccac

SEQ ID NO: 41016 - DNA, 20 bp, human
gttatggcggcgctggagag

SEQ ID NO: 41017 - DNA, 20 bp, human
gtaccgggccgtgctgctta

SEQ ID NO: 41018 - DNA, 20 bp, human
gcgggccgtgctgcttatgg

SEQ ID NO: 41019 - DNA, 20 bp, human
ggcagcacggcccggtacgt

SEQ ID NO: 41020 - DNA, 20 bp, human
gctggctgcttccccatctg

SEQ ID NO: 41021 - DNA, 20 bp, human
ggacctcagggtccaactgg

SEQ ID NO: 41022 - DNA, 20 bp, human
gtacccccagttggaccctg

SEQ ID NO: 41023 - DNA, 20 bp, human
gcccagacaagccgcagatg

SEQ ID NO: 41024 - DNA, 20 bp, human
gagcccagggcagggaatcg

SEQ ID NO: 41025 - DNA, 20 bp, human
gagacgtatgaaaaagccca

SEQ ID NO: 41026 - DNA, 20 bp, human
ggtttgaatgtgaggcggag

SEQ ID NO: 41027 - DNA, 20 bp, human
ggccgctcgctcatgcgctc

SEQ ID NO: 41028 - DNA, 20 bp, human
ggcgccgtgatggagaggaa

SEQ ID NO: 41029 - DNA, 20 bp, human
gtgaatgtgaggcggagcgg

SEQ ID NO: 41030 - DNA, 20 bp, human
ggcgaccccagggcctgtga

SEQ ID NO: 41031 - DNA, 20 bp, human
ggccttcccgagcggagagg

SEQ ID NO: 41032 - DNA, 20 bp, human
ggagcgcgaccaataaggag

SEQ ID NO: 41033 - DNA, 20 bp, human
ggcggccttcccgagcggag

SEQ ID NO: 41034 - DNA, 20 bp, human
ggaggagggaaccccagccg

SEQ ID NO: 41035 - DNA, 20 bp, human
gtagtgccagctacggtccg

SEQ ID NO: 41036 - DNA, 20 bp, human
gggcttccctgggaaacgga

SEQ ID NO: 41037 - DNA, 20 bp, human
gtgtcctgggatgcggagag

SEQ ID NO: 41038 - DNA, 20 bp, human
ggagcggctctggcgccgag

SEQ ID NO: 41039 - DNA, 20 bp, human
gagggccgcaccgctgtcct

SEQ ID NO: 41040 - DNA, 20 bp, human
gcgcggccgtcgcttaccgt

SEQ ID NO: 41041 - DNA, 20 bp, human
ggcgcccggcgcggtcatac

SEQ ID NO: 41042 - DNA, 20 bp, human
gaagtttgcctgggtcctct

SEQ ID NO: 41043 - DNA, 20 bp, human
ggccgtcgcttaccgtggga

SEQ ID NO: 41044 - DNA, 20 bp, human
gctcaccccattgcacggag

SEQ ID NO: 41045 - DNA, 20 bp, human
gccaggctgtcggctccgag

SEQ ID NO: 41046 - DNA, 20 bp, human
ggaagcctcaagagtatcag

SEQ ID NO: 41047 - DNA, 20 bp, human
gcctgaggacacccagtgag

SEQ ID NO: 41048 - DNA, 20 bp, human
gtccagtgtcccgatccctg

SEQ ID NO: 41049 - DNA, 20 bp, human
gtactagctccgcagggatc

SEQ ID NO: 41050 - DNA, 20 bp, human
ggaagaagaggatcagccca

SEQ ID NO: 41051 - DNA, 20 bp, human
gatggtaagagcagaacggg

SEQ ID NO: 41052 - DNA, 20 bp, human
gaggacacacagtgagtcgc

SEQ ID NO: 41053 - DNA, 20 bp, human
gtgccttgcctagctaaaag

SEQ ID NO: 41054 - DNA, 20 bp, human
gtggagaagacccctgtgaa

SEQ ID NO: 41055 - DNA, 20 bp, human
gggactgaatcctttcacag

SEQ ID NO: 41056 - DNA, 20 bp, human
ggcccagtacacagagagaa

SEQ ID NO: 41057 - DNA, 20 bp, human
ggagaaaggctaaagttctc

SEQ ID NO: 41058 - DNA, 20 bp, human
gctctgtgtactgggctcac

SEQ ID NO: 41059 - DNA, 20 bp, human
ggaaagtggacaaccctgtg

SEQ ID NO: 41060 - DNA, 20 bp, human
ggctgctggccgtgccccta

SEQ ID NO: 41061 - DNA, 20 bp, human
gcctcctgcagccagctgac

SEQ ID NO: 41062 - DNA, 20 bp, human
ggacaggcgtggccagtcag

SEQ ID NO: 41063 - DNA, 20 bp, human
gcacccagctggcccctgac

SEQ ID NO: 41064 - DNA, 20 bp, human
gggaggagggggtagcaact

SEQ ID NO: 41065 - DNA, 20 bp, human
gagctgggtggcctaggcac

SEQ ID NO: 41066 - DNA, 20 bp, human
gagaacttagcttaccccca

SEQ ID NO: 41067 - DNA, 20 bp, human
ggaagggagctactcagaag

SEQ ID NO: 41068 - DNA, 20 bp, human
ggtgaattcacagctatctg

SEQ ID NO: 41069 - DNA, 20 bp, human
ggagaggaagcggatgccgt

SEQ ID NO: 41070 - DNA, 20 bp, human
gtctccgagagaagaaaagc

SEQ ID NO: 41071 - DNA, 20 bp, human
ggttggctcgagccgaagtg

SEQ ID NO: 41072 - DNA, 20 bp, human
gtggggtgtagtatctagca

SEQ ID NO: 41073 - DNA, 20 bp, human
gccgcgttcatctctcgaaa

SEQ ID NO: 41074 - DNA, 20 bp, human
gtgagcatgtcgagtcaccc

SEQ ID NO: 41075 - DNA, 20 bp, human
gcacagctatctgtggcatc

SEQ ID NO: 41076 - DNA, 20 bp, human
ggccgggccatacctctgtg

SEQ ID NO: 41077 - DNA, 20 bp, human
gacctgagcccagactccta

SEQ ID NO: 41078 - DNA, 20 bp, human
gctcccaccacacagaggta

SEQ ID NO: 41079 - DNA, 20 bp, human
gcaaagcgaagacagactat

SEQ ID NO: 41080 - DNA, 20 bp, human
gctagggcggccagtggatg

SEQ ID NO: 41081 - DNA, 20 bp, human
gtgagcccagactcctaggg

SEQ ID NO: 41082 - DNA, 20 bp, human
gcaacataaataggaaacgt

SEQ ID NO: 41083 - DNA, 20 bp, human
gggagagaccagtcttcttc

SEQ ID NO: 41084 - DNA, 20 bp, human
gggccatacctctgtgtggt

SEQ ID NO: 41085 - DNA, 20 bp, human
gacagaagcccagggtggac

SEQ ID NO: 41086 - DNA, 20 bp, human
gagaagctggtgagtgaggt

SEQ ID NO: 41087 - DNA, 20 bp, human
ggagagggcctcaggtggta

SEQ ID NO: 41088 - DNA, 20 bp, human
gagcaagtgaggaagatcca

SEQ ID NO: 41089 - DNA, 20 bp, human
gccggtggggagagctaagg

SEQ ID NO: 41090 - DNA, 20 bp, human
gctgtggagggaagcccggt

SEQ ID NO: 41091 - DNA, 20 bp, human
ggggccaacatcctctggaa

SEQ ID NO: 41092 - DNA, 20 bp, human
gagcccggtggggagagcta

SEQ ID NO: 41093 - DNA, 20 bp, human
gcaggcggctctcccatcct

SEQ ID NO: 41094 - DNA, 20 bp, human
ggcacccagtgtccccgaga

SEQ ID NO: 41095 - DNA, 20 bp, human
gaggccctctcggggacact

SEQ ID NO: 41096 - DNA, 20 bp, human
gcagcccccgggcctgtcag

SEQ ID NO: 41097 - DNA, 20 bp, human
gagggatcccctactcacgt

SEQ ID NO: 41098 - DNA, 20 bp, human
ggtaggggatccctagagag

SEQ ID NO: 41099 - DNA, 20 bp, human
gttgacgagaagagagacca

SEQ ID NO: 41100 - DNA, 20 bp, human
ggaggtgccaacgtgagtag

SEQ ID NO: 41101 - DNA, 20 bp, human
gccattaacgacagagctcg

SEQ ID NO: 41102 - DNA, 20 bp, human
gcagcctctgacaggcccgg

SEQ ID NO: 41103 - DNA, 20 bp, human
gtccagggctggggttccaa

SEQ ID NO: 41104 - DNA, 20 bp, human
ggtgaaatagagacccagac

SEQ ID NO: 41105 - DNA, 20 bp, human
ggcaatacccccaaaagtag

SEQ ID NO: 41106 - DNA, 20 bp, human
gagggaaagttcagcgacgg

SEQ ID NO: 41107 - DNA, 20 bp, human
ggcagaaagcaatcagacag

SEQ ID NO: 41108 - DNA, 20 bp, human
gcatcgcgcggcacgtggaa

SEQ ID NO: 41109 - DNA, 20 bp, human
gccgggccgggcagctagca

SEQ ID NO: 41110 - DNA, 20 bp, human
gggaaggccacgagaaacgc

SEQ ID NO: 41111 - DNA, 20 bp, human
gaccgaccccgggagcgcag

SEQ ID NO: 41112 - DNA, 20 bp, human
gagggcgcttcgggtgagtc

SEQ ID NO: 41113 - DNA, 20 bp, human
gagctgcacgagccaccccg

SEQ ID NO: 41114 - DNA, 20 bp, human
ggtgaagccaaaccgacccc

SEQ ID NO: 41115 - DNA, 20 bp, human
gccgcggctgccggagcggg

SEQ ID NO: 41116 - DNA, 20 bp, human
gagagctgcgagttaggaag

SEQ ID NO: 41117 - DNA, 20 bp, human
ggagttaggaagcggctcgc

SEQ ID NO: 41118 - DNA, 20 bp, human
gaagcggctcgctggcagct

SEQ ID NO: 41119 - DNA, 20 bp, human
gttacctgggggttcaagaa

SEQ ID NO: 41120 - DNA, 20 bp, human
gttcagcgctgtcagagcat

SEQ ID NO: 41121 - DNA, 20 bp, human
ggctacatcattgctcctct

SEQ ID NO: 41122 - DNA, 20 bp, human
ggaaaatgctcacttacctg

SEQ ID NO: 41123 - DNA, 20 bp, human
gatttcaaggaaagacgcca

SEQ ID NO: 41124 - DNA, 20 bp, human
gctctgggtcaaaattacct

SEQ ID NO: 41125 - DNA, 20 bp, human
gcttcccttcttgaaccccc

SEQ ID NO: 41126 - DNA, 20 bp, human
ggcgccggaagtggcctctc

SEQ ID NO: 41127 - DNA, 20 bp, human
gacagataaagaggggctga

SEQ ID NO: 41128 - DNA, 20 bp, human
gagtggcctctcaggcgcgg

SEQ ID NO: 41129 - DNA, 20 bp, human
ggccatctacagataaagag

SEQ ID NO: 41130 - DNA, 20 bp, human
gggaagtggcctctcaggcg

SEQ ID NO: 41131 - DNA, 20 bp, human
ggcggcgggcccaaggcgtg

SEQ ID NO: 41132 - DNA, 20 bp, human
gcctgcgccgcggggacacc

SEQ ID NO: 41133 - DNA, 20 bp, human
gctaaaaccggtgccgactc

SEQ ID NO: 41134 - DNA, 20 bp, human
ggggatgagcctgccggagt

SEQ ID NO: 41135 - DNA, 20 bp, human
gtctgtcgtggagggctcag

SEQ ID NO: 41136 - DNA, 20 bp, human
gacctggagccattgccact

SEQ ID NO: 41137 - DNA, 20 bp, human
gacctagtggcaatggctcc

SEQ ID NO: 41138 - DNA, 20 bp, human
ggattttaggggcgcttacc

SEQ ID NO: 41139 - DNA, 20 bp, human
gacagctcacctagtggcaa

SEQ ID NO: 41140 - DNA, 20 bp, human
gagaaaccggagggcaatgg

SEQ ID NO: 41141 - DNA, 20 bp, human
gatgggcttggagcatagcg

SEQ ID NO: 41142 - DNA, 20 bp, human
ggcgctggcctcttcctctc

SEQ ID NO: 41143 - DNA, 20 bp, human
gggctccctccattgccctc

SEQ ID NO: 41144 - DNA, 20 bp, human
ggccagctggtgcgcgcgat

SEQ ID NO: 41145 - DNA, 20 bp, human
gaatgggtgcgggtcagggg

SEQ ID NO: 41146 - DNA, 20 bp, human
ggggagacggcatccactca

SEQ ID NO: 41147 - DNA, 20 bp, human
gagtggatgccgtctcccct

SEQ ID NO: 41148 - DNA, 20 bp, human
ggcccgggagccctgaccac

SEQ ID NO: 41149 - DNA, 20 bp, human
gaatgcaggcagatgagcat

SEQ ID NO: 41150 - DNA, 20 bp, human
gccactggggaagtaatggg

SEQ ID NO: 41151 - DNA, 20 bp, human
gctcccccatccccgcctag

SEQ ID NO: 41152 - DNA, 20 bp, human
ggagaagcagaaggaggtct

SEQ ID NO: 41153 - DNA, 20 bp, human
gcatccccgcctaggggaga

SEQ ID NO: 41154 - DNA, 20 bp, human
gaagtaatgggaggagacta

SEQ ID NO: 41155 - DNA, 20 bp, human
gattccgacaccctccaaca

SEQ ID NO: 41156 - DNA, 20 bp, human
gacctggagccattgccact

SEQ ID NO: 41157 - DNA, 20 bp, human
gacctagtggcaatggctcc

SEQ ID NO: 41158 - DNA, 20 bp, human
ggattttaggggcgcttacc

SEQ ID NO: 41159 - DNA, 20 bp, human
gacagctcacctagtggcaa

SEQ ID NO: 41160 - DNA, 20 bp, human
gagggagagagaactggcca

SEQ ID NO: 41161 - DNA, 20 bp, human
gaaacaggtggggtcaagca

SEQ ID NO: 41162 - DNA, 20 bp, human
gagaaaccggagggcaatgg

SEQ ID NO: 41163 - DNA, 20 bp, human
gcccacaagagaccggctct

SEQ ID NO: 41164 - DNA, 20 bp, human
ggcgctggcctcttcctctc

SEQ ID NO: 41165 - DNA, 20 bp, human
gggctccctccattgccctc

SEQ ID NO: 41166 - DNA, 20 bp, human
gctgagtggtgcggggagtc

SEQ ID NO: 41167 - DNA, 20 bp, human
ggaggcggcgccctgcagat

SEQ ID NO: 41168 - DNA, 20 bp, human
ggagtcgggccttgggatgc

SEQ ID NO: 41169 - DNA, 20 bp, human
ggagaaaccggagggcaaga

SEQ ID NO: 41170 - DNA, 20 bp, human
gggacgggggcactaacctc

SEQ ID NO: 41171 - DNA, 20 bp, human
gttatccaggctttttaaag

SEQ ID NO: 41172 - DNA, 20 bp, human
gcggctcccttcttgccctc

SEQ ID NO: 41173 - DNA, 20 bp, human
gggcactaacctcaggtttg

SEQ ID NO: 41174 - DNA, 20 bp, human
gatagcctctttaaaaagcc

SEQ ID NO: 41175 - DNA, 20 bp, human
ggaccagctccagcatccca

SEQ ID NO: 41176 - DNA, 20 bp, human
ggccagctggtgcagacgat

SEQ ID NO: 41177 - DNA, 20 bp, human
gctggtgcagacgatgggcg

SEQ ID NO: 41178 - DNA, 20 bp, human
gacctagctgcaatggctac

SEQ ID NO: 41179 - DNA, 20 bp, human
gacctgtagccattgcagct

SEQ ID NO: 41180 - DNA, 20 bp, human
gtcagaaagctcctggtccc

SEQ ID NO: 41181 - DNA, 20 bp, human
ggccaatctcagaaagctcc

SEQ ID NO: 41182 - DNA, 20 bp, human
gaccaggagctttctgagat

SEQ ID NO: 41183 - DNA, 20 bp, human
gcactgccctcttgaagcca

SEQ ID NO: 41184 - DNA, 20 bp, human
ggtgctggcctcttgctctc

SEQ ID NO: 41185 - DNA, 20 bp, human
ggccaaatactgggcttaca

SEQ ID NO: 41186 - DNA, 20 bp, human
gcgggtcgcggagggaagaa

SEQ ID NO: 41187 - DNA, 20 bp, human
ggtgcggtacaaagaggtat

SEQ ID NO: 41188 - DNA, 20 bp, human
gcggcggcggcggccaacct

SEQ ID NO: 41189 - DNA, 20 bp, human
gcgcccagggctccgctggg

SEQ ID NO: 41190 - DNA, 20 bp, human
ggctcgcccagggctccgct

SEQ ID NO: 41191 - DNA, 20 bp, human
ggccaacctcggctcgccca

SEQ ID NO: 41192 - DNA, 20 bp, human
ggcggagggaagaaaggcgg

SEQ ID NO: 41193 - DNA, 20 bp, human
ggtcgcggagggaagaaagg

SEQ ID NO: 41194 - DNA, 20 bp, human
ggaccgcagtgccccaagag

SEQ ID NO: 41195 - DNA, 20 bp, human
ggaggtatgggtgcaaggag

SEQ ID NO: 41196 - DNA, 20 bp, human
gcgggacccgatgctatgag

SEQ ID NO: 41197 - DNA, 20 bp, human
gtgcagacatgactgcgtgg

SEQ ID NO: 41198 - DNA, 20 bp, human
gggctcctcactgcagcgaa

SEQ ID NO: 41199 - DNA, 20 bp, human
ggagaagcaggagcagcgac

SEQ ID NO: 41200 - DNA, 20 bp, human
ggagccaaataatcacccga

SEQ ID NO: 41201 - DNA, 20 bp, human
gactgcagcgaagggtaaga

SEQ ID NO: 41202 - DNA, 20 bp, human
gccgatggctcctccgagga

SEQ ID NO: 41203 - DNA, 20 bp, human
gacccacagagaggggaccg

SEQ ID NO: 41204 - DNA, 20 bp, human
ggcagaagaagggctgctag

SEQ ID NO: 41205 - DNA, 20 bp, human
gcaccagcagcccgagaagc

SEQ ID NO: 41206 - DNA, 20 bp, human
gtcgccgccgaggagaaagg

SEQ ID NO: 41207 - DNA, 20 bp, human
gtgagagtaggcaactggga

SEQ ID NO: 41208 - DNA, 20 bp, human
gagtaggcaactgggagggt

SEQ ID NO: 41209 - DNA, 20 bp, human
ggaccgggtcgaggatgggt

SEQ ID NO: 41210 - DNA, 20 bp, human
gtgaggacgtggctgagggt

SEQ ID NO: 41211 - DNA, 20 bp, human
gttccagccgcagaagctca

SEQ ID NO: 41212 - DNA, 20 bp, human
gctgggaccgggtcgaggat

SEQ ID NO: 41213 - DNA, 20 bp, human
gcaggcagggatagaggcgg

SEQ ID NO: 41214 - DNA, 20 bp, human
ggctcagggctcccgcgtac

SEQ ID NO: 41215 - DNA, 20 bp, human
gttctgctcggaaaaaatcc

SEQ ID NO: 41216 - DNA, 20 bp, human
ggggctgaggagcaggaatt

SEQ ID NO: 41217 - DNA, 20 bp, human
gggtcacagctcggagtgaa

SEQ ID NO: 41218 - DNA, 20 bp, human
gccgcattgaacgccaaatc

SEQ ID NO: 41219 - DNA, 20 bp, human
ggcaacaactccactgcgcc

SEQ ID NO: 41220 - DNA, 20 bp, human
gcgttctccccccctcagat

SEQ ID NO: 41221 - DNA, 20 bp, human
gcaccgtcaataaaaagacg

SEQ ID NO: 41222 - DNA, 20 bp, human
ggcatttcctatctgagggg

SEQ ID NO: 41223 - DNA, 20 bp, human
gagctcgcgaataatatgaa

SEQ ID NO: 41224 - DNA, 20 bp, human
gttcgcttgccaggctccca

SEQ ID NO: 41225 - DNA, 20 bp, human
gaaaggggaaagccgagcaa

SEQ ID NO: 41226 - DNA, 20 bp, human
gcttgcttctctccagactt

SEQ ID NO: 41227 - DNA, 20 bp, human
gagtaccttaagcccaagtc

SEQ ID NO: 41228 - DNA, 20 bp, human
gtagcgtaaagcaaagagat

SEQ ID NO: 41229 - DNA, 20 bp, human
gctctccagacttgggctta

SEQ ID NO: 41230 - DNA, 20 bp, human
gaagagatcggccatcatct

SEQ ID NO: 41231 - DNA, 20 bp, human
gtgaactattctgctagaaa

SEQ ID NO: 41232 - DNA, 20 bp, human
gatcacctaaagctgtaaaa

SEQ ID NO: 41233 - DNA, 20 bp, human
gataatttcagtagaggctt

SEQ ID NO: 41234 - DNA, 20 bp, human
ggataccattttacagcttt

SEQ ID NO: 41235 - DNA, 20 bp, human
gaaaacttcttatgattttc

SEQ ID NO: 41236 - DNA, 20 bp, human
gtgcaagagcaagagccacc

SEQ ID NO: 41237 - DNA, 20 bp, human
ggcgaggatgaggaccttca

SEQ ID NO: 41238 - DNA, 20 bp, human
gctcatcctcgcctgcctgg

SEQ ID NO: 41239 - DNA, 20 bp, human
gcccagtgccctaggctgta

SEQ ID NO: 41240 - DNA, 20 bp, human
ggctcttgctcttgcaaggg

SEQ ID NO: 41241 - DNA, 20 bp, human
gatatataccttacagccta

SEQ ID NO: 41242 - DNA, 20 bp, human
gcaggacttagtagccatga

SEQ ID NO: 41243 - DNA, 20 bp, human
gtctttgtacagacagacac

SEQ ID NO: 41244 - DNA, 20 bp, human
ggaagcatttggggcactat

SEQ ID NO: 41245 - DNA, 20 bp, human
gggatttgacccagtgccct

SEQ ID NO: 41246 - DNA, 20 bp, human
ggtgccagtcaggtcttggt

SEQ ID NO: 41247 - DNA, 20 bp, human
gcctcgtgccagtcaggtct

SEQ ID NO: 41248 - DNA, 20 bp, human
gacctgactggcacgaggaa

SEQ ID NO: 41249 - DNA, 20 bp, human
gggttggcagtaggttgagt

SEQ ID NO: 41250 - DNA, 20 bp, human
gtcaggtcttggttggcagt

SEQ ID NO: 41251 - DNA, 20 bp, human
ggttaactccacaggaagtt

SEQ ID NO: 41252 - DNA, 20 bp, human
gggtcttctctacagctgac

SEQ ID NO: 41253 - DNA, 20 bp, human
gtcttgttcggaattcacaa

SEQ ID NO: 41254 - DNA, 20 bp, human
gataacaccatccagaactt

SEQ ID NO: 41255 - DNA, 20 bp, human
gacctttcctcgtgccagtc

SEQ ID NO: 41256 - DNA, 20 bp, human
gggtccctctgggccggagc

SEQ ID NO: 41257 - DNA, 20 bp, human
gcgtgaagaagcggctcccg

SEQ ID NO: 41258 - DNA, 20 bp, human
gagcggctcccggggactgg

SEQ ID NO: 41259 - DNA, 20 bp, human
ggctctgcgccgtgaagaag

SEQ ID NO: 41260 - DNA, 20 bp, human
ggccaagccccgacacctct

SEQ ID NO: 41261 - DNA, 20 bp, human
gacactaggcaaggctacgg

SEQ ID NO: 41262 - DNA, 20 bp, human
gactctgggaaagggatctc

SEQ ID NO: 41263 - DNA, 20 bp, human
ggcaaggctacggaggaggg

SEQ ID NO: 41264 - DNA, 20 bp, human
ggcctcggggctcctacact

SEQ ID NO: 41265 - DNA, 20 bp, human
gtaggcaaggctacggagga

SEQ ID NO: 41266 - DNA, 20 bp, human
gctgctgccaccgctaccaa

SEQ ID NO: 41267 - DNA, 20 bp, human
gaccgccaccgagaaagagg

SEQ ID NO: 41268 - DNA, 20 bp, human
gctgccgtggcaaggactaa

SEQ ID NO: 41269 - DNA, 20 bp, human
ggctgtcgtggcgatgtcgt

SEQ ID NO: 41270 - DNA, 20 bp, human
gccacagccgttggtagcgg

SEQ ID NO: 41271 - DNA, 20 bp, human
gggcccacagccgttggtag

SEQ ID NO: 41272 - DNA, 20 bp, human
ggcgaccgccaccgagaaag

SEQ ID NO: 41273 - DNA, 20 bp, human
gcgatgtcgtgggctgagaa

SEQ ID NO: 41274 - DNA, 20 bp, human
ggccaggccacagtttgcga

SEQ ID NO: 41275 - DNA, 20 bp, human
gaagggggcacagcgagttg

SEQ ID NO: 41276 - DNA, 20 bp, human
gggggagccgacctgggtag

SEQ ID NO: 41277 - DNA, 20 bp, human
ggtctctggggagccgacct

SEQ ID NO: 41278 - DNA, 20 bp, human
gccgccatggagctgagagt

SEQ ID NO: 41279 - DNA, 20 bp, human
gaccctgcccctacccaggt

SEQ ID NO: 41280 - DNA, 20 bp, human
ggggagggcaggagcgaatc

SEQ ID NO: 41281 - DNA, 20 bp, human
ggagagtcgggaacaggtac

SEQ ID NO: 41282 - DNA, 20 bp, human
ggatcgtggccagaacccaa

SEQ ID NO: 41283 - DNA, 20 bp, human
gtggggagcggactcgggaa

SEQ ID NO: 41284 - DNA, 20 bp, human
ggcgcgatcgcggaaggaag

SEQ ID NO: 41285 - DNA, 20 bp, human
gaggggagctgacccggggt

SEQ ID NO: 41286 - DNA, 20 bp, human
gctcggcccggcgaggacaa

SEQ ID NO: 41287 - DNA, 20 bp, human
gcgttcgcgctggggtgtag

SEQ ID NO: 41288 - DNA, 20 bp, human
gcctcggagggcccagcggg

SEQ ID NO: 41289 - DNA, 20 bp, human
gggcggctccgcgaatcctc

SEQ ID NO: 41290 - DNA, 20 bp, human
gcccggcgaggacaaaggcg

SEQ ID NO: 41291 - DNA, 20 bp, human
gctctccagcaaaaacaaag

SEQ ID NO: 41292 - DNA, 20 bp, human
gcgcggaagggtgcaaacct

SEQ ID NO: 41293 - DNA, 20 bp, human
gcggcggggtaaatatcggg

SEQ ID NO: 41294 - DNA, 20 bp, human
ggaggacaaaggcgcggctg

SEQ ID NO: 41295 - DNA, 20 bp, human
gcgcgagcctgcaaaataac

SEQ ID NO: 41296 - DNA, 20 bp, human
gagaaaccaccgctgcgggt

SEQ ID NO: 41297 - DNA, 20 bp, human
gcggttagcggggtagaggt

SEQ ID NO: 41298 - DNA, 20 bp, human
gtcagagtaagccctccagg

SEQ ID NO: 41299 - DNA, 20 bp, human
ggcaaactcccggtccacac

SEQ ID NO: 41300 - DNA, 20 bp, human
gctctttcccaggagcggga

SEQ ID NO: 41301 - DNA, 20 bp, human
ggagggcacagatctcgtca

SEQ ID NO: 41302 - DNA, 20 bp, human
ggggaggggagaaggcggac

SEQ ID NO: 41303 - DNA, 20 bp, human
ggggaaggcgaggagccgag

SEQ ID NO: 41304 - DNA, 20 bp, human
ggggtagaggtaggcggagg

SEQ ID NO: 41305 - DNA, 20 bp, human
gggacgccgtgatcccgggt

SEQ ID NO: 41306 - DNA, 20 bp, human
gccccgctggcagacgctgg

SEQ ID NO: 41307 - DNA, 20 bp, human
gggcggttagacgggttggg

SEQ ID NO: 41308 - DNA, 20 bp, human
gcagtggacaccgagtgtgg

SEQ ID NO: 41309 - DNA, 20 bp, human
gcccgagtgcagggtcaacg

SEQ ID NO: 41310 - DNA, 20 bp, human
ggccccccgctggcagacgc

SEQ ID NO: 41311 - DNA, 20 bp, human
gtccgcatgttcgggacggg

SEQ ID NO: 41312 - DNA, 20 bp, human
gggcagacgctggcggcgta

SEQ ID NO: 41313 - DNA, 20 bp, human
gctccgccgcgcccgctccg

SEQ ID NO: 41314 - DNA, 20 bp, human
ggcttgcggggcggttagac

SEQ ID NO: 41315 - DNA, 20 bp, human
gggcctccgcatgttcggga

SEQ ID NO: 41316 - DNA, 20 bp, human
gcggcggtaggaggcaccag

SEQ ID NO: 41317 - DNA, 20 bp, human
ggcgtcgatccggatgcccg

SEQ ID NO: 41318 - DNA, 20 bp, human
gtcattccgggctgcatcgg

SEQ ID NO: 41319 - DNA, 20 bp, human
ggctgctgtgcattcattcc

SEQ ID NO: 41320 - DNA, 20 bp, human
ggaccccagccccacccggg

SEQ ID NO: 41321 - DNA, 20 bp, human
gcagcgcctcgcttatccgg

SEQ ID NO: 41322 - DNA, 20 bp, human
gggtaaagccccctgcgcgt

SEQ ID NO: 41323 - DNA, 20 bp, human
gggctcgggcggcgactctc

SEQ ID NO: 41324 - DNA, 20 bp, human
ggcgactctccggccagcgg

SEQ ID NO: 41325 - DNA, 20 bp, human
gcattcattccgggctgcat

SEQ ID NO: 41326 - DNA, 20 bp, human
gcttccaccacaggtaccta

SEQ ID NO: 41327 - DNA, 20 bp, human
gcctcgcctggctgctccct

SEQ ID NO: 41328 - DNA, 20 bp, human
gcgatggaggaggagacaca

SEQ ID NO: 41329 - DNA, 20 bp, human
ggacaatatggcggcgatgg

SEQ ID NO: 41330 - DNA, 20 bp, human
gcagaggccgatgtgagggt

SEQ ID NO: 41331 - DNA, 20 bp, human
gctgaactgggtggggacta

SEQ ID NO: 41332 - DNA, 20 bp, human
ggctgctccctaggtacctg

SEQ ID NO: 41333 - DNA, 20 bp, human
gaggagaggactgaactggg

SEQ ID NO: 41334 - DNA, 20 bp, human
gggagtccagcttattgcag

SEQ ID NO: 41335 - DNA, 20 bp, human
gggaaggcgacgggccgctc

SEQ ID NO: 41336 - DNA, 20 bp, human
ggcggcagcggagaagaagg

SEQ ID NO: 41337 - DNA, 20 bp, human
gcagccaccggccgggaaag

SEQ ID NO: 41338 - DNA, 20 bp, human
ggcggcggcagcggagaaga

SEQ ID NO: 41339 - DNA, 20 bp, human
gcgccgaggtgaacagtctg

SEQ ID NO: 41340 - DNA, 20 bp, human
gcggaggaaacccggaaaag

SEQ ID NO: 41341 - DNA, 20 bp, human
gcgcgagtactgggactacg

SEQ ID NO: 41342 - DNA, 20 bp, human
gagggcccgggtctacgccg

SEQ ID NO: 41343 - DNA, 20 bp, human
gctgaggagccgcgagtact

SEQ ID NO: 41344 - DNA, 20 bp, human
gttcacctcggcgtagaccc

SEQ ID NO: 41345 - DNA, 20 bp, human
gctcctcagactgttcacct

SEQ ID NO: 41346 - DNA, 20 bp, human
gggcgggggttcgtgacaca

SEQ ID NO: 41347 - DNA, 20 bp, human
gggtcccaacatcatcacac

SEQ ID NO: 41348 - DNA, 20 bp, human
gcttcacactgtggtggaag

SEQ ID NO: 41349 - DNA, 20 bp, human
gctgccagtgtgatgatgtt

SEQ ID NO: 41350 - DNA, 20 bp, human
gtgttcaaaaaccaaggcgg

SEQ ID NO: 41351 - DNA, 20 bp, human
gagattttggagaatttgag

SEQ ID NO: 41352 - DNA, 20 bp, human
gaccagctggttcgaaaatt

SEQ ID NO: 41353 - DNA, 20 bp, human
gtgttttcttcacactgtgg

SEQ ID NO: 41354 - DNA, 20 bp, human
gacgtgttcaaaaaccaagg

SEQ ID NO: 41355 - DNA, 20 bp, human
gttttggagaatttgagagg

SEQ ID NO: 41356 - DNA, 20 bp, human
gaccaggtccggcacgaagg

SEQ ID NO: 41357 - DNA, 20 bp, human
ggagcggcacatggggtctc

SEQ ID NO: 41358 - DNA, 20 bp, human
gtgctacttccagggaacgg

SEQ ID NO: 41359 - DNA, 20 bp, human
ggaccgcggcaggcgaagtg

SEQ ID NO: 41360 - DNA, 20 bp, human
ggggaggaagcgaccaggtc

SEQ ID NO: 41361 - DNA, 20 bp, human
gtccggcacgaaggagggag

SEQ ID NO: 41362 - DNA, 20 bp, human
gtccgcggcctgcgctgtag

SEQ ID NO: 41363 - DNA, 20 bp, human
gccggcagggacctcgactc

SEQ ID NO: 41364 - DNA, 20 bp, human
gagggaagttgctacttcca

SEQ ID NO: 41365 - DNA, 20 bp, human
gcctgccggagttgacacag

SEQ ID NO: 41366 - DNA, 20 bp, human
ggaggagccagcggagtcct

SEQ ID NO: 41367 - DNA, 20 bp, human
gaggacttgcgaggagccag

SEQ ID NO: 41368 - DNA, 20 bp, human
gccagctcccaggactccgc

SEQ ID NO: 41369 - DNA, 20 bp, human
gctgggcggcaggacttgcg

SEQ ID NO: 41370 - DNA, 20 bp, human
gcgagcgcggctctgctcct

SEQ ID NO: 41371 - DNA, 20 bp, human
gcgcggcccggactgcatcc

SEQ ID NO: 41372 - DNA, 20 bp, human
gcctaggcaatccatgcctg

SEQ ID NO: 41373 - DNA, 20 bp, human
gcagaagtggcccccagatc

SEQ ID NO: 41374 - DNA, 20 bp, human
ggaactagaggggttcctcc

SEQ ID NO: 41375 - DNA, 20 bp, human
gagtctggccaacatagtca

SEQ ID NO: 41376 - DNA, 20 bp, human
gtcctcgcgctgcccatcgt

SEQ ID NO: 41377 - DNA, 20 bp, human
gggccgcctcagcccacgat

SEQ ID NO: 41378 - DNA, 20 bp, human
ggtcccggctaccccaaccg

SEQ ID NO: 41379 - DNA, 20 bp, human
gcggggacagcggcggacgg

SEQ ID NO: 41380 - DNA, 20 bp, human
ggcggcggaatggtcccagg

SEQ ID NO: 41381 - DNA, 20 bp, human
gctacccggcacggccccag

SEQ ID NO: 41382 - DNA, 20 bp, human
ggcgcctcccgccggttctg

SEQ ID NO: 41383 - DNA, 20 bp, human
ggaggcggccgcagaaccgg

SEQ ID NO: 41384 - DNA, 20 bp, human
ggggcgcagtcatacctacc

SEQ ID NO: 41385 - DNA, 20 bp, human
ggaaaggccgacccgcgtgg

SEQ ID NO: 41386 - DNA, 20 bp, human
gggatcgtcgcggaccgaag

SEQ ID NO: 41387 - DNA, 20 bp, human
gcggaccgaagaggttacag

SEQ ID NO: 41388 - DNA, 20 bp, human
ggtgctctagaggatcgtcg

SEQ ID NO: 41389 - DNA, 20 bp, human
gttacagcggccacctggag

SEQ ID NO: 41390 - DNA, 20 bp, human
gaccgatgccggcctcacgg

SEQ ID NO: 41391 - DNA, 20 bp, human
ggagacacacagtgctctag

SEQ ID NO: 41392 - DNA, 20 bp, human
ggtcaccgatgccggcctca

SEQ ID NO: 41393 - DNA, 20 bp, human
gcggtgactacgagttatga

SEQ ID NO: 41394 - DNA, 20 bp, human
gatgctgttcccgctccagg

SEQ ID NO: 41395 - DNA, 20 bp, human
gctctccacacccttaactc

SEQ ID NO: 41396 - DNA, 20 bp, human
gggccgagcgcacagagtcg

SEQ ID NO: 41397 - DNA, 20 bp, human
gcgctctgcgcgtccggcag

SEQ ID NO: 41398 - DNA, 20 bp, human
ggtaaccccgagagaagtca

SEQ ID NO: 41399 - DNA, 20 bp, human
gcgctcggcccggcagccgt

SEQ ID NO: 41400 - DNA, 20 bp, human
ggcgagcggcgaggcgacgg

SEQ ID NO: 41401 - DNA, 20 bp, human
gtctgcgcgtccggcagcgg

SEQ ID NO: 41402 - DNA, 20 bp, human
gtcaaaaggaaactcacccg

SEQ ID NO: 41403 - DNA, 20 bp, human
gggagccgtgacttctctcg

SEQ ID NO: 41404 - DNA, 20 bp, human
ggcacagagtcgcggcgcag

SEQ ID NO: 41405 - DNA, 20 bp, human
gccccgagctcggcgcgagt

SEQ ID NO: 41406 - DNA, 20 bp, human
gcgactcggttccttcccaa

SEQ ID NO: 41407 - DNA, 20 bp, human
gcgggcgtctccggcaactc

SEQ ID NO: 41408 - DNA, 20 bp, human
gagagagggccgggcgtctc

SEQ ID NO: 41409 - DNA, 20 bp, human
gacgctggcccggactgcgg

SEQ ID NO: 41410 - DNA, 20 bp, human
ggggcggcagagaccatcac

SEQ ID NO: 41411 - DNA, 20 bp, human
gcggcagagaccatcacggg

SEQ ID NO: 41412 - DNA, 20 bp, human
gtgagaggctcggacgggag

SEQ ID NO: 41413 - DNA, 20 bp, human
gatcccgagaaaggacgagg

SEQ ID NO: 41414 - DNA, 20 bp, human
gtggaggggtcagaaatgag

SEQ ID NO: 41415 - DNA, 20 bp, human
gctattgttagccggagccg

SEQ ID NO: 41416 - DNA, 20 bp, human
gggacctgtggaatttaccg

SEQ ID NO: 41417 - DNA, 20 bp, human
gtcgctcttacctgtaaata

SEQ ID NO: 41418 - DNA, 20 bp, human
ggttactaggaatcgcagga

SEQ ID NO: 41419 - DNA, 20 bp, human
gaaatatggtttctgtactt

SEQ ID NO: 41420 - DNA, 20 bp, human
gaaacctcggtaaattccac

SEQ ID NO: 41421 - DNA, 20 bp, human
gatattgacaatacagtaaa

SEQ ID NO: 41422 - DNA, 20 bp, human
ggcttcctcaagtaataaaa

SEQ ID NO: 41423 - DNA, 20 bp, human
ggcttgttactaggaatcgc

SEQ ID NO: 41424 - DNA, 20 bp, human
gttaggataagacatgcctc

SEQ ID NO: 41425 - DNA, 20 bp, human
gttaattcaagcttgttact

SEQ ID NO: 41426 - DNA, 20 bp, human
gcacggcatcagcctcactg

SEQ ID NO: 41427 - DNA, 20 bp, human
gatgccgtgcagcaagcagt

SEQ ID NO: 41428 - DNA, 20 bp, human
gactccatgtgatcacatat

SEQ ID NO: 41429 - DNA, 20 bp, human
ggtacaagcaataaaacaca

SEQ ID NO: 41430 - DNA, 20 bp, human
gttacctactgcttgctgca

SEQ ID NO: 41431 - DNA, 20 bp, human
gtgctgaacaataaagcata

SEQ ID NO: 41432 - DNA, 20 bp, human
gtacagttatttgaacaggt

SEQ ID NO: 41433 - DNA, 20 bp, human
gccgaagacacagttcttcc

SEQ ID NO: 41434 - DNA, 20 bp, human
gaagaagattcctctgaacc

SEQ ID NO: 41435 - DNA, 20 bp, human
gatcgacaatttaatcgcat

SEQ ID NO: 41436 - DNA, 20 bp, human
gcggcaggcgctctcggaag

SEQ ID NO: 41437 - DNA, 20 bp, human
gagctggctcggcggcgcag

SEQ ID NO: 41438 - DNA, 20 bp, human
gcaggcgctctcggaagtgg

SEQ ID NO: 41439 - DNA, 20 bp, human
gttgtatggcagagagatga

SEQ ID NO: 41440 - DNA, 20 bp, human
gcggggtggggcaaacatct

SEQ ID NO: 41441 - DNA, 20 bp, human
ggccatacaatgagcgtcag

SEQ ID NO: 41442 - DNA, 20 bp, human
ggccactgacgctcattgta

SEQ ID NO: 41443 - DNA, 20 bp, human
ggggcagagccgcgcgactc

SEQ ID NO: 41444 - DNA, 20 bp, human
gtccgcggagcggaacaaaa

SEQ ID NO: 41445 - DNA, 20 bp, human
gccgcaaccgcctgcaagtc

SEQ ID NO: 41446 - DNA, 20 bp, human
gcgctggacgaggggaccga

SEQ ID NO: 41447 - DNA, 20 bp, human
gaccgacggctgctaagagg

SEQ ID NO: 41448 - DNA, 20 bp, human
gccgcgggcctgggatccca

SEQ ID NO: 41449 - DNA, 20 bp, human
gccctactcacttgagtcgg

SEQ ID NO: 41450 - DNA, 20 bp, human
gtactcacttgagtcggagg

SEQ ID NO: 41451 - DNA, 20 bp, human
gaggcgggagcacgtaccgc

SEQ ID NO: 41452 - DNA, 20 bp, human
ggagcctgccgctggacgag

SEQ ID NO: 41453 - DNA, 20 bp, human
gcgggagcacgtaccgcagg

SEQ ID NO: 41454 - DNA, 20 bp, human
gcgcccctactcacttgagt

SEQ ID NO: 41455 - DNA, 20 bp, human
gccagcggcaggctctctct

SEQ ID NO: 41456 - DNA, 20 bp, human
gggcggcggtgcgcactctg

SEQ ID NO: 41457 - DNA, 20 bp, human
gtcgggcgggcgggagagag

SEQ ID NO: 41458 - DNA, 20 bp, human
gggtcgagcctgggcagtac

SEQ ID NO: 41459 - DNA, 20 bp, human
gggcggtgcgcactctgcgg

SEQ ID NO: 41460 - DNA, 20 bp, human
gcttcagcgcggagctccaa

SEQ ID NO: 41461 - DNA, 20 bp, human
ggcctgggcagtacaggcgg

SEQ ID NO: 41462 - DNA, 20 bp, human
gccgcagattcaggacgacc

SEQ ID NO: 41463 - DNA, 20 bp, human
ggaggagctgaggaaccgag

SEQ ID NO: 41464 - DNA, 20 bp, human
gatgtctaggagctcgaagg

SEQ ID NO: 41465 - DNA, 20 bp, human
gcgccagcgtggggatgtct

SEQ ID NO: 41466 - DNA, 20 bp, human
gagctgaacggagtccacac

SEQ ID NO: 41467 - DNA, 20 bp, human
ggtccacacaggcaggtgag

SEQ ID NO: 41468 - DNA, 20 bp, human
ggaggagaccaagcccctga

SEQ ID NO: 41469 - DNA, 20 bp, human
gggggcttaagggacctcat

SEQ ID NO: 41470 - DNA, 20 bp, human
ggaacggagtccacacaggc

SEQ ID NO: 41471 - DNA, 20 bp, human
gcagctcaactgagtctgag

SEQ ID NO: 41472 - DNA, 20 bp, human
gcagactcagttgagctgaa

SEQ ID NO: 41473 - DNA, 20 bp, human
gtggtggttgtaagacgaga

SEQ ID NO: 41474 - DNA, 20 bp, human
gtcatccatgaattatatgg

SEQ ID NO: 41475 - DNA, 20 bp, human
gcaagtgccagcaccctctc

SEQ ID NO: 41476 - DNA, 20 bp, human
gaggataggataatcccggg

SEQ ID NO: 41477 - DNA, 20 bp, human
ggagccccaaggaggaggat

SEQ ID NO: 41478 - DNA, 20 bp, human
ggggaggagtatgaacctca

SEQ ID NO: 41479 - DNA, 20 bp, human
gtgcgttatagatgccaccc

SEQ ID NO: 41480 - DNA, 20 bp, human
gtggctcttagtacccgcag

SEQ ID NO: 41481 - DNA, 20 bp, human
gtatcctatcctcctccttg

SEQ ID NO: 41482 - DNA, 20 bp, human
ggagtatgaacctcatggcc

SEQ ID NO: 41483 - DNA, 20 bp, human
gctgtagtagtcatctttgg

SEQ ID NO: 41484 - DNA, 20 bp, human
ggggggttggggaacaaacc

SEQ ID NO: 41485 - DNA, 20 bp, human
gacggccggggagcgtgctt

SEQ ID NO: 41486 - DNA, 20 bp, human
gggagctgtagggcctgcca

SEQ ID NO: 41487 - DNA, 20 bp, human
gccgagtccttaaagtccag

SEQ ID NO: 41488 - DNA, 20 bp, human
gatggccaacaggagctgta

SEQ ID NO: 41489 - DNA, 20 bp, human
gcactagggtgatgaaatta

SEQ ID NO: 41490 - DNA, 20 bp, human
ggactcggaagatcctgaag

SEQ ID NO: 41491 - DNA, 20 bp, human
ggtgttctctgtactcctca

SEQ ID NO: 41492 - DNA, 20 bp, human
gcacgacttacaaaagtggg

SEQ ID NO: 41493 - DNA, 20 bp, human
gcaggaatagtcccactcaa

SEQ ID NO: 41494 - DNA, 20 bp, human
gcaggccctacagctcctgt

SEQ ID NO: 41495 - DNA, 20 bp, human
ggtgattcgacttgtccctg

SEQ ID NO: 41496 - DNA, 20 bp, human
gtgcctaagcatgctcccgg

SEQ ID NO: 41497 - DNA, 20 bp, human
ggactatgctgactctggat

SEQ ID NO: 41498 - DNA, 20 bp, human
gaggttgagagcctgaggcg

SEQ ID NO: 41499 - DNA, 20 bp, human
gggtctgggatccccgcctc

SEQ ID NO: 41500 - DNA, 20 bp, human
gtcgctgatgacaaagtgaa

SEQ ID NO: 41501 - DNA, 20 bp, human
gaggccataagcagagagtc

SEQ ID NO: 41502 - DNA, 20 bp, human
gaggaggacaggataatcga

SEQ ID NO: 41503 - DNA, 20 bp, human
gatggatcgggcaacaaaca

SEQ ID NO: 41504 - DNA, 20 bp, human
gaggacaggataatcgaggg

SEQ ID NO: 41505 - DNA, 20 bp, human
ggtactacagacgcctgctg

SEQ ID NO: 41506 - DNA, 20 bp, human
gaggctggagctagatagag

SEQ ID NO: 41507 - DNA, 20 bp, human
ggaaggagcctgaagagtgg

SEQ ID NO: 41508 - DNA, 20 bp, human
gggagaaggagcctgaagag

SEQ ID NO: 41509 - DNA, 20 bp, human
gggaatggggaggataggag

SEQ ID NO: 41510 - DNA, 20 bp, human
gcctcgcctcggtatcgcag

SEQ ID NO: 41511 - DNA, 20 bp, human
gagaagcccaggcgccggag

SEQ ID NO: 41512 - DNA, 20 bp, human
gaggacccgctgcgataccg

SEQ ID NO: 41513 - DNA, 20 bp, human
gcatggaggggcccgaagtg

SEQ ID NO: 41514 - DNA, 20 bp, human
gtcccggacacgcccgccaa

SEQ ID NO: 41515 - DNA, 20 bp, human
gacgcccgccaagggctcgg

SEQ ID NO: 41516 - DNA, 20 bp, human
ggctctggcctcgagctcca

SEQ ID NO: 41517 - DNA, 20 bp, human
gcccagccagggtagccatc

SEQ ID NO: 41518 - DNA, 20 bp, human
gctactcctgatggctaccc

SEQ ID NO: 41519 - DNA, 20 bp, human
gagaataggataatcccagg

SEQ ID NO: 41520 - DNA, 20 bp, human
gccggcaacaaaccaggcta

SEQ ID NO: 41521 - DNA, 20 bp, human
gctgtctgcagtgcatggac

SEQ ID NO: 41522 - DNA, 20 bp, human
ggtagccatcaggagtagca

SEQ ID NO: 41523 - DNA, 20 bp, human
gggatgagatccaggcggtg

SEQ ID NO: 41524 - DNA, 20 bp, human
gtgtaccctgctactcctga

SEQ ID NO: 41525 - DNA, 20 bp, human
ggctcaggatgagatccagg

SEQ ID NO: 41526 - DNA, 20 bp, human
gacggccaaggagtgtccta

SEQ ID NO: 41527 - DNA, 20 bp, human
ggtagcacgcacctgctggt

SEQ ID NO: 41528 - DNA, 20 bp, human
gcatgccctaggacactcct

SEQ ID NO: 41529 - DNA, 20 bp, human
gccggccacggccaccatca

SEQ ID NO: 41530 - DNA, 20 bp, human
gactcatgcactcacggcca

SEQ ID NO: 41531 - DNA, 20 bp, human
ggcagcagtggggtgtgcat

SEQ ID NO: 41532 - DNA, 20 bp, human
gagccatcacctgcagaggg

SEQ ID NO: 41533 - DNA, 20 bp, human
gggccacatcatgttctact

SEQ ID NO: 41534 - DNA, 20 bp, human
gggcagccatcacctgcaga

SEQ ID NO: 41535 - DNA, 20 bp, human
ggtcccagtagaacatgatg

SEQ ID NO: 41536 - DNA, 20 bp, human
gccgtggccagctacaacat

SEQ ID NO: 41537 - DNA, 20 bp, human
ggccgcaagctcggcactca

SEQ ID NO: 41538 - DNA, 20 bp, human
gtcggcactcacggctctga

SEQ ID NO: 41539 - DNA, 20 bp, human
gaggcaggtagtgcaataca

SEQ ID NO: 41540 - DNA, 20 bp, human
ggacccgcaggtgcagaagg

SEQ ID NO: 41541 - DNA, 20 bp, human
gcaggcccagcgccagcggg

SEQ ID NO: 41542 - DNA, 20 bp, human
gagggctccgacggcactga

SEQ ID NO: 41543 - DNA, 20 bp, human
gcagggcagagactaggacc

SEQ ID NO: 41544 - DNA, 20 bp, human
gccatggccgtcagtgccgt

SEQ ID NO: 41545 - DNA, 20 bp, human
gaggaggcagaatgcgacca

SEQ ID NO: 41546 - DNA, 20 bp, human
gcgtgctgcctgagaaggat

SEQ ID NO: 41547 - DNA, 20 bp, human
ggcccgtgccaatccttctc

SEQ ID NO: 41548 - DNA, 20 bp, human
gcccccacaggaccatgcgg

SEQ ID NO: 41549 - DNA, 20 bp, human
ggtgccttgggtcttcccca

SEQ ID NO: 41550 - DNA, 20 bp, human
ggcctgagaaggattggcac

SEQ ID NO: 41551 - DNA, 20 bp, human
gcccagtggtgctcaagacc

SEQ ID NO: 41552 - DNA, 20 bp, human
gcttgggcagcatggaacag

SEQ ID NO: 41553 - DNA, 20 bp, human
gtcgcatggctgcccgggta

SEQ ID NO: 41554 - DNA, 20 bp, human
gtgtagcctgctacccccaa

SEQ ID NO: 41555 - DNA, 20 bp, human
gagcaggctacagggatgaa

SEQ ID NO: 41556 - DNA, 20 bp, human
gtgggagctgacctgaccag

SEQ ID NO: 41557 - DNA, 20 bp, human
gctgggctgacgctaacagg

SEQ ID NO: 41558 - DNA, 20 bp, human
gatgcctgtggcccagtcaa

SEQ ID NO: 41559 - DNA, 20 bp, human
gcccagtcaagggtctctgt

SEQ ID NO: 41560 - DNA, 20 bp, human
gagacccttgactgggccac

SEQ ID NO: 41561 - DNA, 20 bp, human
gctaagagtgctgaagacct

SEQ ID NO: 41562 - DNA, 20 bp, human
gctggagctgtgggcaggat

SEQ ID NO: 41563 - DNA, 20 bp, human
ggattcaagacaggccatta

SEQ ID NO: 41564 - DNA, 20 bp, human
gacaagagtgacgctcacag

SEQ ID NO: 41565 - DNA, 20 bp, human
gctctgtgggtcctggtctg

SEQ ID NO: 41566 - DNA, 20 bp, human
gatctgaagggcaaaggcaa

SEQ ID NO: 41567 - DNA, 20 bp, human
ggtggacgccagggatctga

SEQ ID NO: 41568 - DNA, 20 bp, human
gccagggatctgaagggcaa

SEQ ID NO: 41569 - DNA, 20 bp, human
ggcatagccttcctcctctg

SEQ ID NO: 41570 - DNA, 20 bp, human
gtcgagtccgcagaggagga

SEQ ID NO: 41571 - DNA, 20 bp, human
gcatcatgtcgagtccgcag

SEQ ID NO: 41572 - DNA, 20 bp, human
gggtagtccacaaccaatta

SEQ ID NO: 41573 - DNA, 20 bp, human
gccatcagcagtccatagtc

SEQ ID NO: 41574 - DNA, 20 bp, human
gttcaaggcaaactccactg

SEQ ID NO: 41575 - DNA, 20 bp, human
gggaccaagatgtctagtct

SEQ ID NO: 41576 - DNA, 20 bp, human
gctgggaagagcaaagtcag

SEQ ID NO: 41577 - DNA, 20 bp, human
gaggacagacctcccttcca

SEQ ID NO: 41578 - DNA, 20 bp, human
gtgctgggcctgccgtggaa

SEQ ID NO: 41579 - DNA, 20 bp, human
gtgggcctgccgtggaaggg

SEQ ID NO: 41580 - DNA, 20 bp, human
gctactatgcctacagactg

SEQ ID NO: 41581 - DNA, 20 bp, human
gaagatgtgccccagtctgt

SEQ ID NO: 41582 - DNA, 20 bp, human
ggcatagatcagcaggatct

SEQ ID NO: 41583 - DNA, 20 bp, human
gtggacagcaaactccactg

SEQ ID NO: 41584 - DNA, 20 bp, human
gttaactcctgtgggcacgg

SEQ ID NO: 41585 - DNA, 20 bp, human
gccatacttaagaaaataca

SEQ ID NO: 41586 - DNA, 20 bp, human
gcagccaaaatgatacctgg

SEQ ID NO: 41587 - DNA, 20 bp, human
gatacctggaggcttatctg

SEQ ID NO: 41588 - DNA, 20 bp, human
ggctggaaccaaagtgaaca

SEQ ID NO: 41589 - DNA, 20 bp, human
gttagacttcaattacacgt

SEQ ID NO: 41590 - DNA, 20 bp, human
gcacacttccctgttcactt

SEQ ID NO: 41591 - DNA, 20 bp, human
gaagcctccaggtatcattt

SEQ ID NO: 41592 - DNA, 20 bp, human
gaatcagccaaaatgatacc

SEQ ID NO: 41593 - DNA, 20 bp, human
gcaaggtcacactcacagtt

SEQ ID NO: 41594 - DNA, 20 bp, human
ggattgcttctttgctggac

SEQ ID NO: 41595 - DNA, 20 bp, human
gataagttgtccctgtggaa

SEQ ID NO: 41596 - DNA, 20 bp, human
gtctctgagaggaaacccca

SEQ ID NO: 41597 - DNA, 20 bp, human
gggcggcgacggagggaatc

SEQ ID NO: 41598 - DNA, 20 bp, human
gggcgccccgcacatcatct

SEQ ID NO: 41599 - DNA, 20 bp, human
ggacggagggaatctggcga

SEQ ID NO: 41600 - DNA, 20 bp, human
gtcatcttggcggcgacgga

SEQ ID NO: 41601 - DNA, 20 bp, human
ggctccgctgaatacagcaa

SEQ ID NO: 41602 - DNA, 20 bp, human
gcagaagcgcctcatccctg

SEQ ID NO: 41603 - DNA, 20 bp, human
gggaatctggcgaggggact

SEQ ID NO: 41604 - DNA, 20 bp, human
ggcggctcctcagcccaagt

SEQ ID NO: 41605 - DNA, 20 bp, human
ggccccgcacatcatcttgg

SEQ ID NO: 41606 - DNA, 20 bp, human
gctgttgcttcaccgataaa

SEQ ID NO: 41607 - DNA, 20 bp, human
gcgaccgcggagagcaccct

SEQ ID NO: 41608 - DNA, 20 bp, human
gagtgaacgtgcgctcggag

SEQ ID NO: 41609 - DNA, 20 bp, human
ggcgctcggagcggtagatt

SEQ ID NO: 41610 - DNA, 20 bp, human
gcgcggcgcatatagtgagg

SEQ ID NO: 41611 - DNA, 20 bp, human
gggcccttcgagaagaggaa

SEQ ID NO: 41612 - DNA, 20 bp, human
gggcgaactaaggactgggt

SEQ ID NO: 41613 - DNA, 20 bp, human
gccgctctctcctggaaaaa

SEQ ID NO: 41614 - DNA, 20 bp, human
gagcgggataccaagagaac

SEQ ID NO: 41615 - DNA, 20 bp, human
gccagctggtccggttctct

SEQ ID NO: 41616 - DNA, 20 bp, human
gagccgactcaacagagcta

SEQ ID NO: 41617 - DNA, 20 bp, human
gactgtgagagacccagcgg

SEQ ID NO: 41618 - DNA, 20 bp, human
ggctgggcttgtgctccgta

SEQ ID NO: 41619 - DNA, 20 bp, human
ggcatatagtctgtattctg

SEQ ID NO: 41620 - DNA, 20 bp, human
gacgccctacaggataagca

SEQ ID NO: 41621 - DNA, 20 bp, human
gtagagaacgatccaccgct

SEQ ID NO: 41622 - DNA, 20 bp, human
gcagaggatgagaagtagta

SEQ ID NO: 41623 - DNA, 20 bp, human
gggatgaaagtccttaggag

SEQ ID NO: 41624 - DNA, 20 bp, human
gcattctgccgaggtctcgt

SEQ ID NO: 41625 - DNA, 20 bp, human
ggaagtagtacgggacagtg

SEQ ID NO: 41626 - DNA, 20 bp, human
gagtttggcggtgagagacc

SEQ ID NO: 41627 - DNA, 20 bp, human
ggcctcgaagaatccgctat

SEQ ID NO: 41628 - DNA, 20 bp, human
ggagagacgggaaaacccaa

SEQ ID NO: 41629 - DNA, 20 bp, human
gttgtgcagacagccgatag

SEQ ID NO: 41630 - DNA, 20 bp, human
ggatcgatgggatccccata

SEQ ID NO: 41631 - DNA, 20 bp, human
ggctctggtaatcgattcag

SEQ ID NO: 41632 - DNA, 20 bp, human
gcatagggtgagtcaataat

SEQ ID NO: 41633 - DNA, 20 bp, human
ggcagtagccagtctccccc

SEQ ID NO: 41634 - DNA, 20 bp, human
gaccggaatcatgtcgagtt

SEQ ID NO: 41635 - DNA, 20 bp, human
ggccgatagcggattcttcg

SEQ ID NO: 41636 - DNA, 20 bp, human
ggcgattggtgttggcggtc

SEQ ID NO: 41637 - DNA, 20 bp, human
gcgaacatgtctggagcagt

SEQ ID NO: 41638 - DNA, 20 bp, human
gcctcctcctcggccggcag

SEQ ID NO: 41639 - DNA, 20 bp, human
gacatgtctggagcagtcgg

SEQ ID NO: 41640 - DNA, 20 bp, human
ggcagtcggaggaacagacg

SEQ ID NO: 41641 - DNA, 20 bp, human
gtgatttagacaatagcggt

SEQ ID NO: 41642 - DNA, 20 bp, human
ggggcggtggcgattggtgt

SEQ ID NO: 41643 - DNA, 20 bp, human
gtacttgatttagacaatag

SEQ ID NO: 41644 - DNA, 20 bp, human
gtcatgggactactccagat

SEQ ID NO: 41645 - DNA, 20 bp, human
gttcatatttgagtgggcgg

SEQ ID NO: 41646 - DNA, 20 bp, human
gcctccgtgaggtcccaagg

SEQ ID NO: 41647 - DNA, 20 bp, human
gagagttcatgccagtcctt

SEQ ID NO: 41648 - DNA, 20 bp, human
gttctgaggctgtagacatg

SEQ ID NO: 41649 - DNA, 20 bp, human
ggtctgaactggcaagaaca

SEQ ID NO: 41650 - DNA, 20 bp, human
gagcatggctaaggacattc

SEQ ID NO: 41651 - DNA, 20 bp, human
gctggaagccctcccacctt

SEQ ID NO: 41652 - DNA, 20 bp, human
gagggcaatcagcagcagca

SEQ ID NO: 41653 - DNA, 20 bp, human
gctctggactcgatataagt

SEQ ID NO: 41654 - DNA, 20 bp, human
gctgggtcacttccaaaggt

SEQ ID NO: 41655 - DNA, 20 bp, human
gcaagtggtggtcctccgtg

SEQ ID NO: 41656 - DNA, 20 bp, human
gcccccaggaaagcctatgt

SEQ ID NO: 41657 - DNA, 20 bp, human
ggcaagcagaaatctgtggt

SEQ ID NO: 41658 - DNA, 20 bp, human
gggctggaaactgagtgaca

SEQ ID NO: 41659 - DNA, 20 bp, human
ggaaatctgtggtgggcggg

SEQ ID NO: 41660 - DNA, 20 bp, human
gaaggagaacgtgtctgtaa

SEQ ID NO: 41661 - DNA, 20 bp, human
gtgcaggcaggccatccccc

SEQ ID NO: 41662 - DNA, 20 bp, human
ggatcaccaaagaactgaat

SEQ ID NO: 41663 - DNA, 20 bp, human
ggcatcacttacaggaaggg

SEQ ID NO: 41664 - DNA, 20 bp, human
gcaccaaagaactgaatggg

SEQ ID NO: 41665 - DNA, 20 bp, human
gtgctctgcaataagagctg

SEQ ID NO: 41666 - DNA, 20 bp, human
ggccatgttgtgaggccggg

SEQ ID NO: 41667 - DNA, 20 bp, human
ggccccccggcctcacaaca

SEQ ID NO: 41668 - DNA, 20 bp, human
gtcacaacatggctgagacg

SEQ ID NO: 41669 - DNA, 20 bp, human
ggatcccgtttggtccaaag

SEQ ID NO: 41670 - DNA, 20 bp, human
gctctgtctcggtgatgcta

SEQ ID NO: 41671 - DNA, 20 bp, human
gggaaaaaggacactttctg

SEQ ID NO: 41672 - DNA, 20 bp, human
gccgtttggtccaaagggga

SEQ ID NO: 41673 - DNA, 20 bp, human
gtttcttgggggctctgtct

SEQ ID NO: 41674 - DNA, 20 bp, human
gtcagccatgttgtgaggcc

SEQ ID NO: 41675 - DNA, 20 bp, human
gggctgagacgaggtgccca

SEQ ID NO: 41676 - DNA, 20 bp, human
gttcgtatcagaaaaggcag

SEQ ID NO: 41677 - DNA, 20 bp, human
gatgaggaggacgtgaggac

SEQ ID NO: 41678 - DNA, 20 bp, human
ggaaactgttaaccttgaca

SEQ ID NO: 41679 - DNA, 20 bp, human
gcggaaatggaaatcctaga

SEQ ID NO: 41680 - DNA, 20 bp, human
gtttaatttcttgtccgtat

SEQ ID NO: 41681 - DNA, 20 bp, human
gaaaaaaagattgtcggaaa

SEQ ID NO: 41682 - DNA, 20 bp, human
gaaggactgtcacattccct

SEQ ID NO: 41683 - DNA, 20 bp, human
gaccgataaaacagagaagg

SEQ ID NO: 41684 - DNA, 20 bp, human
gaggcagaggatggccctgt

SEQ ID NO: 41685 - DNA, 20 bp, human
gggagcatgaggaggacgtg

SEQ ID NO: 41686 - DNA, 20 bp, human
ggaccttgccggaggagggg

SEQ ID NO: 41687 - DNA, 20 bp, human
gaaggcagagtcccccctca

SEQ ID NO: 41688 - DNA, 20 bp, human
gcatggcggtgtcctcagag

SEQ ID NO: 41689 - DNA, 20 bp, human
gaacatagacagagctccca

SEQ ID NO: 41690 - DNA, 20 bp, human
gtcagggctgccaccgagca

SEQ ID NO: 41691 - DNA, 20 bp, human
gagaaacacggccacacccg

SEQ ID NO: 41692 - DNA, 20 bp, human
ggtgtttcttccctgctcgg

SEQ ID NO: 41693 - DNA, 20 bp, human
gtgccgcccctcctccggca

SEQ ID NO: 41694 - DNA, 20 bp, human
ggggagcctgtgtcaaccat

SEQ ID NO: 41695 - DNA, 20 bp, human
gctatgttcaagggccgggg

SEQ ID NO: 41696 - DNA, 20 bp, human
ggcctgagaggacttagata

SEQ ID NO: 41697 - DNA, 20 bp, human
gagggcagggagcgaatcct

SEQ ID NO: 41698 - DNA, 20 bp, human
gtgtctcagaggacacccta

SEQ ID NO: 41699 - DNA, 20 bp, human
gctcagaggacaccctaagg

SEQ ID NO: 41700 - DNA, 20 bp, human
ggacttggtgggaggttcct

SEQ ID NO: 41701 - DNA, 20 bp, human
ggagaggacttagataaggc

SEQ ID NO: 41702 - DNA, 20 bp, human
gaggacaccctaaggtggga

SEQ ID NO: 41703 - DNA, 20 bp, human
ggataaggcgggaaagattc

SEQ ID NO: 41704 - DNA, 20 bp, human
ggttggcaggagacaggggg

SEQ ID NO: 41705 - DNA, 20 bp, human
gctggttggcaggagacagg

SEQ ID NO: 41706 - DNA, 20 bp, human
ggcctggccgcagtccccca

SEQ ID NO: 41707 - DNA, 20 bp, human
gggccccgacagcagcgaca

SEQ ID NO: 41708 - DNA, 20 bp, human
ggcctgagaggacttagata

SEQ ID NO: 41709 - DNA, 20 bp, human
gagggcagggagcgaatcct

SEQ ID NO: 41710 - DNA, 20 bp, human
gtgtctcagaggacacccta

SEQ ID NO: 41711 - DNA, 20 bp, human
gctcagaggacaccctaagg

SEQ ID NO: 41712 - DNA, 20 bp, human
ggacttggtgggaggttcct

SEQ ID NO: 41713 - DNA, 20 bp, human
gaggacaccctaaggtggga

SEQ ID NO: 41714 - DNA, 20 bp, human
ggataaggcgggaaagattc

SEQ ID NO: 41715 - DNA, 20 bp, human
ggagaggacttagataaggc

SEQ ID NO: 41716 - DNA, 20 bp, human
ggagcggctccagatgacag

SEQ ID NO: 41717 - DNA, 20 bp, human
gcagcgggaggccgcaagag

SEQ ID NO: 41718 - DNA, 20 bp, human
gaggcgcgcgcggagagctc

(The sequence listing continues in the following parts.)

What is claimed is:

1. A method of screening for one or more genes that modulate a phenotype, the method comprising:
    contacting a plurality of cells with a library of structurally distinct small guide RNAs (sgRNAs) that target at least $10^4$ genes, thereby generating a plurality of test cells, the plurality of test cells each comprising:
        a small guide RNA (sgRNA); and
        a nuclease deficient sgRNA-mediated nuclease (dCas9) that recognizes a PAM site having the sequence NGG,
    wherein the dCas9 comprises
        a dCas9 domain fused to a transcriptional modulator;
    selecting the test cells on the basis of the phenotype;
    quantitating a frequency of the structurally distinct sgRNAs within the population of selected test cells, wherein the sgRNAs that target the at least $10^4$ genes that modulate the phenotype are overrepresented or underrepresented in the selected test cells, wherein:
    i) the sgRNAs that target the genes are overrepresented or underrepresented within the selected test cells relative to the frequency of the corresponding sgRNAs in the sgRNA library; or
    ii) the method further comprises contacting a plurality of control cells with the sgRNA library, wherein the plurality of control cells are not subject to the selecting on the basis of the phenotype, and the sgRNAs that target the genes are overrepresented or underrepresented in the selected test cells relative to a corresponding frequency in the plurality of control cells; or
    iii) wherein the sgRNAs that target the genes are overrepresented or underrepresented in the selected test cells relative to the corresponding frequency in the test cells at an earlier time point in a culturing of the test cells;
    wherein at least a majority of the library of structurally distinct sgRNAs are targeted to a region between −50 to +350 relative to a transcription start site of the targeted genes if the transcriptional modulator is a transcriptional repressor; and −400 to −50 bp relative to the transcription start site of the targeted genes if the transcriptional modulator is a transcriptional activator;
    wherein a majority of the at least $10^4$ genes are targeted with no more than 25 structurally distinct sgRNAs and wherein the structurally distinct sgRNAs of the library comprise binding regions:
        (i) beginning at the 5' end with a guanosine nucleotide;
        (ii) having a length of between 19 and 21 nucleotides;
        (iii) lacking a UUU sequence; and
        (iv) targeting a genomic site in which the PAM site having the sequence NGG is not followed by a G.

2. The method of claim 1, wherein the library of sgRNAs contains at least 50,000 structurally distinct sgRNAs.

3. The method of claim 1, wherein the selecting the test cells on the basis of the phenotype comprises selecting the test cells on the basis of protein expression, RNA expression, or protein activity, or wherein the selecting the test cells on the basis of the phenotype comprises fluorescence activated cell sorting, affinity purification of cells, selection based on cell motility or culturing the cells, thereby selecting the test cells on the basis of cellular proliferation.

4. The method of claim 1, wherein the sgRNA is encoded by an expression cassette in the test cell, the expression cassette comprising a promoter operably linked to a polynucleotide encoding the sgRNA.

5. A method of identifying a lead compound for treatment of a phenotype, the method comprising:
    performing a method according to claim 1, thereby identifying a gene that modulates the phenotype; and
    identifying or screening for a lead compound that modulates
    expression of the gene or activity of a peptide encoded by the gene.

6. A method of identifying interacting genes, the method comprising:
    (i) performing a method according to claim 1, thereby identifying a plurality of structurally distinct sgRNAs that target genes that modulate the phenotype;
    (ii) contacting a plurality of test cells with a library comprising a plurality of pairwise combinations of the structurally distinct sgRNAs identified in (i);
    (iii) selecting the test cells based on the phenotype; and
    (iv) quantitating frequency of the pairwise combinations of structurally distinct sgRNAs within the population of selected cells, wherein the pairwise combinations of structurally distinct sgRNAs that are overrepresented or underrepresented in the selected cells are predicted to target interacting genes.

7. The method of claim 6, wherein the pair wise combinations of structurally distinct sgRNAs comprise a first member and a second member of the pair, and wherein the first member and second member target unlinked genes.

8. The method of claim 6, wherein the pairwise combinations of structurally distinct sgRNAs that are overrepresented or underrepresented in the selected cells are overrepresented or underrepresented relative to the frequency of first and second members of each pairwise combination in (ii).

9. A method of optimizing an sgRNA, the method comprising:
performing a method according to claim 1,
wherein the plurality of structurally distinct sgRNAs target different regions within or next to a single gene,
wherein the most overrepresented or underrepresented sgRNAs in the selected test cells are identified as optimized sgRNAs that target the gene.

10. The method of claim 1, wherein a majority of the library of structurally distinct sgRNAs comprise binding regions having at least one of the following:
(i) a binding region that targets a gene that is at least 1 bp apart from a gene targeted by another sgRNA of the library;
(ii) a GC percentage of between about 40% and about 60%; and
(iii) a methylated or fluorescent nucleotide.

11. The method of claim 1, wherein a majority of the library of structurally distinct sgRNAs do not contain a nucleotide sequence of three or more repeated nucleotides, excluding a 3' transcription termination sequence of the structurally distinct sgRNAs.

12. The method of claim 1, wherein a majority of the library of structurally distinct sgRNAs lack a binding region having three or more nucleotide mismatches between the binding region and the targeted gene.

13. The method of claim 1, wherein a majority of the library of structurally distinct sgRNAs are targeted to non-overlapping genes.

14. The method of claim 1, wherein a majority of the targeted genes are targeted with 10 or fewer structurally distinct sgRNAs.

15. The method of claim 1, wherein a majority of the library of structurally distinct sgRNAs are targeted to a region of between 0 and 350 base pairs downstream of a transcription start site of the targeted genes; and wherein the transcriptional modulator is a transcriptional repressor.

16. The method of claim 15, wherein a majority of the library of structurally distinct sgRNAs are targeted to a region of between 25 and 100 base pairs downstream of the transcription start site of the targeted genes.

17. The method of claim 1, wherein the library of sgRNAs contains fewer than $5 \times 10^4$ structurally distinct sgRNAs and wherein the at least $10^4$ genes are targeted with less than 25 sgRNAs per targeted gene.

* * * * *